United States Patent 7,629,444 (NUCLEOTIDE AND AMINO ACID SEQUENCES FROM XENORHABDUS BOVIENII STRAIN XS85831 AND USES THEREOF) - sequence listing, part 4

SEQ ID NO: 14952 - DNA, 30734 bp, Xenorhabdus bovienii
  unsure (1)..(30734): unsure at all n locations
  Genomic contig Name=Xb4151_4152.C411
gcttccgaaattgaatggcttggtaacgccaacaacgggtcagaattccaagctccttaagcaatttcagccccaaccgggggctgcgccagtccccgtaccaccgcccaatgccggcagcgatgaataccatgtcggcacttccaggggcagtacgcaatgcttcgcgatctcttctgccgcagtacgnccgacttcagggtttgcaccagcgcccaatccttttgtaatgccgttgccaatctggatagtctgaccgacagctgttttgcgcagcgcctgagcatcggtgttaatcgcaaagaagtctacaccttcaatacgttcacgcaccatgtgctcaacagcattaccgccgccgccgccgacgccgatgactttaatcaccgcgtcgttggttaattccagtggttcaaacataatttctctccgttttgtgcctttatgtcgaggccggcgccattgtcgcggcctctgtataaaaaatcaaaattcttttctcagccagctgctgacttttttgaaccagccgctcactgacgttcttttatcggcatcagaatcgccaccaaggtgagattctttaccataatgcagaagcccgactgccgttgagtagcaaggctcctgcacataatccgtcagaccagtaatgttcaggggacggccaatacgtacttgggtatggaataccctctgagcacattcggccacgccatctatttgagctcctcccccggtcaagacaatccctgcggccagatgatgttttactccctgctgacgtaattgttcctgcaatcgcagaatttcatcattcactaaattcagcagttcggtataacgaggttcgatcacctcagccagagtctggcgttgcaagctacggggaggacgccctcccacgcttggaacctctacactttcatccttgctgactatcgaacccaatgcgcaaccgtgacgaaccttgatggtttcagcatcactcggaggggttccaaacgcataggcgatatcactagtgacgacatttcctgcataagggatcaccttggtatggcgcaatgcgccaccagtgtatactgcgatatccattgtgccgccgccgatatcaacgacacagacgcccaattcacgttcatcctcggtcagaacagcataacttgccgccagacccgcaaaaataagttgatcaactttcagtccacaacgttcaacagcttttacaatattttttgccatgtcgttatggcaggtaatcaagtgaacttttgcctgcatacgtacgccagaaagcccgaccggatttttgatcccttcctgataatcgatagcgtattcctgtgggatcacatgcaaaacacggtgttcatcacgaacacgaaccgatttggccgtatggacaacactgtccacatcgtcctgtgtcacttcttcttccgaaatcggcaccatgccaatttcgttctggcaactgatatgcttaccggaaagtcccagataaactgaagatatctggcagtccgccattaattcagcctgatcaatcgcacgctgtacgcatttaacgaccgattcaaggtcgttgacaccacctttatccataccgcgggatggacaacttcccactccgataatattaaccataccatcgggcagaatttcaccaaccagggcagatacctttgctgtcccgatttcaaggccaactaccaattttctgtccgttgatttgatcattgttattctgcctgtctctgtattattgccagtcactgttatttttctgcccgttgattgaaaccggcgcatcaattaataaaggagcccaacctaccgcagcgccgctgtcataacgtaagtctacataagccacgcgtttctccgtatttttctgcaacacaggataaagttcaataaaacgtttaatccgcttcacatcatttttatttcccagttccagccgaatgtcgttattcagaattaattgccaagcattacgctccgtcatgatcaccgttttcaatttcattttatgttcagtaaacaagggcgctactttgttatattctgccaatacctctttctctttaccttcagggccagaaagcatggcgtaatgccctttgacactacgctctatcggcaaactaaatacatttccttctgcatccagcatgtacgtatcattccaacgtacataaggcacgtattctaccagatgaatttttagttcatcaggccattgcttacgcacagtgacttgccgaatccacggtagtcgttctatctgcccctgaataatgttgacatcctgtgtcataaatgtcccgatagcgccaaatgccattattgctcgcctgacatcatcattcgtggtgtaatggcgttcaccagtcaacaccagttttgagagcgctaatctgtttgaatccttcatccagtccaatgtcatccagcctccccatacgatggtgccaatcaccatcaggaagaaaaaaatccctgctagatgatagccattactggggcgggagcttcgcgtttcactttctcgctcccgggtattccgggctgcctgtgacatatcaatcggccaactccagaattttcaccaccagctgtgaaaaactgagtccggactgacgtgcggccatcggtactaagctatggctggtcatacctggggatgtattcacttccaacagatagaaattaccattgccatcatccatgatatcaacccgaccccaaccactgcatcccagcgccttatacgcttttgatgcaatctctgccaactccagctctttttctgcactcaggccacttgggcagaagtatttcgtttcattggaaagatatttcgcatcgtagtcatagaacacttccggagcttggatacggatagagggtaaaacctcatcgcccaaaaatgccacggtatattcaggacccaacaaccatttttcaaccagcacatccgtgtcgtgctggaacgccagctccaatgccccacgcagttcggaataatcattcactttagtcataccaacactggaaccttccagattcggcttaaccattaatggaagtcctaattctcgaacatattcttggagttggaaatcattaacttgttcaaatttttgagcattaattgcggcatacggagaaaccggcaactttgctccctgccataactgttttgtgcgcaatttgtccattgacaaagctgatgccataacaccactgccggtataagggatttgcaaaaactccagtaccccttgcagcgtaccatcttcaccaccacgcccatgcagagcgatgaaggctttgctgaatccttctcctttgagtttagtcacatcaaagtcttttgtatcgactgaatatgcattaatgcctgcttctttcagcccggccacaacagattgtcctgattgcagtgaaacttcccgctcagcggaggttccgcccaatagaacagcgaccttctcaaccatgatgctctccctcattaaaagacggctgtaattttgtttcagccagattgcgcgctattttaccgatattaccggcaccctgaaccaacactaagtcattgttttctattacctgtgacagcatggctgaaatttgctctgaatctgacacaaaaatcgggtccaatttcccacgactacgaatggtacggcacaaagagcggctatcagcccccggaattggggtttcacctgccgaatacacatccagcatcaatagaacatccacttgactcagaatattggcaaaatcatcatataaatcacgagttcttgtatagcggtgcggctggaacagcatcacaatacgcttatctggccaacccgccctcgcagccttaatcgtggcatcgacttcggttgggtgatgaccataatcatccaccagcatcacgcgaccttctttgccattaatatgtttgagggagaattcacccagaaaatcaaaacggcgccccgttccctgaaattcagccagtgaagccagaatagcagcatcattgatcccttcttctgtcgctacagcgacagcagcggttgcattcagcgcgttatgacgcccaggtgcattcaatacgacatgcaattctggcaagtcgtcacggctgatggtgaaaaacccctgcgctgccttctgctcgtaatgtgtaatgcggatgtctgcttcttcgctgaaaccataggtcgtgatataacgtccaatgcggggaattaactctttcacgacaggatcatcaatgcacatcacggcacgaccataaaatggcaagttatgtaggaaattaacgaatgtctgtttcagattttcgaaatccccctgataggtatccatgtggtcagcttcaatattggtgataaccgccaccataggctgcaagtgcaggaaagaagcatcgctttcatccgcttcagcaatcaggtaacgactggttccaagacgggcatgcgtgcctgcggccttaaccagccccccattgacgaatgtaggatcaaggccagcctgagcataaatgccggcaatcatcgctgtcgtcgtcgtttttccatgcgttcccgcgatagcgatgccatgccgataacgcatcagctctgccagcatttccgcacggcgaataaccgggatgcgggcttcacgagcggcaataatttctgggttgtccgcagagattgccgtggatgcaacgaccacactggcacctcgtacgttttccaaacggtgattaaaataaatggttgcacccagtgcgagcaactgttgtgtgacgggattgggtgccaaatcagaaccacttatctgataaccttcattagccaacacctcggcgataccacccatgccagcaccaccaatgccgacaaagtggatatgcctgacttttctcatttcaggcacggaaactcttaatttcgccaactgttgtgtattcacgttttaatcttcactagttatgtttacgtcgccgttctacttggaacggcctgaataattttcaacagcatcgatcaatgctgctgccacacgctcagttgcattaacgatggctactgaacgcgctttttctgccatttccagcaattgtggacgctgccactgtgtgagcagatctactacggcttcggccgtaaattgaggctgttcaagtatttttgctgctcccgctttttccagcggtaaagcattccaatattgctggcgatctttatgttgaaatggcacaaagatcgcaggtaatcctgctgcagaaacttcgctgaccgtcaatgcacccgaacgacacaccacgatatcagcccacgcataagcctgcgccatatcatcaataaattcagtcactttaaattcagatttagctgaattttcatattttctgtgtgtttcttcctgcgcaccttttcctgcctgatgccatatagtgatgtgaacacccatacgctcagccacttctggcatgatttgattcagaattcttgcaccctgactacctccaacgaccagtacacggatagatccttctcttcctgccagacgctgtgcaggcactggcagcgccagtacatcttcacgcacagggttgccgacaacaggtgcatcagaaaatgcgccgggaaatgcctgcaagaccgttttcgcaattttggccagccagcggttggttaatccggcaataccattctgttcatgcagaacaaccggaatgccacacagccatgcagcaattccgccgggtcctgagacatagccacccatacccagcacaacgtccggctgatagcggcgcatgatcgtttttgcctgccggatcgccttaaaaattctgacaggagccgcaaagagtgcttttattcctttgccacgcaatcctgaaatttggataaattcaatatcaataccctgtttaggaaccaaatccgcctccatgcgatcagcggttcccaaccagcggatttcccagccttgttcttttaaatgttgggcaaccgccagtcccggaaaaacatggcctcccgtaccaccagccattaccattaaacgccggtttctgccgctcatttggggctccttacaaacgcctgtgcttttgccagacgcacttcataatcaattcgcaataataagacgatagccgtagacatcacgatcaaactcgaaccaccgtaactcacaagaggtaatgtcaaacctttcgttggcaacatacctgacgctgcaccgacattgatgaatgcctgaaagctgaaccagatgccgattgcacaagccaaaaaaccagcaaagcgctgattaagctgtaatgctcggcgaccaatcatcattgcgcgaaaggcgacgaagaataccattgacaacactaaaaccacacccaaataacctaattcttcggccagaatagagaaaataaagtcagtatgcgcttcgggcagatattccattttctggattgaatttcctaatccctgtccgaaaaagtccccacgaccaaatgccatcagcgattgtgttaactggtaaccgctgccgaacggatcatcccacggattaaggaaagaagttactcgacgcatacgataaggttcagcaacaatcaacacgcagacggcaaatattccacagccaatgatggcaaggaactgccacaatttggcaccggccagaaataatagcgccagcgttgtcacaaacaaaacaataacggttcccaaatcgggctgtgccaatagcagaatagccagcgcaatcatgacgcccatgggcttgcagaaaccccaaaagttgtttctcacttcttccacttttctaaccagatagctcgataggtaacagaaaagtgacaacttcgataattccgctggctgaatacgcaatgggccaattgccacccagcgcgatgcaccattgacagaactgccaaccagcagcaccacaacaagcatgatgatcgtgcccagcaatataatgttgctgtaacgctgccaaaactccattgggatgcgcaaggtgatgagtgataatataaacgccagcaccaagtaaattgcatcacgctgcgcaaaaataaacggatcttgtgcgagacgctgacccactggcattgaggccgatgtcaccatcacaaaacctatcacagctaatcccaatatcatccagaccagggtacgatcatacatgacgatatccgtggcatcggtctccacgttccccgtcagccaatttttaaatttaccgaggcctggaatagtcattagcctaactcctcggccaaacgggcgaattcatggccgcgatgttcaaaaccattgaactggtcaaagctcgcacaagcgggtgacagcagcaccatgtcgccagtcatcaacttcggtgcaattttcctcatcgcctgttccatcgtttctgtcaacacggaaatttcaggacgcaattgcgccagctgatttccatcacaaccaaaacagtaaaggcgaatgttatttcccgatacataaggttgcagtggagtaaagtcagcggcttttccatccccgccgagtaaaagatagagcgtaccttccaatgtcagtccactgagtgctgcctgagtactgccgacatttgttgccttggaatcatttacccaacgaacgccatttctcatatgcacgacttgaaaacggtgttccaatcccggataagtctgtaatgcctgaatactggcttcgcgagggatacctacagcatcagccaacgccaatgctgccaggccgttggtgtaattatgttgccctgttaaccgaatctgacgggtttccaataaagattgatggttaaccaccaattgttgacgtccactctcaagctggtaagcaccactatccacaccaaaactgatacagcggctatctttacctgcttccggcaatgtcaatgcatcctgttcattcaccacgcacacttttgcctgatcatagatacgcagttttgctgcacgatactgcgacaacccatcaggataacgaaccatatggtcttcagtgacattcagaacagtcgctgcggcagctttcagactgtaagtcgtttcaagctgaaagctggagagttccaatacatacaactggcaaggctgtttcagcagttccagtgcaggaataccaatatttcctcccacaccaacctgccatccggcttcttttgccatctccccgacaagagtcgtgacggtgcttttaccatttgaccccgtaatggcaacaatcggtgtcgtcgcctcacggcaaaacaattcaatatcaccgacaatttcaatgccggcgtcggccgctgcctgtaactcaggtgttgccagtgcaatacccggactggcaacgattaaatccgcgtccatcaaccattgtgtattcaggctaccagtgtgacacgcaacgtcatcaggcagcttatcgctgcccggtggcactaggcgggtatccatcacacgtggagtcacaccacgtgccatgaaaaagtcaacgcaggagaggcccgtcagccccaatccaacaataacgacttttttacccaaatattcagccatgattaacgtaccttcaacgttgccagaccaatcagtaccagcaccagggaaataatccagaaccgcacaataacgcgtggctccggccagcctttcaattcatagtgatggtgaatcggagccatgcggaaaatacgctgcccccgaagcttgaacgatcccacctgcaaaatgacagatagcgtttcgacgacaaataccccgcccatgatgatcagcaggaattcctgacgcagcaaaaccgcaatagttcccaacgcgccgcctaaagccagtgaaccgacatcccccatgaaaacttgcgccggataggtgttgaaccacaggaagcccaacccagcgccaacaattgcggtacagacaatcaccagttcactcgcgtggactaaatgaggaatgtgcaaataaagggcaaacttcacgttactcatcgcccatgccacgatagcgaaacccgctgcgacgaacaccgttggcatgatagccagaccatcaagcccatcggtcagattaacggcattactggttcccacaatcacgaaatacgccagcaggatgtaaagcagccccagttgtggcatgacttctttgaaaaatggcacaatcagttgtgttgcggcagtatctttacccatactgtacatggcaaacgccacacccaatgcgatgactgactgccagaaatatttccagcgagcaatcagccctttggtatctttacgaacaactttgcgataatcatcgacaaatcccactacgccgtaacccagcagaacggccagcacacaccagacataagggttatccagacgtgtccacagtaatatggacatggtgatagagaatagaatcagcaacccacccattgtcggtgtaccgcgcttactgaaatgggattctgggccgttgtcacgcacaacttgaccaatctgcaatttttgcaggtagccgattaaagttggtcccacccataatgcgataaatagtgcagtcaacaagccgacaatggctctgaacgtcagataggaaaagacgtgaaagactgtgtgatatttaaccaggtaatcagctaaccaaactaacattggaagttctccttcagtgtgttcactacctcttccattgcggcactgcgtgaacctttaattaaaatagaaatcatttcgtgttgttccagtaaaggaagcagcgctgcaactaattccgccttgttagcgaaatgctgtccccgaccacttgtttcactgatatgagaactgaactcaccgacgctcattattttgtctatttttgtcgatgccaaggcttcaccaacctgacggtgacactcaacggtttgatctcccaattcacccatgtcaccgacgaccataacgtgataaccgggcatctgtgacaaggtattggcggccgcaatcatggaaccgatattcgcgttatacgtgtcatccagcacgatttttccctctgcaagtcgaatagggaataagcgtcctgaaacaggcttcagttctaataacccggcacgaatatcactgagagaagcacccacagagatcgccagcgcactggcggccaatgcattggcaatattgtgtttccccggcagtggcagtgttacctcaatatttccaatcggtgtatgcagacagaaactcgttgccagcggttgctcctgaatgtcagtggcgtaaaaatcagcttctggcacgggtgaaacagcaaaccgccatacagcctgcggctcgctcataccctgctgccaatgcgtccaatcattgctatcgagattgatgatggcggttcctgctgatgaaagccccgcaaaaatttcgccttttgccttggcaactcccgccaaagagccgaagccttccagatgagccgcaaacaggttattcaccagcgcactttcaggacaggtcatttcagcggtataggcgatttcgccaatgtgattggcacctagctcaatcacggcaaattggtgttcttcagtcagcctgaacagtgtcaatggcacaccaatgtcgttattgaagttgcctgcggtataaagggtatgaccgcgttgacacagaatcgccgccgtcatctctttgaccgacgttttgcccgatgagccagtcagtgccactatccgtgctttactttgctggcgaacccaagccgccagtttgcccatcgccaagcgggtgttttccactaccacctgagggcagtcaatttcaaggcggcggttgaccaacaaagcaccggctccctgtttcgcgacatctgctacgaaatcatgagcgtcgaacttttccccttttaaggcaatgaacagtcctccacgcaccatttttcggctatcaatttccacggtattgatttggcaagtagccgcctgctgttcggaagtgtgatatagcacgccgcctgtcagttttgtcaattgcttgagtgtcagcggaatcatgcaattacccccagcagacgtgcaacagtcagacgatctgaataatctaaacggcggttgcctactaattgataatcttcatgacctttacccgccaccagtacgacatcctcttcagcagcctgcataatggcactggtcaccgcttcaacacgcccgtgaatcgccatcgcccgacccggatcgatgaaaccggtcagaatatcttcaacaatagaatggggttcttcactacggggattgtcatcagtcactatcacccgatcagcgccctgctcggcgataccgcccatcagtgaacgcttacctttatcgcgatcacccccacagccgaatacacaccaaagttggcctttacagtgcaatcgtgccgcagacagggctttttccagagcatcaggtgtatgggcataatccaccacgaccgtcggacgatctcgcgcagcaaagacttccatgcgcccacagacaggctccagacaggaagcggcttccaatagtttttgcagtggatattccagtgacagcaaggtagcgagtgccagcagcagattactgacattgaacgctcccataaggggactgttgagagttccctgcccccaagaggatgtaaacgtaatggatgcacctttgtcgtgatagtggatgtcactagtggataaccagcgccccgaccaatttttcggcaggcgattttccatcgtgacggccaccgtttcaggtaagcgggtaagccatttttgccccacatcatcatcggcattaatgattttctgttttacatcatgactgctgaacaacaaccatttggcctcttcgtaattttccatatcaccatgataatcaagatgatcacggcttaaattggtaaaaacggcggcttgaaatggcagggcggccactcgtccctgcactaaaccgtgtgaagaaacttccatcgcggcaaaagtggctttttgattaacgagctgctgtaaatcgagctggatatcaacggcggaacccgtggtattttcacttggaactatcattcccaacaggccatttcctaccgttcccattacggcactgatttccccaagaccctgactccattgtgccagcaattgtgtcgtcgtggttttgccgttggttccagtaactccgacgagtttcagtttattacccggatgctggtaaaattcgcctgccaattttgacagtttattattgagatcatccagatagataaccggaacaccgtgcattgcttgaatggtgccgttatccgtttttcccttcgcttctgcaatcaccgcagcaacaccttgagcgatggcttgaggaatataatttcggccatctgtctggtgccctttaactgcaacaaacagatctccggcagccgccttacggctgtctaatgtcatttcgcgcagcggaagctccggagtatcaacaccccatggagccagtaaatcgcgtaaattacgatctgccacttttatcctctttattatcaatcacaaattcttttttatcatccgcaggcagtgcgtcgggttcaacgttcatcgtacgtaaaacaccactcatgatagtgccaaagatgggcgctgaaaccgcaccgccataatatttaccggcttgtggatcattgatgattacaaccaatgcaaaccgtggattacttgcaggggcaatccctgcggtataggaaagatatttattaacgtattttccatccggcccgaccttcttcgccgttcccgttttgattgcgatacgataaccttttattgcggcgcgtaccccgccgccgccgggtagtgccacactctccatcatgtgaacaactgtgcgcataatgggttcaggaaatacgcgggttcccggtataggagggtctactttggtaattgacaacgggcgatagataccaaagctgcctatcgttgcatagactcgcgctaactgtaacggtgttaccatcagcccgtagccgaaagaaaaggtggctctctcaagatctgaccagcgttctcttttgggatatatgccactactttctccgaccagccccaaattggtcggttttcccatcccaaagcgggaataaacatttaccagttccgaggcaggcatcgctaacgccagtttagaaacacccacgttactcgatttctgtaaaatcccagtgatggttaattcagaacgcggggcaacgtctttgatttgatgcgaacgcgctccataagccaatcgataaggtttggtatccagcactgaattttctttaacaatgttaaggttcaacgcactcatcaccactagcggttttaccgtagaaccgggttcaaaaatatccgtgatggcacggttacgcatcgcatctttcggcgttcccgccagattattcgggttataggatgggttgtttgccattgccagaacttcgccggtttttacgtcaatcaatatggccgtaccagactcagccttattaagtattactgccttggtcaattcacggtagaccaaagtctggagacgctcatcaatgctgagagccagattgtgggcagcctgactgtcagtgaacgaaacatcttcaatgacccgtccattgcgatccttgcggacaattcggctccccggcttacccgtcagccagttgtcgaagctcttttccactccctcaatgcctttgtcgtcaatattggtcacgccaataatgtgcgcggtcacctgccctgccggataataacggcgggattcttggcgcaaatagatgccaggtaatcttaatttttcgacataatcaccaatggaggtattgacctgacgggcaagatagacaaaacgcccctgtggataatcctgaattttacgggtcagttgattaagcggtatggaaagcgtgtcagctaacgcttgccagcgcgtatcatccgttatgccgcctttttcaaagatttctttgggatcagcccaaactgcatcaaccggtacgctgaccgccagagggcgcccattccgatcggttatcataccgcgagtagtcggaatggactggacacgtaaggaacgggagtcaccttcttttagcaaacggtcaggattgataatctgcaagtaagcaacacgaatcaaaagcccgaacaaagcaaacgaaatgcccccacacagcaaagcaaagcgccagcttacaaaactggctttatcttcttgcttcttcaactttaaagagcgtgcagctttcatcgcctacctttgagttgttaactgaacttattgagttataacaatattttcttgcgccggatcaacatgttgcatatgcaatgtttcagtcgctatattttcaacgcgactgtgatcaccgagggcattctcttcaagaagcaggttacgccactcaatatccagagaatcaaaatcaatcgccgagcgctctttttccgctatcaataagcgggttttatgggcaaccgtcacaacgctaatggccgaaatgattaccgctatcagcaaaaccagtgggatcttggcattgcggattaaatccctgccaatgacccccactaatccatgacgctcacctgccatttactcacctgccttttcagcaaatcgcaatacagagcttctcgctctagggtttattaccacttcgtcctctgaaggcttcagtttgccaattgatttcaggctgcgtcccccctgagcttttaactgcgtttcagtgagaggtaaaccggctggaacctgtggcccccggctgtgctgccggataaaacgcttcacgatgcgatcttccaacgagtggaaactgataactgataatcgcccctgcggtgccagaacctgcaatgcaccattcaatgcgcgttctatttcttccagttcactgttaatgtagatcctgatagcctgaaaactgcgcgtcgctggatgcttgtgcttttccttaaccgggcttgcctgagcaatcaactccgccagttctctggttcgggtgatttgcccttcctgattgcgggctacgatggctctcgcgatacgtttggcaaaacgttcttccccaaaggttttcagtacccatgcaatatcatcagcttcggccttcatcagccactctgtagccgattgccctcgggtagggtccattcgcatatccagcggcccgtcacgcataaatgaaaaaccacgttcaggatcatccagttgtggggaggaaacccctaaatccaacaacacaccatcaatttttccgaccagtcccgcttcttctatataggtagccaattcggaaaatggcccgtgagtaatggaaaaacgcgggtcagtaatggctttcgccgcttcaattgcctgcggatcgcgatcaatcgcaattaaacgcccatctgcccctaattgagacaaaatcaggcgagaatgccctcctcgcccgaatgttccgtcaatataaattccattttctcggatattcagtccattgacagcttcgtccagtaatacactggtatgcttataatgactatttgccatatttatagtgataaatcctgtagccttgctgataaaggttcttgtgtggattgttcagcctcaatatcattctgtacttgctgataccaggcttgctcatcccacaattcaaatttattaaattgcccaaccagcatgacctcttttgttaaccctgcgtgctgccgcagtgtattcgctaacaaaaggcgccctgcactgtccatttggcattcactggcgtgccccaataacaaacgttgaacgcgacgttcggctagattcatgctggataggcgagataacttttcttcgatgatttcccattcgggtaatgtgtaaagcaacaggcacggctgatggagatcaatggtacaaaccatttgacctgtagattcctcattcagcttttccctatatcgggcaggtacagtgagtcgccctttactatcgagattaaccagtgttgctccacgaaacatactcaggttaccccttgatggtaaaaatctccacattatcccacaaatcaccacaattaagagtttacggatggtatgaaaaccttgtcaagccagagcccatgtgctttagctagatttacagaaagatttcagagagaagaagagagatttttcagatttggcaatattaataatagataacactatgataattttaaataaattaacgatgatggaaagtatattcttagaaaaaaaatttaggttaaataattaccacttaaattaatttatgtaactaaagtctcattgcagcctaattgttacccaaatgaaatctattagtaataaaaatacatttaagttataacatcgaaaaaaataatcacaaattgaaatttaatgactattggggataaaaaatgattaaatatcaaatcaataaaaaaatctctccatcacagaagtaaacgatgtaaatcgtctgactttacgtgtagatcattcaccttgccatttttagtaacaagttatcggattttcaggtcataaaactctgctcaaaagaattttagtcagaatagtcttaaagttacgttaactaacgtatttcaaagagtttgatcgtattaataaggcaccctcatattcaatgagggtactcaatcaagcttttctactcaggcttccacgacggcataaatgacgacgcattcgagttattcctggctctggccgctttttttcatccaaactggccaataccagttcaagggcacattcagccacgtcacggtggcgttgtgcgacggacagcaccggacattcaagaaaatcaagtaattcatgatcaccgaacgtagcaatgaccaactgctcaggtaaccgaccactgcgcttaaggagggtatccatgacgccttgcagcaaggaaaatgaggttgtgtagagtacttgaggtacaggattattttccagccatgaagcaaagacttcagccgcagcttcacgttcatagctgttcgcatacaggtagttcacttcacgctgatcactttcccatgcttcacgaaacccctgttcacgtaagaaactgaccgataattcaggtaatgctcccagataaagaacagattctgacggaaattgacgcagctcctgtgccagcattttcgcatcttcgaggtcatcccccacaacactgataaagtgttcgctgtccaatgcacgatcaagcgcaataattggcagtgaacggtttgtccaacgttgatagaaaggatgttcaggaggcaacgcagtggaaacaataatggcatcaacctgccgttgcagaagatgctcaacacagcgcatttcgttatctggctgatcttcagaacatgcgatcaatagctggtatccacgttgccgtgcctgacgctcaagatagttggcaattcgggtatagctcgtgttttccaaatccggtatcactaagccaattgaacgagtacgccccgcccgaagaccggcggcaacagcattgggatggtaattgtgctctctgaccaccgccatcactttttctactgttttatcgctgacccggtactgcttggctttaccattgataacataactggccgtggtacgtgaaacccctgctaagcgggcgatctcatccagtttcacattaatccctcagtaagatgatgaaaaaaccctactttacagtagggttcgttaaagatctgtatattaacccgcagattgcgatttttcatcgcataattttatccccgcgagcgataccaacaatgcctgatcgtgccacttccaggatctcagcaacatcgcgcacggcatcaagaaacgcatccagtttttcactcgttcctgccaattggacagtgtatagtgctgacgtcacatcaacgatctgcccacggaatatatccgtgctgcgcttgatttcttcccgtccatagccactggcctgcaatttcaccagcatgatttcacgctcaacatgagcacctgcggtcaattcactgacccgcagaacatccaccagcttatgcagttgtttctcaatttgctctaataccttagcatcacccttggtctggatagtcatacgtgacagagttggatcttccgtaggggccacagtcaggctttcaatgttataaccacgttgagaaaacaggccaactacgcgggataacgctcccgattcgttttcaagtaatacagacaaaatccggcgcatgatcaggtcctctctgttttgcttaaccacatttcatccattgctccaccccgaatctgcattggataaacgtgttctgtttcatcaacggtgacatcgacaaaaaccagccgctggttttcagtgacttcatgcaaagcctgagccagtttattttccagttcttcgtaagtttggatggaaacaccaatatgaccataagcctctgccaatttgacaaaatcaggcagcgattccatataggattgagaatgacgacccgcgtaaatcatgtcctgccactgtttcaccatacccagaaaacggttgttcaaattcagcaccagaacaggcaagccatactgcaatgcagtggataattcctgaatattcatctgaatactgccatctcctgtcacgcacactactgtcgcatcgggctttgccagcttcaccccaagcgcggctggcaagccaaatcccatcgtgcccaaaccaccagagttgatccaacgcctcggctcatcaaagggataatacagtgcggcaaacatctgatgctggcctacatctgacgagagatacgccttgccttcagtcagacggtaaagcgtttcaatcacggcctgtggcttaattttcgcggtggtgcgatcgtaaccaaggcatttgcggctacgccattgttcaatggaaagccaccagtctttcaatgcatccggatcctgagtgtcttccagagtattcatcaattccagcatttggccgagtatctgtttggcatccccaacgatgggaatatccgccgacacagtttttgaaatagaggccggatcgatatcaatgtgcagtacaatggcttctggacaatatttttccagattattggttgtgcgatcatcaaaacgcacacccaccgcaaaaatcaaatcagaattgtgcatcgctttattagcttcaaacgtgccatgcattcccagcattcccagactctgacgatgagtggcaggaaaagcgcccagccccatcaacgaactgacgaccggaatgtgcaaacattcagccaatttcagcaactctgatgaacatgccgaattgatggcgccgccacctacgtagatcaccggctttttcgcatccagcagagttttcaacgcccgtttaatctgtcctttatgcccctgaacggtaggattgtaagaacgcatgctgattttttccggataaacatacggaaatttcagtgccggattgacggtatctttgggaaaatcgatgacaaccggaccaggacggccagttgtcgccaaatagaaggctttcttaatcgtatttggaatatcttctgcttttttcaccagaaaactatgtttaacgatgggacgggaaattcccaccatatcgcattcctgaaacgcgtcattacctatcaaggagctggcaacttggccagacaaaaccaccattgggattgaatccatgtaagccgttgcaattcccgtgatagcattggttgctcctggcccggatgtcaccagaacaactccggcttttcccgttgaacgggaatatccatccgccatatgaacagcaccctgttcatgacgaacgagaatatgttcaattcctcccaccgtatgcagggcatcgtaaatatccagtactgccccacccggataaccgaatacatgtttaacgccttgatcgattaacgatctgacaaccatttcggctcctgacaacatctccattgagtttgcctccaggctctgtttgcaagttaatcgtcggaacttcataaaatcgccattaaaaacaaccttatttattccactttttatttatataaagtcaatctagtgttaactcattcgataacaccagattaattaacataacgttagagactaacgttagcaaacatcaattcacatactgagaacattaatctcgatacatggattcgatttcatcgtgataatgttgcgaaatcaccttacggcgcagtttcagtgtaggagttaattcgcctttttccatggagaaagcttctggcagtaggatgaagcgttttacctgatggtatttggcaatatttttttgtagttccgccaaacgttgttcaaacagttcgatgatctgacgattgttcagcaactcgatacgatcacgataatgaagatggatggattttgcgtaatcttctaatgcatcataactggggacaatcaacgcagaaacaaaattacgggaatcggcaataaccgcaatatattcaatgaaacgatcctgtcccaaagtcccctcaagcatttgcggagcaatgtattttcccgtcgaggttttcatcaaatctttcaggcgctcagtgatgaacaaattgcctgtttcatccaatccccctgcatcccccgtacgcagccatccatcttcggtaaaagcatgagccgtttcttccggctggttgaaatagcctttcatcacaatagggccacgtacctgaatttcatcttcggcactgatgcgcacatcaatactcggcaatggtgtgccaatcgagcctgggagatagtttttctcttcccagcaagataccgtggcacaagtttctgtcatgccgtaaccatatttgatattaatgccggcggatagaaaaaaccgggcaatagcatcgtcaagacgtgctcctgccacgggtaagaaacgcactcgccctccaaatatgttacggagcttgctcaacactagtttgtcggccagttgatcactacagagagagaagatacacgcttttttattctgtagctgacgcatccagcggttctccccccgctttatcgcccagcggaaaatcagcctgcgcaaaaatggcgcacgggaaactttttcaagaatagcactatgcactttttcataaaaacggggaacagcgcacataacagtgggacgtacttcagccatcgcctcgcgcacagaattggtgtcagttaaatagacattaagcgcccctgtatgcatgacatagtaactccatgcgcgctcgaagatatgggacaacggtaaaaaactgagtgatacatcttctttggtcagtgtcagacgctgatcatgcaagtaaagctgcgaagcgatattgtggtaatccagcatcactccttttggctctcccgttgtaccggaggtgtagatcaaggtgaaaagatcatttaaatcctgccctgcaatgcggttatcaagctctggctgatattgtgcgtgcgcattgacaatgaaggcagataaatactgcgcctgcggacagctcttcaagtcaacggactcgtccagcacaataagatgattgagttgagggcacaattccagcaatgtcatcgcaacattatattgttcttgctcaccaacaaacagtacccgcacaccggcatccttgagaatgaaggtagcctgatcacggctgctggtcgcataaagagggactgtaaccgcacgtaactgaagaacggccaaatcagccaatgaccatgcaatacagttatgcgcaaaaatagcgactttctcctgaatttctacacccagtgacaacaaagcttttgcgatggattccgttctataagtaacgtcttgccaactcatttcaagctgctctgatggtgaccattgcctgaatgcaatcttttcgggatattcaatggattgctgttgcaaccggttaatcaggtgataggaatgcagggaatctgttatcacgatatattcctgtataagtcttagatttatcatactcagcaagcacactgactgcttttcagcttacagatgttcgctattttcgcgcagtctacctattcctggtagaaggggaaagcgtatttttactctcttctcccccctaaggggggaagttttacaggacttatcggataactagggataaatagagacaaatatcgtcataaaggcagaacagtaaggccgcacacgctctccgacaatcggttccattagataatcttaatcatttgcaacaataatgcttgttaccatgacgtcatacaaaatgacatttgatgaaacaaattttggcagcgtcgtgcattttgttctattcctgttcaccaagattgctcagtaacgatttcatccactgatgacctttatctctgtttgtcgaaccgtgccatatcaaatagcaggggcgggagattcgtccgttgggcaagggtatcgcacgtatatttaactgttcagaataatgctcaaccatccatttcggtgcaatagcgactaaataagtctgagacacgatattgagaacactatttaagtccgttccctgataagaaacagaacgcaacaattcattactttcatagtaaggtttactgaatgaatccacattatccaatgccacaattgcatgcctctcttcctgcaattgctgctgattaatgcgtttactgattcgaggatgcgttttggaaactgccaaaaccaattcatcattaaacaatggagaattatgaaaatcaggctgatctaattgtatataactgataacgaattctatttcctgatattttaattgtttctcaatatttccattgatttgtgttttaatgacaacttcgatatttggcgaatgtttttttattcccccaacaatttgggcagctaaacgaatatcaagcgggctgcaaatagagagattaaataccctcgcactattatcgggctcaaaccccacaccaggcaactcattatggacaatctgaagtgcttgtcggagcggcccaaagagctgttttgcccttgccgttggttgaatgcctcggccatagcgcacaaataactcatcatcaaacatagtttttaagcgggctaccgcattactgacagccggttgtgacattcccagcgcctgagccgcacgtgtaatattctgcatttgcattacagcatcaaacacagtaagcaaattgagatccacactacgcaattgcacttcacatgattcttttcttcttgttgttactgaattatacccagtcattacttcactccactaaatttattgcagcgacctcattaaataacggaatattggcagtatcccaatgcaacattttgacacaataagccgccataccaattaataagatcaatcaccccaatttgttagaaattaaattgagctccttccttgtacaaaaataaatatgcataaccaatgcattcttatttatacgacgttaatattcttataagcatgaatattaattttttatgtatgaatagaaataactcgaattacattagtcacttacgcgtaaaaattcgcaaccaataatgtcagagtgacgagtagaaacaattcataataaaataatggtgttccttctatctatcagaaaaattatcaggctatattaaccaaaaatcagatcttccaatatatttaggtacatcttattaatattctatatggttatgttttcttaacctagaaacactgcggtgaacatccatctcatccctgtctgttaatccatcagtgaacatctgcacaaaacaactgtataaaacaactgtataaaataacagataccctatttattatccattagagccgaattttacttcatatatagatacaaataatagataaaaacattgctaaaaatgtaaaaaatagtcaccaaaactaaaagtagttcggtaaatgaccaaaggtgagtatcattcactcttgattcatatttgttccgcttgacattgttttgaagataacgtatcaataaaagtccttaggtcgtcatactcgattaacagatttataaaggttagcttacatgattcacactattcgcctactaaaccgactactcatcgcctttaatgtgcgcggtatgctggtaggggaaagacagagttaacctccatcagatgtgaaaaaaaccgcgctgggcgcggtttttttataccggctcggcgctcaagaatcaaacacaataatttattgataggagcacaacatgagccagcaagttattatcttcgataccacactgcgtgatggcgaacaggcattacaagctagcctgagtgtaaaagaaaaactacaaatcgcttatgcactggaaagactcggggtagatatcattgaggcggggttccccgtttcttccccgggagattttgagtcggttcaaaccatcgcccgtgagatcaaaaacagccgcatctgtgcattatcccgttgtgttgataatgatattgatgttgccgccgaatccctgaaagtcgcagaagccttccgcctgcacctgtttttggcgacctctagcctgcacgtcgaacataaattgaaaaaagaatttgacgatgttgtcgaaatggccgttcgttccatcaaacgtgctcgcagatacaccgacgatattgaattttcctgcgaagatgccggccgttcgaatatcgacagcttatgtcacattgttgaacaggcaatcaaagcgggcgcaaccaccattaatattcccgataccgttggctataccacgccttatcaatttggcggcattatccagaatttatttgaccgagtccccaatattgataaagcgattatttctgtccattgccatgatgacttgggtatgtccgtggcaaactcgattacagcggttcaggccggagcccgtcagatcgaaggcaccatcaacggcttaggggaacgcgcgggaaactgttcgctggaagaagtgatcatggcaatcaaaactcgccaacaaatattagacgttcacactaatatcaaccacaaggaaatttaccgcacctgccaattggtcagccagatctgtaataccccaattccggccaataaagcggttgtcggcagtaatgcttttgcccactcatcaggcattcatcaggatggcgtcctgaaaaaccgcgaaacttacgaaatcatgacgccggaatccatcggactgaaagatacccaattgaacctgacctctcgctctggccgtgcagccgtgaaacaccgaatgtctgagatgggctatcaggagcaggattataatctggataccctgtataaagctttcctgcgtctggcagacaaaaaaggtcaggtgtttgattacgatctggaagcactggtattcatcaatcagcaacaacaagagaatgaatattaccgtctggattatttcagcacccagtccggtacccacatcgtaccaacggcaaccgtgcgtctggcctgcggggatgaaatcaaatctgaagccgctacaggcaatgggactgttgatgctatctatcaagctatcaaccgcattaccgggtattcactcgaactgatctcctatcagttgtccggcaaaggacatgggaaagatgctctcggtcaggtcaatattatcgtggaacattctggacgccgtttccacggaatgggattggaaacagatatcattgaatcctctgccaaagccatgatccctattctgaatagcatctggcaggcagaacaggtcgaaaaagaaaagcagcgcatacaaagcaatacctcccaaaataatttccctaataacgatacaaaggaaactgcataaccatgacaactccccctactatacacaaacaagactctggcagttatcacattgcggttttgcctggtgacggtattggccccgaagtcatgagacaagcctataaagtattggatgcaatccgccagcgttttaacctccacataacaaccagcgaatatgacatagggggcattgcgattgatcgtcatggttgcccgttgcctcaaacaaccatcgccggttgcgaaaaagccgatgcactcctatttggttccgttggcggccccaaatgggaacatttgccccccgcagaacaaccagaacgtggtgcgctgctaccactgcgcaaacacttcaaactgttcagcaatttacgcccggcgcgcttatatgcgggtttggaatctttttgcccacttcgccaagatatcgcggagagaggttttgacattttatgcgttcgtgaactgacgggtggcatctattttggtcaacccaagggacgggaagggaaaggaaaatatgagcgggcttttgataccgaaatctaccatcgtttcgagatagagcggatcgcccgtatcgcttttgaatctgcccgtaagcgtcgtcataaggtcacatcaattgataaagcgaacgttttacagagctccgtactgtggcgtgaagtcgtcagcgaagtcgcaagagcgtactctgatgttgaaatccagcacatgtatattgacaacgccaccatgcaattgatcaaaaatccggctcagttcgatgtcctgctatgctccaatatttttggtgatattttatccgatgaatgcgccatgatcacgggttcaatggggatgttaccttccgccagcctgaatgaaaaagggtttggcttatatgagccagcgggcggatcagcgcctgacattgcaggcaaaaacattgccaaccccatcgcccagattttatctaccgcattgttactgcgttacagttttgagcgtgatgatgctgcaaacgccattgaacacgccattaaccatgcactggagcaaggctatcgaacaacagatttagcaggtaatgacaaagcagtcagtacggatgaaatgggcgatatcattgcacgttatattgccgaagaaatttaaggcaccaacattttacgccactgtatggtaaatagattcgataacatcgggcaggcattacagcatcaacctacatttctgtgttgaaagccgacactatctacctataccgagtaggatgaggggccatcattccatcctactatgaaatacctttgttaaaaaaatgcaggtgcggcgtagtatgaggggagtaaaaatgaacacgttcagagggtttgattttaaaactgcgtggttacccccctgcaaggataattcacagaaaaagctaaagttataaacatttttagtctggcgcccactattttattcactttttctgtggatatgtatgtgaaaaagacaggggtaagacgggtatatttttctttcatattttataatgcgtcataaacttaaataaatatttattatttttcattatcttaatgcattttattctcttttttacaagcgatatcagtcatcataatgacctattctgttcacactgagcaaatatcaatcaatgatgattttatccacaggatatgccttttagttaagcaaaaatcgtctgtttttgtagaaaacaggggttaacagagctgtaaatcaaaccagtgatctcaatttttatcacttatcccagaaatctgtggataacatagtgtaagatcctgtttattatcgctgggaataggtgaacaatcataacaagactatttttaatacggtaaacaccaattaaaaaatcttgtatatcatgctattatcaaggtaatcatcataatgataagttcataatgattatccataatcataccgaacattttttaaccataaaaaatatatgcgataaacatgtactttacaccgcccagtccacctgaaaatgaacaacaactactcgaacgagctaatgctctggctggtttatcaatgggtgagctggctgcgcaggccaatctgcccattcctcccgatctaaaacgggataaaggttgggttggcatgttgcttgagtattatttgggcgcaagtgcaggcagcaagccagaacaagatttcgaacatattggcattgaactaaaaaccatccctgtagataagaaaggctcaccattggaaacaacttttgtctgcgttgcacctttaacgggcaatagtggcattagatgggaaaattgccacgtcaggcgtaaattatcccgtgtcctgtggatacctgttgaaggggaaagggcaatctcacttgctgaacgccgtgtcggttcaccactgctctggagccccgatccgattgaagaagagctattgcgacgtgattgggaagaattaatggatttgatcgtattgggcaaagttgagaatatcaccgcacgccatggggaagtattgcaattacgccccaaagccgccaatagccgagcgttgacagaagctattggagaatttggtcaacccattatgacacttccacgcggtttttatttgaaaaaaaacttcacagctcccttgctggctcgtcattttttcttatgaaaacaatgcatgtatcatgcccgtttttgatgaacattcgcccattgcctaattcatgatattgatgtaatagcctgattgcattgcttcgcttgcagtgtgaagtgaaatttagtgttatctactctatctacttccaaattcaacaaggctcccggcgatattttcacttcggtaatgtcaacaagcccagataccggatgataactaagatagaaagtgccaaccaacggataactgccattgtccgtttttttgatataaatagagcatgtaagttggttactacaagccgttgatggaatatattcatattccatttcacttccacgcttacttgagaaaacctgcgcgttattgatcccttcagcatcaagtatcatcaaataggcgccaaccttagcgtcagttgtatctatcaaattcaaactgatagtaaaattgggttgccgataaaatgcaatattactttttccagccacaattatttcctcatttatactattagcgataaattaaattatataaacatttatcacaataatttaaaacggcacaagacgccgtactcaaacccgcataattattatttataaataaatttgtatcttttttatttttatttattattaatgatttaaataatgctgatatataaaattaaaacattgagttaaggaataatattaccatgaaacgactggtgatattttcctttcccgttatatagctaacttgtcttattactcaaaaatttctttacttttttcagcgccatttgtcttttcaagggtgataaataatcaataaaaacaatgccattcaaatgatcaatttcatgttgcataacaatcgatagaaaatcttcactttccaccaccatagccttgccatgacgatccaatgcttccactttcactttttcaaacctttctacatccgcgtaatatcccggtatatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtataatccagtaaaatttaatagaaaaaaacccctaaaatcataatgctataattaataatcgtcctcatcaaactccagtttttcccttgtatccctcccaaatacggnaaattgatatata

SEQ ID NO: 14953 - DNA, 42253 bp, Xenorhabdus bovienii
  Genomic contig Name=Xb4151_4152.C412
aaccgctcgttacccttattttattaaatctcgtttaaacgcctactaatcatccaatcatccccgaaaagaccgatatatgacctctcggggataattattacatccccgcaatctttttctcggccattttagccgaattagtgccaggatattgttttactacctgctgataaactgcttttgctttaactttctgtcccttttcttgcatgattaatcccactttgtacagagaatcactgcttttctgtgatttgggataatctttcacgacagtagcgaaataataagccgcgtcgtctttcttgcctttgttgtaattcagctgccctaaccaataattggtattcgataaatatttcgacttaggataggttttaacgaacgtttgaaacgcagagattgctttatcatattctttggtattaatcgccaaagcaaccgcagcatcgtaatcacctttttcactccccgtacttgtcggagcagcaggtggattaccatcggtttttgccgatggcgtggctgtattaccgccttctgtacctgatgatggattagtgattttatccaactgttggtaaatatctttctggcgctcaatgacttgatttaattgatactggttttcctggatctgaccacggagtgtatcaatatcacgttgagaatcagcaagctgttgttgaagttgagttaacaattgactgtgagcatcggaaatacgctctaattgagagaggcgctcatcggtggagcctgagccgacattactgattggcgcttgggcggtagcggcccaaggagccgctacgccaaccaataacgacagacccaacacataatgtctgaagttactgttcatgcattactcttagtatacgattacagcacgacggtttttagagtatgctgcttcgtcatggccaagtacagctggtttttctttaccgtaagaaacgatagccagttgatcagcagaaacacctttgccttgcaggtacattttcactgcattagcacgacgctcacccagagcgatgttgtactcaggcgtaccgcgttcgtctgcatggccttcaatggtcactttgatagatgggttgctgcgcaggaataccgcatgtgcatccagcatctgagcgaaatcgctgttgatgtcatacttatcgaaaccgaagtatacgatattgttgttttgcagctcttgcatctgctgacgtgctaattcttcagcagacagacctgctttagcagaattatcaacagtacctacaccagactgatcattgttgccatttttgttagtactacacgctgctacggccatgattggtaaagctaacatcagcccttttagcactttgttcagttgcatttctttgatccttttatagtttgccatacatattatttattatgcatcacagatacggcgaccaggcagggaatttaacctgtccatcggtagccggaagacgcgctttgaaacgcccgtcggtcgaaactagctgcaatacagtccccaacccttgagtggagctataaatcaccatagtgccgttaggtgcgatactcggcgtttcatctagaaacgtatctgtcaacatttggacagaccccgttcccagatcttgtttggcgatatgctgactgccacttgctgagctaaccatcacgataaaactaccgtcagagctaacatcagcatcttggttctgagaaccttcccaagtcaggcgctgtggagcaccgccattaatatcaattttgtacaactgcggacggccaccttgatctgaggtatagaccagtgtctggttatccggcatccagcttggctcagtattgttactacggccatcagttacctgacggatctgaccagaagccaaatccatcatgtaaagattcaaactacctgttttagatagtacaaatgcaagtttagtcccatctggagaaaatgcaggcgctccgttatgacgagggaacgaagcaacctgacgcactgctgtcgttgccagtgtttgaataactagcgcagagcgaccactttcaaacgtaacataagcaagttgagaaccatctggcaaccatgctggcgacattaatggttcaggtgagcggtgtacggtaaattggttataaccatcataatcagaaacacgcagttcatatgggtatttacccacgctcgacttcttgacaacataagccaaacgggtacggaatgcccctttaatacccgtcagtttttcaaatacttgatcactggcagtatgggcggcatggcgtagccattttttctcaattttaaattgatcctgagccatcaccgttcctggcgcgccagcagtatccactagctgatatgaaaccagataattgccgtctgcagcaggctggatttgcccaacaatcacagagtcaatcccgagggcagaccatgcagcaggtgttacctctgaagcagttgagggttgctgtggcatacgatttggatcaataggattaaatttcccactgtttctcaaatccgcagcaataattgaaccaatttcttctggggcattgcctgcacctgtccatttaaatggaacgactccaataggacgtgcagaatcaacaccctgtgtgatttcaatgcgaacttccgcatgagcaagcgctgcccacatcatcaaaaaacctaatactattttaaacgactgtttaaaagtttgcttcatcatgtctcccttatcgcgatcgtttatatgcccgcaataatccgccggattctaacaaaggccaacaaacaaaactagatacctaaataaaatctaataattttgtttgtatatataaattattcgtatttttaactgccaaataacgcttttttaccaaataattaccttactggggcttgaaatccagtgaggaattcttgaaatgctcataaatctctttactcggtggtcgtggaattttagtctggagagccgccgcaactgctgccctgcataacgcaggatcacccgcaccagccttaatatcaatcagcaggccatccggtgccagttttatccgtaactcacaagtacgtccgagatacaaactcggatcatgaaacttctgctggattgcagtctgaatttgccccttgtaattattgatatccgactgtgaagggccgcttttcttgccaccaccttgaccagccgccgatgccccaccctgcttaggtgcactggacgttaacccacccagcaggtcatcaacttcctgagcctgttttgtcgcttctgccttggccttggctttggccttagtttctgttttcgctttggtttctgcctcggcttctgcttttgccttagattcggcttccgctttagctttggtcttggcttcagcctccgctttggcctgagcttcggcttctgctttaaccttcgcctcagatgcggctttgcgtttcgcagtttcttccgcttctttcttggcctgaacctctgccttctgccgagcctctgcctgttcctgtagaattctttctttttctgcttttgccttagcagcagcttcttccgcaagtttttgttcctcacgggctttcgaagcggcggcatctgcctgttttttctgttcttcagacgcctgttgtgcttttattcgctcttcttctgccgacttcagacgttcctgctcttcagcctgttttacccgcaattccgccgcctgctgttcagcttttttcttccgctgctgctcagccaattttgcattagcctgctgttgctgttgctgactgtattgctgaacgactgcattcggatcgaccataacagcatcaatgacagtaccaccagctcctccgccccccatttctgttttttgcatcagcgaaccccaaatcagaaacccgatcaggataatgtgaagtataaccgaaatgataatggcgcgattcagcctattattttgctcgtttgtctttcccacactcgacatccagaaactttaagtaacagcaaccatcaggccccaatgggctgagtcattaaaccaaccgattttacacccgcctgacgaagcatattcagcgccttgatgatttcgtcataaggaacttccttagaaccaccaatcaggaaaactgttttaggattgattttcatcaaggcttgagcttcagcaatgatttgctgttcaggtaacaattccagacgttcctgattaacgatcatattgtattgcccaataccagaaacttccataatgaccggtggattatcagaactggacactgccttagaatccaccgcatcaggtaagtcaacttctacgctttgcgtgataatcggtgccgttgccataaaaataagcagcaacaccagcaacacgtccagtaaggggacgatattgatctcggattttagctcacgcctgcgactacgagtgcgcgccattcgcttatttcccctaacgatttattacgacttattggtattaggagtaaaagcctgacgatgcaaaatcgccagaaattcttccataaaattatcgtagatttgttctagtttattgacgcgctggctcagacggttgtaggccatcaccgcaggaatggcggcaaacagaccaattgctgttgcaatcaaggcttcagcaataccgggagcaaccatttgcaaagttgcctgcttcactgcacccaaggcgataaaagcgtgcatgatcccccaaaccgtcccaaacaggccaatataagggctgatggaacccacagttcccaaaaatggaatgtgattttccactgtttccagttcacggttcattgaaatacgcatggcacgagaagccccggtgataacagcttctggtacatggctattcacttgatgcaaacgagcaaattctttaaaaccagaatggaaaatctgttcagtaccgtttaacgaatcccggcgtgactgactttctttataaagacgggacaattcgattcccgaccaaaacttatcctcaaatgcttccgcttctcgggtggcagcattaagaattctcgttcgttgaataatgattgcccaagaaacaatagagaagccgatcaagattaacatgatcaactgcactaaaaagcccgccttcagaaataaatcaaggatattcatgtcagtcactgcttaaactccgcgacaatagactttggaagcgcgataggcttcatttgagatgaattcacgcagacaaccagagattctgcgctgctgatagctataccattacaatcaacaattcgttgagtaaatgtcagagaagcgccacgaatattcgtaatttcgctttcaacaaccagcaagtcgtccaatctagctggtttccggtagtcaacagtcatgcgactaacaacaaagccaatctgctcatccagcatatacttttgatggaagcctttttcacgcaacatttcagtacgagctctttcataaaaggctaaatattgcgcgtgatagaccacaccactagcatctgtgtcttcgtaataaacacggataggccaacggaacaacatattactcacatataatcctaatcaagcgaattgacgctgccactatactcaagacaatcgcgctttggaatgacttgtcagtaaagaagtcaaaaaaaatttatagaccatcagtctataaatttataaatagtttacttaaaaaaatgatataagccaaagagaagaatcaaaagtgcaggcaatggatgaaaaaaaagccgccagatgacatgtttaggatgaaacccgacaccaaaagtgacaccagaacaaacagcccaaatcagtaaaataccctgccatatatgaagtgaactggtattagcagcaaaacgtgccggatcccagaatacacatgaggcaagcgccagagccataatgaggataagggccctcagaggccccttatccatcagttggtagaatttatcagccaacattatttttcgccactctcagtcgctttttttgattcgctctgctcaagtgccaaggctgcaatgatagcgaaactacaagctaagagcgttccgagaatccaagcaaaataccacatgcgctatgctccttagtacagtgaatttttgttgttttcaatgtagttcttatccaaacgtccaaaagttttatagtaacaccaagtggtgtacaacaagataagaggaacgaagataagtgcaacaacaaacataacttgcaatgtccactgactggatgtcgcatcccacatagtcaggctgatattcggatcaatgcttgatggcatcacaaatgggaacatcgcaattcccgaagtcagaatgatgcaggcaacggtcaatgatgaaaacaggaatgcccacccccctttatccattcgtgtcgccagcatagtcagcagaggaagagtgacacccaatgccggtattgcccacagcgccggatatttattaaagttaatcagccatgcccccgcctgatgtgcgacttctttatgcagtgggttagatgggccattaatatccaatcctcctgtcacaacataaccatcaatgccataaatcaaccatacgcctgccaacaggaaggcgactgccgttaccagtgcgcaaacatgtgtggcagtgcgcgaacgcagatgcaactcaccggttgtacgcatttgcagataagtagcaccttgtgtcacgatcatcatcaagctaatgatgcccaccagcaagccataaggattcaacaacccgaagaatgacccttcataggacactcgcatgtaggaatctatcgccagcggtacaccttgcagcaggttaccaaatgcaacaccaataatcagcggcggtacaaagctaccaataactattccccagtcccacatgttccgccattgactattttccagttttgaacggtaatcaaagccgacaggacggaaaaacagtgcagctaatacgaggatcatcgcaacataaaaaccagagaaagcggcagcatataccatcggccatgcagcaaacagcgcaccaccggctgtaattaaccaaacctgattaccatcccagtgaggagcaatcgagttaatcataatgcggcgttcagtatcgtttttaccaatgacacgcagcagaacaccaactcccatgtcgaaaccatcagtcactgcgaaaccgatcagcaacacaccaatcagcagccaccatataaatcgtaatacatcataatcaagcatacgtggactcctgcttactcaatattgttggctgaagacgcagttttctgttcaaagtggtaacgtccggttttgaggctacttggacccagacgagcaaatttgaacatcaagaacatttctgcgatcaagaacaaagtgtacagaccacaaatcagtaccattgagaaaatcagatcaccaacactgcgtgtcgaagcagcaactgcggttggcagaacttcaccaatcgcccacggttggcgaccatattctgcaacaaaccaccctgcttcaatagcaatccacggtagtgggatactgaacagagcagcacgaagcaaccatttctgctgaccgattcgattacggataacactcaggaatgccagaccgataaccagcaacatgagaaaacctgaagcaaccataatgcggaatgcaaagtagagtggcgctacacgcgggatagaatctttcgcagcggatttaatctgttcttctgtcgcatttgccacatcttgggtataacgcttcaagagcatgccataaccaagatctttcttactttcattaaatgcattgcgaactgctggatcaatattgccagaacgcaactcttccagtaattcgtacgccttaatgccgttacggatacgctgctcatgctgccccatcaagtcacgcaggccgacaacgggcgtatcagtggagcgagtggcaatcaggcccagaatataaggaatttgaatagagtatttattttccattttatcctgatctggaataccaatcagagtgaatgaagctggaggtggttgagtttcccattcagcttcaatggcagccagtttggttttctgtacgtcccccatttcgtatccagattcatcacccagaacaatgacagacagtatcgcagcaataccaaaacttgatgcaatcgcaaaagaccgtttagcgaacggaatatcgcgtcctttcagcagatagtaagcgctgatgcccaagacgaaaaccgcgcctgtcacataacccgccgcaacagtatgtacaaatttcacctgagccacagggttaagcaccaattcgctgaaactcaccatttccatacgcatggtttcgaaattgaaatcagatgcaatcgggttttgcatccaaccgttcgcaaccagaatccacaatgcggagaagttagagcccagtccaaccagccaagtaacagccagatgttgtttcttgctcagacgatcccatccgaagaaaaacagaccaacgaatgtagattcgaggaagaacgccatcaggccctcaatggccagcggtgcaccgaaaatatcaccaacgtaatgtgaaaagtatgaccagttggttccgaactggaactccatggtcaaacccgttgcaacacccagagcaaagttaataccaaataacttaccccagaattttgtcatatctttgtagatctgtttgccagaaaggacatataccgtttccatgatcgcaagcaaaaacgccataccgagcgtcaatggcacgaacaggaaatggtacatagcagttaaggcaaactgtaatcgtgacagttcgacaatatcaaacatcttgactccttgctcctagcaggaagacaccgacttgcggcaacccgactccgtaaaacggaagcctcgtaactaccagcaataaatgcctaaaacacaacaatgaattattaagtaaatcagatattcagtagataccacaataatattacgcctatattcacatacaataaataggttttacgtgactcagcttggaattctgaatataggtcaataatgccgtacattcataggctaatatctaattattttagatcaatttaagcaaacctagcgaatacataccatagtaataaattgattttagtcaactttttactttatttgttaatcattacagctattatttcattctggttggtttagtgttaatgatttgttgttttcaatggctgttgatttattttttgctgtaaaaaacattcgaaaattaactttttattttcattctttgaaaaatatattttttcaatatttccaattaaattaatcaaataaataacatattagagttccagttaagttaaattttaaaatacccacttgtataaaataactaacttactgtatatattataaatataaatataaatataaaggtcacccaaaggtgacctttttcaataaaaatagcttatttttagactagttgcctgctaataaaacttttactgcatcaccgatgtcagcaagactacgaaccgtcttcactccagccgcttccagtgcagcaaatttttcatctgcggttcctttaccacccgcaataatcgcaccagcatgacccatacgtttgcctttaggtgcagtcacaccggcaatgtaagcgacgacaggtttagttacatgctctttaatgtaagcggccgcttcttcttctgctgtaccaccaatttctccgatcatgacgatagcttcagtctgcgggtcttcttggaacagtttcagaatatcaataaagtttgagcctggaattgggtcaccgccgataccaacacaggtagattggcctaatcctgcatccgtcgtctgtttaacggcttcataagtcaatgtaccagagcgggatacaatacccactttacccgccttgtggatatgtccgggcatgataccgatcttacacgcatccggcgtaataacacccggacagttaggaccgatcatacgaacacctgcttgatccagttttactttcactgtcagcatatccagcgttggaataccttctgttatagtaatgatcaatttgatgcctgcatcaatcgcttccagaatggagtctttacagaatggagcaggaacataaataaccgaggctgtcgcaccagtcgcttccactgcttcacgtacggtattgaatacaggcagccccagatgctcagtaccacctttgcctggtgttacaccgccaaccatttgagtaccgtaagcaatcgcttgttctgaatggaaagtaccctgactgccagtaaacccctgacagatcactttggtgtttttatcgattaaaatagacattatttattccccgctgctgcaactgcctgtttagctgcgtctgtcaaactgctggctgcaatgatgttcaaaccactgtctgccagtttcttcgcgcccaactcagcattgtttccttccagacgaaccactaccggtacgtgaacaccaacttcttccacagcaccaataatcccgtcagcaatcaagtcacagcggacaatgccaccaaaaatattcacaaaaacagctttaacattttcatctgacaggataattttgaatgcttcagtaacacgttcttttgtcgcaccaccacccacatcaaggaagtttgccggggcaccaccgtgcagtttgacaatgtccatggttcccattgccaaaccagcaccattcaccatgcagccaatgttgccatcaagagcaacatagttcagttcccattgtgcagcctgagcttcacgcggatcttcctgtgaaggatcatgcatttcacgcaattcagcctgacggaacatcgcgttaccatctgcacccagtttcccatccagacagataagatcaccttgagttgtgataaccagagggttaatttcgaccatagccagatcacgctcaaggaacagctttgccaatcccatgaaaattttagtgaactgaccaacttgtttactggttaaacccagtttaaacgctagttcacggccttgatacggcatagggccagccagtgggtcgatgattgctttatgaatcagttcgggcgtttcttccgccactttttctatttcgacaccaccttcggtagaggccataaacactacacgacgtgtaccacggtcaacaacagcaccgagatagagctccttggcaatatcggttgctccttctaccaagatctgatgaacaggctgaccctgtgcatcagtctggtaagttaccagtcgtttacccagccattgttcagcaaaagcacggatatcttccttgctgttgacgactttcacgccaccagccttaccgcgaccccctgcgtgaacttgacatttaacgacccaaggacctgaaccaatcttggatgctgcttcttctgcttcgcgcggtgtagtacaggcataaccagcaggtgctggtaaaccataccgtgcaaaaagttgttttgcctgatactcgtgtaaattcatgatgttctatccataatttagtctaagaaaggtaaattaccttctattttattgctctggatatgaccagcccgaaggctggcctgcatatacattttttacatcaacattgctttacttcagactgggcggaatttaacaccctccgccccgatggtgatgctatacatccagcaacaaacgtgtcggatcttccagcatttctttgatggtcaccaggaagcctacagactcacgtccatcaaccagacggtgatcataagacagcgccagatacatcatcggaaggatctcaacctggccattcactgccattgggcgatctttgatagcgtgcatgccaaggatcgcactttgtggtgggttaatgatcggtgtagacatcagagagccgaaaacaccgccgttggtaattgtgaagttaccaccagtgagttcttcaacggtcaacttaccgtcacggcctttaatagccagctctttgatgctcttctcaatatccgccatgcccagtgcatctgcatcacgcagtactggtgtaaccagaccacgaggtgtagataccgcaatgctgatatcaaaatagttgtggtaaaccacgtccgtgccatcaatagaagcgttaacttctggatagcgcttcagtgcttcaacgactgctttcacataaaaggacatgaagcccagacgcataccatgacgtttttcaaacgcgtcaccgtactgcttgcgcaattcttgaattggcttcatgttaacttcgttgaacgtcgttagcattgcagtattgtttttcgcttcaagcaagcgttctgcaacacgtttacgcaggcgagtcattggaacgcgtttctcactacgatgtggcagctgagaagcctgtgctggtgcagcttcagccactttgccactctcttttttatgcgcagcgatatatttttccacatcttcgcgaacgatacggccaccaacgccactgcctttaattgcagcaggatctaaatcatgctctgcaatcagacgacgaaccgccggacttaatacgtcgttgctttcttcttccaaagaagcagtctggcgctgcgctggtgttgattctgttttttcttttacttcagcaggaatacccgtgctatcgctcaaacggatacgaccgagcagttgcttggacagtacggtggcaccctcttcttccaaaatagcttccagaacaccggcttcactcgcgggtacttccaaaacgactttgtcagtttcaatttcaaccaacacgtcatcacgttgtacagtgtcacctgcttttttatgccatgtcgcaacagtggcatctgcaacagattcaggaaggtctggaaccagaatttctacgctactcattttctatccttatttattcaacgttcagggcatcattaaccagcgcttgctgctgctgctggtgaacagacgtataacccactgccggggaagcagatgctggacgacctgcataacgtaaagaagccccaaatgggatcacttcacggaaattatgttgactgcaataccaagcaccttggttcagaggttcttcctgacaccagacgaagtcatgaacatgagcatactgctcaagcagagactgcaagttctgacgcgggaatggatatagctgttcaacacgcacaatggcaacatcagcctgctcgttcttacgacgctgatccaacagatcgtaataaactttaccggaacaaagcacaacacgtttaacaccttttggatccaaggcgtcaatttcaccaatcacaggctcgaatttaccgttagccagttcatccagactggagaccgccaatggatgacgcaacagtgatttaggtgtcatgacaatcagcggacgacgcataccacgcagagcctgacggcgcagcatgtgataaacctgagccggagttgatggtacacaaacctgcatattctgttctgcacacaattgcagatagcgctccaaacgtgctgatgagtgttctggaccttgaccttcataaccgtgcggcaacagcatgaccagaccacacatacggccccatttctgttcaccggagctgataaactggtcaatcacaacctgcgcaacgttagcgaaatcaccgaactgggcttcccaaatcgtcaaagcgcgaggttctgtcgttgcataaccgtattcaaacgccagtactgcttcttctgacagtacagaatcccatacgttgaatacaccctgactactgtgaacattttccagagggacataaacagcagcattcggctgattatggataacggcatgacggtggaaaaatgtaccacgacccgcatcttcacccgataggcgcacagggatgccttcatcaaccagagtagcgtaagccaatgtttccgcaccaccccagtcaaacagcttattgccgttagccatttcttcacggtcgccgtaaattttcgcaacccgtgaatgcatttcaacttcagcaggaatggtgctgatacgtttgccgagatcttgcaggcgtttcatatccactttatgtgggtagtcctcatcccattcgtgattcaggtaaggctcccacgtaaatgagtgcaaccccataggacgccattcattcacaacgcactcaccatgatccagcgcatcacgatacagattggccatttcagtaacatcgttagctgccagcaggccttctgctatgagtttatctgcatagattttacgtggtgtcggctgttttttgattttctggtacatcagtggctgagttgcacttggctcatcagcttcgttatgaccgtggcgacggtagcaaaccagatcaatcatcacatcacgtttgaaggtattacggaaatcaagcgccagacgagtaacaaaggcaacggcttccggatcatccgcgttaacgtggaaaatcggtgcctgcaccattttcacaatatcagtacaatattgcgttgaacgggcatctttcggattagaggtagtgaaaccaatctggttgttaatcacgatgcgaacagtaccgccaacttcatagcctcgagcctgagacatattcagggtttcctgaacaatcccctgccctattacagcagcgtcaccatgaatggttactggcagaaccatgttgcttcggccttcatcaagacggtcacggcgagcacgcactgaaccaataacgacagggctgacaatttcaaggtgagatgggttgaaagctaacgccaaatgtaccaatcccccttcagtttcgaaatcagaggaaaagccctgatggtattttacgtcacctgtaccgagatgctctttatgtttacccgcaaattcgtcaaacaaatcagctggttttttaccaaagagattgaccagaacgttgaggcggccacgatgagccattcccagcacaacttcacgggtaccctgttttcccgcatggcggatcagttctttcagcattgggataagcgcatcaccaccttcaagggaaaaacgtttcgcccccgggaacttagcccccaaatagcgttctaacccttccgctgctgtcagttccgccaagaaacgatgtttttcatccgcactgaactgtgaacctaccgcaatggattccagacgctgctgaatccagcgtttttcttccgtattggtgatatgcatatattccgcaccaattgaaccacagtaaatgcgtttcagggcgtcatatagatcagccagtttcagtgtttctttgccaatggcaaacgagccaacattgaacgtttcttcaaaatccgcttttgttaaattatggaaagcaggatcgagatcgggtacaggttcctgtttccataatcccaatgggtcaagattcgcactttgatggccgcggaagcggaatgcgttaatgagctgcaaaactttaacttgttttgcatccattgctggatcgctgactgaagtgtgataacgcgtggcatcttttgccagacgacggaagtaatcgcgcgtctgtgagtgaagttgttccccgctaagccctatatccggtaattgttggaatatttctctccaacttgcatcaacggagttaggatcggttatatagtcttcatagatttgctctatgtaagactggtttgcaccagccagaaagctcgagtccagccagtccttcattgcgccgttctgcattgtgatcccttaagctttaaaagctttagttttcgccgtggttaacaaataccgcttaatgagcggtgttgataaaaggttcatttggacgtgcttaatgcatgttctttattgggattgtcctacccttcaaggaacctttaaaaactggatatcagtttctaaaagttcctttatttcaaaacatgcgccgtcattcgcagtaggcaatttatcatttttcattcttaatgccctccatcagcttgatatttctttcaaaattgtggagggcaacattatatgcattatttacacgcgattaatgcgttatttatgcactatattttacttatgcgctgtgtttcagcagcatcgacttaatatgaccaatcgcttttgtcgggttcaaccctttaggacagacgctgacacagttcatgatgctatgacagcggaaaacgctgaacgcatcattcagtccatccaatcgtgaagccgtttcagtatcacgactgtcaatcaggaaacggtacgcagccaaaagacctgccggcccaataaacttatctgggttccaccagaacgatggacaagacgtcgagcaacaggcacacaggatacattcatagaggccatccagtttttcacgctgttccggtgattgtagatgttcgcgcgctggtgggtttttaccatcgttaatcaaataaggacggattttctcatattgcgtgtagaactggctcatatcaacaaccagatcacgaacaacaggcaaaccaggcaacggccgaatgacaatcttcttattaccccggcgcagtaccgaaacgggagtaacacaagccagaccattcttaccattcatgttcacaccgtcagagccacaaacaccttcacggcaagaacggcggaatgataaggtcgggtcctgctcttttaactggataagcgcatccagcagcatcatgtcacgcccttcctcggcttccagcgtgtaatcctgcatacggggtgcgttatctacatccggattataacgataaatcgaaaattcaagtttcataatctctttctccgcaactggaacatcagcaacgcaattagtaagaacgcactttcggcgggaaagcttcacgcagcgtaggctgcatgtttacttcacgccgagtcatgctctcagttcgcggtaaatacaagctatggcacagccagttcgcatcgtcacgctctgggtagtcaaaacgactgtgagcaccacggctttctgtacgataattcgcagacactgcggtcgagtatgcggtttccatcaggttgtccagttccagacattcgatgcgctgggtattgaattctgatgaagtatcatccagacgggcattttgcagacgttcacgaatcactttcagctcttccagcccttttgccatcgcatcaccttcacggaagaccgagaagttgttttgcatgcacgcttgcagtgccttacggatttcaaccggatcttcaccagaacgggtattattccagcggttcaggcgttgtagtgctgcatcaacatcagactcactggcgtcacggctggttccctgctccatcaggcactctttcaggtgcaagccagcagaacggccgaataccaccaggtcgagcaatgagttaccccccagacggtttgctccgtggacagatacacaggcaatttcacctacagcgaacaagcctggaatgatgacatcttcacctttttcgttgacagtcagcgcttgacccgtgatcttggttggaatccctcccatcatatagtgacaggttggaataaccgggatcggctctttcaccggatcaacgtgagcaaaggtacgggataattcaagaatgcccggcagacgggtttccaatacgtctttccccagatgatccagtttcagtttcgcatgaggtccccaaggaccttcacagccacggccttcacggatttcgatcatgatggaacgtgcaaccacatcacgacctgccagatctttagcattgggtgcgtaacgctccatgaagcgttcaccatctttattcagcagataaccaccttcaccacggcagccctctgttaccagaacgccggcacccgcaatacccgttgggtggaattgccacatttccatatcttgtacaggaacgccggcacgcagcgccataccaacaccatcaccagtattgatatgagcattggttgtggattggtaaatacgaccagcgccaccagttgccagaatggttgccttggatttgaaatagacgatttcgcccgtttcaatacagatggcagtacaaccaacgatagcaccatcctgatttttgacgagatccagtgaataccattcagagaaaaccgtcgtgttatttttcaggttttgctgatacagagtgtgtaacaaagcgtgacccgtacggtcagcagcagcagcagtgcgggcagcctgctcgccaccaaaattcttggattgcccaccaaatggacgttgataaatacgaccattatccagacgggaaaatggcagccccatgtgttccaattccagaatggcttcagggccagttttacacatgtactcaatggcatcctggtcaccgatataatcggagcctttcaccgtgtcatacatatgccattcccagttatcctcatgggtattgcccagagcaaccgtaattccgccctgtgctgaaacggtatgtgaacgggttgggaataccttggagatcaaggcacaagataaacccatttgtgaaatttgcagtgcagcacgcatacctgcgccacccgcaccaataacaaccgcgtcaaactctcttactggcaatttcatttatgcaccccacacaacaattgttccgtaaatcaaataaaccaacaacgcaacaataatgaccagttgcagcactaaacgcagtgcgagtggcttgacataatccgtcagcacctgccacatccctatccatgcgtgaaccaggatagaaagcagagccagcacggtgaacactttagtgagagatgaagagaagaaactgcgccagacttcataggtgatgtctgacgttgttgctacaaaaccaacaaggtaaaggacgtataaaacaataacgattgcagatgcacgcagcagcagccagtcctgaatacccgtgcgacccaatgcggatgcgttgcttaccataataataccccagccagaatagacagaataaccgcgattactattgctactttggcagaagcactaccggtagcgaggttttcttccaagaaaccaaaatccatcaatacatggcgaataccaccacaaatatggtaagccaacgccgtcaatatcccccacaggataaatttagcgaagaagccagtcatgatttcagatgcttgcaggaagccctcttgcgaagacagtgacatccccagcaaccacagcagaatgccgactgcaataaaggtgatgacgcctgagatacggtgcaagatcgaagttatcgcggagacgggttggttaatcgtccgcagatcgaggttgacaggtctttgttttttcacaattttgcccacacagcttttttttattttccatcctccggtcctgggcaggaatcagacagcgctaagaggatacaaagacacaacataattaaattaacaatccttacatgttcatcaaaagttgtgatttggctacgctggatgctcctgcagcagggtaatccggagaccttacggcagtataagtacttcacatacttattacaattcccacacaatatgattattaacatttagcttgaacagtgagaaagatcacgcttcaaacatttatcataaaaaccattatcttatttgacaaggattaaacatttatcttacatatatgaaggtatatattgtttaccgtcgttttccggcggaaaagtaaacttcacgaaaaacaaaagttatgcaaaagtactaattagacacaaaatgacaacattttatgttaaaaatactttaaacataacacccagaaactttttaacaacctaaaaatcgttgtcgcccgtaatgagatttcagcgttatataatgtgataccagcctgattttaaattctctccggtagcacaatgccatcggcacagtataaattgcgcctatcatggttgttaggggttataaaaataagcgctaaggagatgtaaatggctgataaaaaagctacgttgaccataagtggtgcagctgctatcgaactagacgtactaacgccgaccctaggttctgaagtgattgacgttcgtaccctcggctcaaagagtttctatacctacgatcctggctttacttctacggcctcctgtgaatcaaaaatcacctatattgatggcgacgaaggcattttgctgcaccgtggtttcccgatcgatcagctcgcaacgggatcaaactatctggaagtctgttatatcctgctgtatggcgaaccacctacgcctgaagagtatgaaacattcaaaaaaacggtgattcgtcatacgatgatccacgaacagatcacccgtctgttccacggtttccgccgtgattctcaccctatggccgtactttgtggtgtgacaggtgcactggctgccttctaccatgatgcactggatgtccataaccctcaccaccgtgaaattaccgcttaccgtctgctgtccaaaatgccaaccgtagcggcaatgtgttacaaatattccatcgggcagcctttcgtttacccacgtaacgatctttcttatgcagccaatttcctgcacatgatgttctctacaccttgtgaagaatataaagtcaatccagtgctagaacgtgccatggatcgcattttcattctgcatgcggatcacgaacagaatgcttcaacttcaacggtacgtaccgcaggttcttctggtgctaacccattcgcctgtattgcagcgggcatcgcatccctgtgggggcctgcgcacggtggcgcaaacgaagcctgtctgcgtatgctggaagaaatccagactgtcaaacatattcctgaatttatcgctcgtgccaaagataaaaacgattctttccgcttgatgggctttggtcatcgcgtttataaaaactatgatccacgcgcgacagtaatgcgtgaaacctgccatgaagtactgaatgaacttggcctgaatgacagcctgctggaagtcgcgatggagttggaacgtatcgccctgaatgatccgtacttcattgagaagaaactgtacccgaatgtcgatttctattccggtattatcctgaaagcaatgggtatcccatcctccatgtttaccgtgattttcgccattgcccgtactattggctggattgcacactggactgaaatgcacgatgaaggcttgagaatcgctcgtccacgccagctttatactggccatacccaacgtgatttcaaaagtcagttagagaaataatttagcattctttatttcattgtcagacattatctgacaagtgcattaactgcacctcacatatcaggttcaatcgtaatattaaacctgattagggtgcagttatcgccgacaagcaccggccatatactccctcggaggttttcccatatttttgcgaaaaaatgtcacaaacgcactatcattagcaaatcccagctcctgtgcaacataagacagagttttatcctgagcaagtaactcaattgcttttatcagccgccattgctgccgccactgttgataattcatgcccgtttcacgcagaaatattcgggtgatagttttctcactggcgccaatatgagtggcaagcatttgtaatggcggaggcaattgatcaaacggcaaacgcgccagacgtcgatcagaaggtaacggtaataaagtcggctctttacctgcctctctcatttcatcaaaaaagaccgccaataaatgcgctccctttccctgacgccaatcagtatcaaaaggagatattgcaatacgttctaaaatcgcctgtagcaatggtgtggtttccaatatttcactctgcttcgaaatccattctatccctgacatatccagataaatggagcgataccctatggagccacgcatttccgcccgatgcagtgtctttggcggtatccatgcaactctggtcggaggcaggatagagagctgatttgccaacgtgatcttgatacaaccttgctgagtaaacaacagttgccccatatcatgctgatgaaagcctgaatcgtactgccccatctctgccgcaatacctatcacggacacattcgaactatatttcaaaccatcaggatcaaaatgatcactttgtcgcagccaggccatattaataccctttaactttatgtccgattacataaataaatcgcctttattatcataaaaagacattcagcagaatgctaatctttcgggctataaatagctcatcagaagaaaatatcatgcacaccagaccatcactttggctcgctatcactttaatgatgtttccacagatcgtggaaaccatttatagccctgcactaaccaatattgccagtggattttctgtcaatgcaacacaggcctcccaaaccctgtcattctatttctttgcttttgccatcggtattgtcgtatggggtcgcatgtgtgatgttattggcaggcgtcctaccatcattgcaggattattactctacggtgcagcttccttgctggcactgctaaccgaacacttctggctattactggctaccagaatgttatccgctttcggtgcatctgtcggttctgtcggtacgcaaactattatgcgtgatacttaccgcagcgaagaattgtcgcgtgttttttccatcatggggatcgccttggccgtcagccctgcgattggcatgatcagcggctctatactaaatcattttgggggttataaagcggtatttgccgggctggccattctggctgttatcctgatgagctggtctgttattcgcttaccggaaacccggccagtaaatgtgccaaaaattgccctatttggcaccgccgtcaccatgttcaaagatatttcgatttggcgaaatgcgtttctcatcgcatttttcaatatttgtctgttcagctattaccagttagctccctttcgctttcaacaattcggactatcacaggcacagttcggttataccggcctgctattcactttcggcgttgggctaggttcactactgaacaagcatctgttaaaaaaacagtggctatcggcaaaattaatttctcttgccgcgatgattgtttttctgagcgggatcggcgtttacctgctcgaaaatagctggctatttatctttcccatgctgggcattgttaccgcttacggccttgccattcccaatattttagcatcggcgctgaacaactatgccgatcggctgggtacagcaggcgccttactggggctattgtattatctcttgctgggcggcggtttggcgctggctggctggagccaggcattgggcagcatactgatctgctgtggcgtatcaaccgtgcttttaacaagaaaatggtgatagacaggttctgcgaaaacaaattgggaaaaaacaacggggctaccgttctgatagcctcgcctgataaattgataagctgcgaacaaatcaagctggattaggaatatcaacaaaagtgacatccaacccataatgatttgccagccattcaccgagtactttgataccataacgctctgttgcgtgatgccctgccgcataaaaatgtagccccatctcacgggcaacatggatggttttctctgacacttcccccgtcacgaaagcatcgacaccaaactcagccgcctgctcaataaaactctgtccacctcccgtacaccatgccaatgtacgaatttcttccggtgcattatcgccacaatgcagtactttgcgttctaatcttttttcaagccgctcagtcaattctgtgggggtaatcggttggtcaaatgcgccatgaggaagcaaggggtcaatctgcccgatgatttttacccccatctgacgcgccaactgaacattgttacccaatgtaggatgagcatccaaaggaagatgataaccatacaggttgatatcattgctgagcagtgtttgtagacgacggcgtttcatgccacggataacaggtgattcgtttttccaaaaatatccatgatgaacgatgaccgcatcagctttaagacgaaccgcctcatccaacagagcctgacatgctgtcacaccggtaataatccgctgaacatggggacggccttccacctgtaaaccattgggggcataatcctgaaattcacgaacattcagttccgtattaagcacatgttccaattcaacattgttcatcacacttcccccatcatttagcgctttcgccataaaatacttacctgtcattaattgctcccaagattgttgcttatatgcaccacatcaagaatcgtatcaatagcaataaacagcgataaaagcaaaacacctcgccagcataaacaggcaaggtgtcagaatactctatcaggggaaaaaaactaagaatggaaagtgacaaaccagagcaatacagtcatgttacttacgtaatgatgctgtcttagcggtttcgaatacctgcggccatttccgaactctccagccatacgggtttatcgctggtttttatccataccttacgcagatagctgtaaaaacgggcacgatcctgacgaaatagcataacaggaagtgcaatgacgcccaatgttacagcgccagtacgccgcaagagaacctgatgccaagaatattcacgatatgtagacattaagaccctcctcatgggctatatctgtaatacgtacaaaattttacccgacaaaatgaaaatttgctacttattcaacccttttttagcctatatatcactcatttcttctattgatgtaatttaattacaaattaatacctaaataaaaacaagataaatacattgaaaacaaaaaactaacttgtagagtttgctagactttccttggataccttattaattaatccctcttatatttttatactttttttacactttcataatctcttttaacaacttctttgcatggctcttcttatgctgtaaccatctagtgaataaggatataagcacaatgaatacattcataatcatcggcgtatttctggtagtgtcattactgttctatctgatttacgcgttattgaatgcggaggatttttaaatggtagcctccgcttttttgctgattaccagtttcttggtcattctctttatattgagcagacccctcggcagtctgatcgcaaatctggtcgaaggagaattaccccgctggctgacaaatgcagaaaccagcctgtggcgttgctgtggcttgcaaaagcccggcggcaacgtcaaagagatgaactggtggcaatatgctctcgctatcatcacattcaacatcatggggttgctgctactctttatgctgttgataagccaagaacatctgccactcaatccacagcattttgccggtatgaaatgggatctggcactcaacaccgcaatcagttttattaccaataccaactggcaggcctacagcggtgaaaacaccctcagttacttaagtcaaatggcgggtttgactgttcagaatttcctgtcggccgcaacgggaattgcagtggctttcgccttaatgcgggcattttcccgtcagggcgtgaaaacactgggcaatgcctggatagatattacacgcattacactctatctattgctcccgctgtcgatcatcattgcacttatcttcgtcagtcagggcgttatccaaaatttctccccctatgtacttgtccacacccttgaaggacaacaacaactgatccccatggggcccgttgcctctcaagaagcaataaaattattgggtacaaatggcggagggttctttggggcaaactcagcccacccctttgaaaacccgaatgccctcagtaactttgtgcaaatccttaccatattcctgatcccctgtgcactgtgtttcgcgttcggtcttgtggtcggggataatcggcagggacatgctttactatgggcgatgacgattgtctttatcatcgccgttacgattgtgatctatgccgaaatcatgggtaatccccacttcatccaggctggtgccagcagtaatctgaacatggaagggaaagagtcccgctttggtatccttgcctcctcactttatagcgtcgttacaactgcggcttcctgtggggctgtaaatgcaatgcacgattccttcaccgcgctgggtggcatgataccactctggttgatgcaaattggtgaagtcatctttggcggtgtaggctccggcttgtacgggcatgttgctatttgtcctactggctgtgtttattgccggtttgatgattggccgcgctccggaatacttgggcaagaaaatcgatgtccatgacatgaaaatggtcgcgctggcaattttggttacgccctcccttgtcctgttaggaaccgctctggcaacttcaatcgatgcaggacgcgctgcgatcatgaaccccagcgcccacggtttcactgaagtgctttatgctctctcatccgctgccaataacaacggtagtgcatttgctggtctgaatgccaacagtgtgttttataacctgctgttaggggcaatcatgtttctagggcgctttggtgtgatttttccagttctggccatcgctggctccatgattagcaaaaaacgccagcctatcagcagtggaacactgccgactcacggctctctattcactggattactgattctggtggttttgctgatgggtgcactcacctttattcctgcgctggcgcttggccctgtcgcagaacatttacaactttggcaagcaccacgataagcgagattgcgagataactcatgaaagacaaacatcaagcattatttgaacccgctttaatacgccatgcacttatcgacgcagtgaaaaaatgccatcccgctatccaatggcgtaatcccgtcatgtttgtcgtctatctgggaagctgcctgaccaccgtgttgtggcttgggatgttaacagaacagcttaccggtaatgcactttttaccggctccattgctttatggttatggttcactgtactgttcgctaattttgccgaagcactggcagaaggccgcagccaagcccaagcgtccagtctgaaaggcgtaaaaaaaaccacgtgggcgaccagactggcttccgccagccatgatgcagcaaaggaaaaagtcacttcagaccatctacgcaagggcgatattgtgttggtggaagtgggcgaaattatcccctgtgatggtgaagttcttgaaggaggggcttccgttgatgaaagcgccattacaggagaatcggctcccgtgatccgcgaatctggcggtgattttgcttcagtcactggcgggacacgggttttatcggattggctgattatcgaatgttcggtcaatccgggagaaacctttttagacagaatgatttcgatggtcgaaggtgccaaacggcgcaaaactcccaacgaaattgctctcactattttgctcacggcactgactattattttcctgctgtcctgtatcagtctactgcccttttccttgttcagcgttcaaaccaatcaatcaggcgatcccatcagcatcaccgtgctggttgccctgttagtctgcctgatccccaccaccatcggcggattactttcagccattggcgttgcaggtatgagccgcatgttgggtgccaatgtcattgctaccagtgggcgcgcgattgaagctgccggcgatgtggatgttttattactggataagacgggaaccattactctcggtaatcgtcaggcatcacagtttttacctgcaccgggtgtaaccgaagaacaactggccgatgctgcccaactttcctcactcgctgacaaaacaccggaaggacgcagcatcatgattttggcaaaacagcgcttcaatatgcgcgaacgcgatcttcgcgcactcaacgcgacattcattcctttctcagccatgacgcgcatgagcggcgtcaatataggcacccgtatgatccgcaaaggcgcagtagatgccatccgacgttatgttgaggccaatcacaatcaatttcccgatgccattgatctattggtgcagcaggtcgccagtaaaggtgcaacaccattggtcgttgcggagaatcagcgtgttttgggtgttgtcgctctgaaagatattgtgaaaggcggcatcaaagagcgtttcagtgaaatgcgcagaatgggaatcaaaacggtgatgattacaggtgacaatcacctaaccgccgctgcaattgcagcagaagccggtgttgatgattttctggcagaagctacgcccgaagcgaagctcgccctgatccggcaatatcagtctgaaggatgtctggttgctatgaccggtgacgggacaaacgacgcccctgcgctggctcaggcagatgttgccgttgccatgaattcagggacacaagccgcaaaagaagcgggaaatatggtggatttggactcgaatcctactaaattgattgaagtggtgcatatcggcaaacagatgctgatgacccgtggctccttgaccacatttagcatcgccaatgacattgctaaatattttgccatcattcccgccgcatttgcggtcacttatccccagcttaatgccctgaacatcatgcatcttcattcaccggaatcggcggtgctgtctgccgttattttcaacgcgataatcattatcgttctgcttcctttggcgctaaaaggcgtcagttaccgcgcgatgaacgcactgtcactcttgcgccgaaatctttggctatacggccttggtgggttgctcatcccctttgtcggcatcaagctcatcgacatgttgctcactgttctggctttcaaataaggtgatgaaaatgatctggttacgcgcctccatcgtcctactaacattcctgactctaatcactggcatcgcctatccgttgctgataacaggcatcgcaaacgccttgtttccccatcaggccaaaggtgccttgattgaacataatggcaaatgggttggttcggaattaatcggtcagtcatttacccaagccatctattttcatggacgtccgtctatgacgctggaacacccttacaacgccctgtcatctgggggaagtaattttgcaacaaccaatcccgccttgactcaccagatataccagcggattactcaggtacgtttattcaatcattcagaaaacagtgccattcctgtcgatctcatcaccgcatccggcagtggtttagatccccatatttctcccaatgcggctgaatttcaggcccaacgtgtcgccacagcccgccacttatccataaatgtgattaataaattgattcaagcttatactgcatacccgccactgaaatatatgggtgaacccgtggtaaatgtactggaacttaatctggcactagataacctgaaaccacaaggctgatattatatggatcagattgaacccctgcgccccgatccggatgacctgctggcactagcaaacgaaaaaccccgtggcaaactaaaaatatttttcggtgcctgtgcaggagtaggtaaaacttatgccatgttacaggaagcgcagcggctgctgtctcaggggctggatgttattgccggcgttgtcgaaacccatgaacgacaagaaaccgcggcactgctgacaggtttacctcaattgccactgaagcatattcgctatcatgaacgcaggattgccgcatttgacattgatgcagctattgcccgttatcctgccattatcctgatggacgaactggccttcagcaatcctcacagcagccgtcatcccaaacgttggcaagacgtggaggagttgctggaagcgggcatcgatgtcctgaccaccatcaacgtgcaacatctggaaagcctgaacgatgtggtcggtgccattaccggcattcgcgttcgcgaaaccattcccgatcacatatttgatcatgccgatgacgtcgtgctggttgatattccaccggatgatctgcgccagcggcttaacgacggcaaagtctatatttccggtcaggccgagcgggctattgagcatttcttccgcaaaggaaacttgatcgcgctgcgtgagttggcattgcgccgcacggcagaccgagtcgatgatcagatgcgtgctttccgtgatacacggggaaaagaaccagtctggcacactcgggataacctgttgctgtgcattggctgtaatgctggcaatgaaaagttgatccgaaccgcagctcgtctggcggcaaagctgggttgtgaatggcatgccgtttatgttgaaacccccaaattacaccgactgccagaaatcaagcggcgtaccatcctgaaagcactgaagctggcacaggagctgggggctgaaactgccacgctttccgatcctcatgaagaaagagctattctgcgctacgcaagagagcacaatctcggcaaaatccttgttggccgctatcatggctcacattcgacttcatttagtgataaatggcttggttttaaatggcgccctgatttcgttgaacgtttaggaaaactggggcctgatctcgatctcatcattgttgcactggaagacaaaaaacgctgggataaagaacaacgggataaccgggcattccatgaaaaatggcgcatccagatccacggcttcctcatagcgattatactctgcaccttaatcaccctgttctcgcatacctttttactcacccttgataaagccaatctggtaacactctacctgcttggcgtcgttattattgccctgttttatggccgctggccttctgtctttgccgcctttatcaatgtcatcagtttcgacattttttttgtccagccgcgatggtcactggctgtcacagacatgcaatatctgcttacctttaccgtgatgttgatcgtaggggtggtcgtaggaaacttgactgcgggtatacgctatcaagccagagtggcccgctaccgtgaacagcgaacgcggcacttatatgaaatcacgcgtgagctcagcagagctttgaatgaagaagacgttgcccgcatcagctatcactttttatccaacagctttcaggcaaaaacaggcttgttgctgccggataacaacgcacgtttatatcaggtgaagtccaataacggcggacaaatgcagatcgatgaggcaatagctaaatggagttttgacaaaaaacagcctgctggggcaggaaccgatacattacccggcgtaccctatcagctatttcctatcgccacggcttcacaggtatttgctgtccttgctatcgaatcacctaacttgcgccaattattagtaccggaacaacaacggttattacaaacgtttaccgggcttatcgccaacgcactggaacgtttgcacctttcccgccgtgcggaatccgctaaactagaaaccgaacgggagcaattacgaaactcactactggccgcactttcccacgatttacgcaccccgttgactgttctgtttgggcagacagagatactgatgctggatttatccactgaaaattcgcctcatacccaacaggttaaccaaattcgtcaacagatcctcagcacctcacgtctggtcaataacctgctggacatggcacgtattcaatccggcggtattcagcttaatcttgagtggcattcactggaagaaattgtcggtagtgccctacgctcattggaatataccctcagccgctacacggtagaactttccctgtcagccaacttattactgcattgtgacgcatgcttactggaacgagttttcatcaatctgctggaaaacgccattaaatatacccatgagcagacaccactaggcatacgggcaacgactgaatacaaacaggtacatattgaaatttgggatgcaggctccggtattccacaaggacaagaacaagtcattttcgacaaattctcacgcgtccgtaaagaatccgccattcccggtgttggattagggctggcgatttgccgtgccatcattgaaattcacggtggccatatatgggcagctaacaataaaaaaggtggagccagtttccactttgttctaccgttagaagaggtgcccaaaattgaagaagtcattgaggaaatgtgagcatagccagaaacagtacaatcttgatcgttgaagatgaaaaagagatcaggcgtttcgtcagattggctctggaaggcgaaaactggcgagtatttgaatgtgacacactgaaacgaggtttaattgaagcagccacccgcaaacccgatttgctaatccttgacttgggattgcccgatggtaacggcattgatctgatccatgatatccgccaatggagtagcattccaatcattgtgctttccgcacgcaataatgagcaggataaagtcgcggcgctggatagcggtgctgacgactatctgagcaagccttttggtatcaacgagctgcttgccagagtcagagttgccctgcgtcgcgccaccaaagccaatcagcccgatccgatgattcattttgccgatatcagtgttgacttaatcaatcgtcgggtcttaaaaagccagaaggagcttcatcttacgccgacggaatatcgtctgctgaccgaattgctgaccaacagcggcaaggtgctgacccaacgctatttgctcaatcacgtctgggggccacattatatcgagcataaccattacctgcggatatatatggggcatctgcggcaaaaactggaagaagaccctgcccgtcccaagcatttactgacagagactggcgtaggttatcgatttatgccctgatgccctgataaagcttcctgttactttctacggacaggtaaacccgtacctcggatacctttctgtggtaaaaccagcaccgcggctgaccaagctggcattgtcaccatgccatcttcggttattttgatcccggcagctaaagatgcattccctaatctgctttgaatatcatttaatttcaaaccatgagtattgagatctcttacagtgacggattttgacgcagcattaatcaccaccactaaaccatcaaaccgcaaatcacgatcatcatcggtagtgttaccatcatcaatagtcatgaccagtaatccgagttgctgatgtggccccacattacgaaaatcgatacgttgcttgacggattcccccttaccaagggtcatcaagggtgaaaattgacgcagacgtaacagttcctgatagaaagccatcatctgtaataactcactttggcctggttttttcacctgatttttcactcgatgaatcagcgcataatttccaccgtcatcccgtttccccggcatacctacatcatagttgttatctttgtaggtataactgacacggttaaaccaatcccctgcattataagaatcacgagtaaacgattttgagcgcagtaattccgacccttgctgatcgaaagccagcccttgcccgaggagtactgtggaaagagagattgcctgcatacggagccttgtcgccagatctgcctcgtatgccgctttgtagctgatgatgtcccataatgtctggttatcgtgcttggaaacataattaatcacttcaatgggatcagcggcataacccgcagcgacacctttgtagttaatttcccgacccgctttcactttcccatctttatcgatcatggcaaagtcagccagattacccgccatccctagacgaatcagatccgccaaatgacgagcttcattcgcatctaatcgggcaatttcgttaggtaatgttcccgcaccgttgcccattccctgattaatacgaatattatcagcagaatcaaacggcccaccaccgcgtactgcatctcgcaatcgatccgagaaagtaccgataccggagcctttaagattaatctgtgaagccgtctcaaatcgatcatcctgcccggaattccagccctctccgaaaaaatagaccgatggattaattgcacggacttttgccagtgccgagacaatctgagccttaggatggtagcccattaaatcaaatcggaatgcatctattttgtagtgcttaacccaagtcactaatgagtcttcgatgagcttggcaaacatccggtgttctggtgcggtatcagagcaacaggtattattttcaacattacccgtaatttcatccaaacggtgataataccagggcacgactttatccagtactgaagttcggtgtgtggggccggcggcattggtatggttatacgcgacgtccatgatcacattcatccccagttgctgcttgatggcctgaaccatggtacgaaactctttaatacgtactgagccttctgcatgagtggcataagagccttccggtactgagtaatggaacggatcgtagccccagttataagaatcagtttctgcaagcattttatttaactcttgtacttgcggattgctggcactatcaccgcgttgtaacgcctgcaatacttccctcacggtcatggaacgattgcaataatcagcgaagcggctatttttcaccgttgtgttgacttgacataaccgattgaaggactgattaagatcagccacattacgactaaattcatcaatagaagcgatatcaaacacaggcaacagctctatatgggtcattccggcctgactcagtgcctttagatgtttgaacatatcgctgctgttagccgtgagagccagatatttaccacgccaagcttgtggcactgtgttgtccgcaacagagagatcccggatatgcgcttcatagagggtcatacgtgcaatatctgccggtgtcttctgcggatgcggcatgctcagatcatcccagttttgtggcttcagtgcttcgtcatccagattgatgacctggctatattccgaattcgtagacaggctgtgagaatagggatcggtaacctcatagcgttccaccttgcgggaatacggatgatacacggttaaagcataacggtagtaagccccgatcaaatttgtatcaccctgccatgaccaagagccactcgccgcatcacgattcattatatgattggcgatggcctgtttattttcattataaataaccagacccacattttgagccgtcggcgcccacaagcggaaagtcacctctgtgtcgtttatcagtgcgccatattccagtgtttccgcagtgccggcaaagcggtcgtccaacacaccggcaatttgtacttgagtcgccgataataacaagccttcttcattggtcgccaatgccaccagttcaccggtgattagccgatcaacatccgtgttttctggcaattggaatgcgggcagctccgctaaatgagggaatctttcggctgtctttttgctcagagtcgtcggtgtcagcaccagataactatcagtaaagtttccttcgtcattcacctctactttgttataccgattgtaatataaacggacatgaggcttatctgctccctctggccataatagcgtccgtttatcgacccaatgtgctgaagcctgaagatcgtcagcaatagtggcttcagttggtattttgttcgggatatgagccatcggttcctcggcgattttgggtaaatcatttttgttatcacagcttgtaagtagtagagaaaatagactgcctaataggatcaggtaagcctttttccaaaactgagattccatagccagaccttttaatagaaagagaacatcgactattttagggttaaaaaaatgagatgagatattaaatgctgtctcaaacgattaagcatcctccctagtttataaagggagggaggagaaaataggcggagttttactgcgggggctttaatggttgctttgggataaccccactcaccggaagcaaaaagccgcagcaacatatattgctacggcttttataatctcttcagataatcaatcaaccggcggtaaacacctgattgacaatttccagcgcttcctgctcaatcttctcgcgatgttctgcgccgaggaaactttcacagtaaattttgtaggcttcttctgtacctgaagggcgagctgcaaaccagccgttgtcgctcatcacctttaagccaccaatagaagcaccattaccggaagcggtagtcaggcgtgcagtgatgggatcgccggccagtgtgttcgccttgaccatttccggtgacagtttggacagcagggctttctgctgatggctcgccggagcctgaatacggctataacttggcgtaccgaaacgtgcagccagtttgtcatagcgctgctgcggattctctccggtagtcgccgtcatttccgccgctaacaggcagaggataataccatctttatccgttgaccacggcgtaccgtcaaaacgcaggaaggaggcgccagcactctcttcaccaccaaagcccagctcgcctcgatataacccatcgacgaaccatttaaagccgacaggcacttccagcagctcgcgtcccagatccgcgactacgcgatcgatcatggcactggaaactaaagttttacccacagcaactttttcagaccattgtggacgatggcggaataaataatccacagccgttgccagataatggttgggattcatcaaaccgactggagtaataatcccgtggcggtcgtaatcagggtcattagcaaaagctaaatcaaacttaccgcgcagctccagcagaccggccatcgcccagcgtgatgagcaatccatacggatcacaccgtcatgatccagcgtcatgaaacggaatgtctgatcgaccttatcattgaccagcgttaaatcgagattgtagtactcaccgatccgctgccaataagcaatacccgaaccacccagcggatcaataccgattttcagccctgcctgctgtatggccgccatatccacaacatcccccaaggatgtcacataaggatcaaccagattctgtggatgcagatattcacttttcagtacccgctcatagggcagacgcttaaccccgttcaggtcattcgccagtaatgcgttggcacgcttttcaatgatggaagttaaatcagtatcggcaggcccaccattaggagggttatatttaataccgccatcttctggcggattatgggatggcgtaatcacaatcccatccgcccggtttttcccctgacggttgtagcacaaaatagcatgggaaatagcaggagtcggcgtaaaaccattattttcctgcacaatcacgtccacaccattcgcgatcaggacttccagcacagaaataaaggccgcttcagaaagtgcgtgggtatctttgcctacatagcatggaccagtaatcccctgctgtgcacggacttccactatcgcctgagaaattgccagaatatgcgcttcattaaaactgttgcggccagaactgccacgatgaccggaagtaccaaacttgacctgatgagccggattttcgggatggggctgtagggtataatactgggatgtgagctgtgcaatattgattaaatcatgctgctgggcaggctgcccggctcttggatgaattgccactttaatttctcctgaaaggctacactggcttattcgccagtgcagtttaatcaattcagcggtttaaatcagttaactgatcgaattcagttaaatagtgccacacactttttcaatcacatttgccggaaatttcatatcctgcataacgtgttcaaccatgctgcgtttacggccggtattggtattagtgataacccagaaaggtgtgccggggatatgacgtggcttggtgtgtttaccactggccagcagggtctgctcacttcccgcaaaataggtacgggtacgaccatgcatggcttctgttgttttcgcaaagctttcgctgttcaagctgtacagagtggacagaatcgacatgaaacgctcaacggattttttcttttcagcatactcgtcagaaagcaataattcacgaacaacgcgaacaacatcacgggagcgtgcagccggcactttgctgacagagacagattctctgacaggcggtgtagtttgtactggctgcccggcgtccactttcaatatgcgccgcaaaatatcagatgcactttcaccgatatgcagggtttggcttgcaataaagcggtaaaggtcttcatcaacttctatcgttttcatttctatccagtactgttcttaatgaaaaaattattctgagattataagatataatacagcaaaacaaaacaattaaactttcaataacttaaagtgattctttctgaaattaagaaacaaaaaaaacgggtcttttcctctaaaataaatcaaccagttaccgtcatttgatgccatttagtttgtcactgccgacctgtcatggtattaaacatcacgatattaaacgttgtatcaatgacattaaattcaggcagactatgaactcaaataatcaattaaattatcattttcacacgccggaaaacccacagtcatcaacccccattgtcttgattcatgggctttttggcgatttgagcaatttagggatattggggcgtgatttgcagcaacattatccggtcattcagattgatgtgcgtaaccacggtatttctccgcagatggaaaacatgaattaccgcgatatggcacaagatgttttatctctccttgatgaactgaatgtggcaaaagccattattatcgggcattcaatgggaggtaaaatcgctatgaccatgacggcggttgcaccggagcgtattgaacaaatcgtagttatcgatatagcgccagtgacttacctgactcgccatcacgacagcattttttctgcactgaaccaagtcaaagaagcaggagctcagactcggcaggccgcgacggaagttatgcggaaggatattcatgaggatggcgtgattcaatttctgctgaaatccttccgtcaaggagaatggaaattcaacctaccggttttgcgcaaagaatatgaaaaaattatcggctgggaagcgattcctgcatggcccaaaccagcgctgtttattcggggcggaaattcggattacattactgaagcctaccgcgaagatatcatgcgccaatttcctcaggcaacagcatgggtgatagcgggttgcggacattgggtgcatgcagaaaaacctgaagcggtactcagagcaattcatcgttttttagcaaaaaaataattacaatatcagtccacactctatgtggactgataataaaatcaaattcccttttgacgtcagggaataacaaaacttgtctttttgatatacagcgcataaggtgcttcatttccagcaaaagcatttagaacgaaagatgataataataaaataaataatgcaataaaaaatctaataactctatttagatagaattccatagataaacactcctgtcgcattatataaaaataacatgaaaatcagacaattatctattttactatagtagatagaacatcagaaaatatataataaaaagcattataaaattatttagtttaattaaataacagtaacagataaaataatcactttaatttcatagaaaaaatattatctaacctcatctacacataaattaaacgataatttaacaatggcgtataatgaaaaatagttattacataataaaattattaaatgataataatttatataacacaataataaaaataaatataatcaataaattaaaatatcaataatattaaatgttttcatatgataattattatattattcatatcataatattgttttttattattattgtatgaatcacaaaaacaattaaattcattatcaattagtagttgatatatttaaaaatataaacctaaccttaatatgataatatcggtaaatatattatatcgaataaatcactacaggaggaataatgaagataataaataatacacaaagtaatatcatagtttctgttaataaatggggcgatgatggacaaacgggtcggtttacggtatcacctggcagaagtggatcatggaatcgcactgatgagcgcggttttgtcatggcaatactgaaaaaaggtgtacaagattccttttatattttttctgatagtgacatcaaggttttcgacagttatgttactgataatggcagaagaatcaaacccgcaactgaccgatattattagtcctgctgtgtactaattttatcaaaatgacttgctcaatggttaattagggcaatgtccgactctttaatcgtgaatgaacattgtccatttaacttgagtatttccccaataaaaaattgttttaacagatgaaactagtgaaatttctctgactatagcgatttatttatgatttctccaaaaaaatcaaaaaatacgcgataaaatagatttacctcggtagtataagccagagaaattgctctatttctgatagctatcaggaatggaacaaataagactagcattacagggacaagtactttgactatccaaagtccctgccagtttcgtccccttatctaaaaaagaacccactcctcctacaatgacataatttcctgagtatctcccacaggtaactgtggagccttcaattgcagcctgccgtccataaaatttaatgctgctggttcccgtaaggatttcaccaccacaagttgttttatcgctgactgttaaaaaatatccctttgacatttgatttcctctcttttcagattcgacatgaactcatgaattattcattttcatcgtaataatatttcacttactataaaaaaccaagtaaaaatatatattaaataggctcatttttatcattaattccatttttagaatattaaatttacccttttaaatttacccttggattcgcctaataagtgcgatttcttagaaagacgtcagttgctatagtaggcatctttctcgccaaaggaaaatgcgctatgacctataaacaactgaccgaaacagaaagatatcagattttcagcttgaaagaagccggtttttcaccacgggagatttcaaagtcactcaatcgaaacccatcaacgattagccgggaattgagacgaaatcaggaggcaaagaaatatgcgcctgaacaggctcaacttaaggccgtagcgcgccgacattgttctacaaaagcagtaaaattgaaaccagagatagaaatgtggatcaaacagttaattttgcaagatttaaatcctgaacaaacggtcggttatctcaaaagggaaaatatcatatctttgcatcatgaaacagtttatcgattgatttataaggataaatttaatgagggtgatttatggcaacatcttaggattacgaaaaaaccgtatcgtaaacgttatggaagttatgagcgccgaggaaaaattaaaaacagagtcagtattgataagcgccccaaacttgttgataaaaagcagcgtattggtgattgggaaggagatactctcgtgggtaaagatctcataaaagtgcattattgacattagttgaacgaaaatcgttatttactatcataattaaacttaaagataaaacagcagaagggtcgtaaaagcggccacaagacatttatcactgataaaacataaaattaaaacaatgacctttgataatggcctcgaatttgtcgaacacgaactgatcagtaaaaatgtagagccaaaaatttatttttctcatccatattccccctgggaaagagcgataaatgagaacactaatggattaatcagagattacttcccaaaaggaactgattttaataaggtatcagagctggagattacctcccagggcgcaagcatagtttgattaatattataagttcaaatattaatcaaactatgcttgcgccctgaggttaatctccagctctgataccttattaaaatcagttccttttgggaagtaatctctgattaatccattagtgttctcatttatcgctctttcccagggggaatatggatgagaaaaataaatttttggctctacatttttactgatcagttcgtgttcgacaaattcgaggccattatcaaaggtcattgttttaattttatgttttatcagtgataaat

SEQ ID NO: 14954 - DNA, 37788 bp, Xenorhabdus bovienii
  unsure (1)..(37788): unsure at all n locations
  Genomic contig Name=Xb4151_4152.C413
cttattgagcttcaattccactcgacgcagtcctttgactttatctctgcgcaactggttgcgtttattgatcctaagctgctcgtccctggacagcggattcgttttcggtcgccctggcctgcgttcatctgcgaacaaatccagtgtggtgcgatcagtttgttcttttgccataaattcaattgtaaagggcgtgtaccaatagtatagcgggcaatgataccttagctgggcgcgagccgctactggttgatgggagagatatctggcaggaagatagagatatgggggagtgggttatttcaggatatgcatcgttgattttctggctcagacgggggggttaaaactcaaagttttcattggctctttccacatcgggatggcataacgagccaacgttattgatacttgctttatcaacgtttgattccattcggcttactgtagaggggttaactccctacatctgcattattcaattgaaagcgtatcgtctaagttaataaatgtgataattatgaacatattaattatcacattaatatgttcataattttagataggtagtaattggagaatagtaggtatggtaaccaatgcaataagcagggaaataataatggagagagaaatgacttcctgtttaaaaccatacttattggaaaaaacataaacacctgctcctattggctgtgcagccatgacaatcgcagcaattagccagatattatcagtttgttgcataccaaatagatagtaggcacagagaaacgtaatcaatggctgtattcctaatttaaggcacaacattggcatagctaattttagcgcatcgctgttgatatgctctttgattttaagccgagataatcccagtcctaaagcgaatagtgctgttggaccggaggcattacccagaaattcagcaaatgaacgtaaaaagttaggaacgggaatacctaaaaaaacgaaaaccaatccagcaataactgaaatagtcagaggattgctcaatgttgtctttaatgccccaacgagactttgactaatggatattttgttgccggattggtgtgtagaaaaaatatcataagtgatgataacagccatgattgcaggaatgttatgcaaaatagtggcgatagcggcaggaagcgcggcggattcaccatagactgaaattaggattggaacacccatatacccagttgtaccataacatgcacccatgcttaaaatcgacgattgcggtaaactaatccccataaattttgctactaatattcctaaaatgtatgcggcaccaattccagacaaactggcagttatgaatccccattgttgtagctcattaatatctgcccgagcaatagcaaggaacaataaagcagggagtgcgatataaagcacatattcattgattaatttatcagattttccactgtcagggcgtaagcgcccgaaaatatatccgataaaaataataagaaatattggtacaactatcataaacattataaatcaatcttatatgaatttaaaacataacaacatactcctttgatagagggagtgaactgtacagcctgcatggttgtggttgagacatgcatctgctcttggggggactgggcatttgcagtggaaatgaacagggaaaaacaaacgccaagaagagatagaagatttcttgccattcctcgtccttacagtgatcacttaggttagtgttgatattttagatagattagtctatctaaaaaattcgtgcaaccgtgttctgtgtgaaagataggcgagggcagagggtaattattgtttcaggaaactggtgtgtaacattcgaatttatcgatggtgatgtgcacatcgttaactatgggaattatcactaataaaaaatgaagcccctatttgttgagtatgcaactttcagggcttgttccacctttattaattaatagattttaaaatataaataaagtcctagtttttaatgcgacaaataatatggaaataatgaccagtttctaatctccaaacgtcaccgttattaatatctacaactatattctttgtttcatatccttcccccacaatattagatgaccagaaccaaaagttaccaatgttattgttattattatcaaaataattaacaggccacccataactgttgtaaagagtcccatttggataagcattatgtatatccattaattgatcgctagtgggtaactctcctaatttattgcagtaatctgccgctacacgccattgtggggttacccataattcgcggtttattgtatcaggaatatcatccctttcctcagaatgtaatggagcctcagaatgtaatggaggccgcgagtatttttttccgttaactgtaatgtaatcttccatatgcccccaataattagccagtggtgtatccgggctggtaatcacggtaaaaataacatcccatgttttggtcaacgtctggttggctccgtcatgcacctctaccgacagggtggttcttgtgccaataccgttagggtcagtgacattgataacgagatgacctttttcatcagtatggccgcggtaagtatcctctttacccgccagtacaccttctttcgcctccaggtttactgtgactgtgtcagctttcttctgacgattaatcgccgtcatcttaattgtcacagggacacccccaacggcttgacctccgttctcagttttgaccgtgagcgtaatggttttatctctttcaaccttaaccgccatcgtgccatccgcatccttctcaggtttatccggcgttatcgtgaagtcactcgccacgcctttcaccgtaccatccaggttgccttctaaattattgccttcatcagcttcctgccgtgtatctctgttatatgatttgccacgcgccagtttcgaacgggcttgtatcgcaacttggatgactcggccactgtcttccggtttcagacggtatccggggatggtattggtgttatttggcgggacaatatgatccttgtcatcactattaaattgttccaccagaaactcgggggacttattgtaatcagggtctcctgcgggatatttgataccccataaaaagagggagttatcttggtcatgtccgcctttagcctcaaatttatacgttgcagtcagttcctcatcaaccgctaacttaccgtggattttcagatctgcaatgccggggccccgggaggggtcaataatctgccctatcgtattaccgccctgaagttcattaccttcattctgaccgctgttcttcaaaatatcagttcctggtttgcttctgccatttttgggcgtcaaaacaatttccacaaatttatcaatatcgtcgtcactcagcttataagattcgatctggcccccttgaccatcgacagtgcctgtagcgccctgtttactgatgtcttccggcgtgccgcctattgttgcgacccgcctccaggtgtaggtagttttatcttccacataaccgttattgggctcaaactcataagtggctttcagggttgaatttacagatcggtacccgtgcaagactacattcttaatggaaggaatggcattagggtcaagaatggtgcccggttttgcccctttgggcgtggtttggttgatgttggtgtccgtcataccaatatctaccgttttggcttcaccgacttcgttgtttccgttaacgggcttaacggtaatcgccaccgttttccctgcatccgcttgctccagcgttctggtcaccttgcctgttttgtcctgagcattcttgccgttgtccggtacgggctggtaatcggctgccggagtccccttgtcatgccaggcaaactgggagaggtcggtggcgtcaccgccattaccgttaaaggtatattcggccgtaagcggctgattgatttccaaatcaccactcaggacaatcttgtcgataccgggtttggcatccggatctgccacaccgcctttgccattcccgcccgtaaggccccggttggctgccgggtcggctatatccgtggtcaccggcgctttggcccgcaggttcgccccgttagccgccagtatggacacttccagtaccttaccggcatcgctgcgcgcaataacatacttcactttttcattatccgccgcgccggcggttacccggccttcgccgtttttctgcgccagtaccggttctttcaccccggcggcatccgccagtgccatcacttgtttcgcggtagtgcctttatctccccagacatagaacgaacggtcagccgtattaccgccgttgtccttaaactgatagcgggcatgcagggtttcattgatatgtaaaatgccattcagttgcagattgttcacggccggcgcgttgttttcatcaaactcaatcaccgtctccttcttcatctccgtgccatccacggtggtggtcagcgtccagtggccggttttctggccggcggtgacgacgatttcatacaccccgtccgacacttctttaacatcgccgatttgtggatcttggccttctcccgataattgaccggcggcattgaccctgatgctgtcttttgcccccgtgacgggtttgccctgtttatctttcagcaccacccgtagggttttggtggaaacgccatccgcgggcagcgggctactgccatccgccggctcaacggtggagctctgggtatccagcacatcggccagtgattgcccgaaggcaatgacggccggtttcagcgttttgccttccaccgccggggtgattttccatgtcccttttttctgacctgccgtcaccttggccttataaataccgctgcccggcggatcttctcttaccgcgcccagtgagggcgtggggttctggccgtacagttcatttttatcatcggtcagggtgattttatccgccgctcccgtgatcgggttgccgtccttgtctttcaggttcaggacgaggtctgtactgtcgccttcctgattcaggttgccattttccggcttaaactcggtgcgatcggtatctatcatctccgccaatgaagagccaaagtcaataacagtcggtgtcagctcatgaccatcgatcgtgggcgtgattttccatttaccgtgcctggtgccggcagtcgcggtgatttcatagatgccgctgccttccggaacttccctgacttccgtacccagctcaggatctttaccgtcgccggtcagtgtcgttttatcgtcggttaatttgaggttacccgccacgccgctgacaggcttgccgtctttgtcggtcagtttcaggcggataaccgtttgggttttgccgtccgccaccatcgatttctcagcgggttcaaagccggaaccgtcgggattgacggcagaagaaaccacctgtatcagcgtttccatccgttcagaggcattgccctgagtgtcataagcgatgccggacagggtgtaggtgttgttacccttgtcatggaacggcggcagggtcagcaggtaacgggtgcccccgcgaaccggctccgctgccagattttctgcccgtgtcggtgcatttacgctgtcgagtttgccgccccccgccaccagaccggcggtatcccagacaatctctttcaggccatgctgggcactgacattgacattcagcgggatcaccgcgccgccgcgtccgttaatccggttttccatcatcaggcggatcagatttttcttccggtattccagtacaatctgattattacgctccaccaaatcataacgtccgccttgcagattgcgtttaaaggccacggcatccggatcaacctgttttgaccacggtgtaccgatttcataattcagccccagattaaacagggtttcaccgccgccggaggtactctgccggcgatccagacccagcgtcaccagcgggatcggggtataactggcgccgagggtaaaggcggccggatctttctgccggcgatcttcactcagcaaaccgacttcatcaccaaagtactgctcataaattaacttgccgcccagctgtggataggaaggcacataaccttcggcacgcaggtcaaaaccactggccggccgttcttcgtagtctttcagtttcttgccgtctttccagccgctggcacggaaatagccgttcgccccgaatttcataaaatcacgggcgtattcagcgccgaggccaaagcgggtatggtcacgggttatgtcgtggtcaaggaaagcgttatagcccaacatcccggtatcaaagaagtgacgctgacccagcccgaagttggcggtggtgcggctgtcaatatggcgcaggccgaactgggtaaaggccatctgtttttcggtgtcataaagcggtaacaacatgtcgaactgactgccgtctaagcgcccgcggtcatccacattggcctgtaatttgaccgtgccgtagtgttgcagccagttttgcacggtctgattggcttcactcattgccataccgcgtaactgatttttggcactgtccagcacatgaccgcctttcagcatgcctgccgcgcgggaaacggtactggccagccagcgttcggtattattttcagtatgacctgccggcgattcggcggcggcggcttgtgtcagactctcagccagtaaatgaccggacggagatttgggcacgtcaatttcatctcctgcgcccagagccgtaaagggcttgtggaaggtacgaagctggttgagttttttcaattccgttacggtcaggccatgacgcttggcgacggatttaatactttcgcccgcggccagtcggtaagattcagtctgtaatgtctgtggccgggtcgcctgtgaatgcccgggggttttgtcggcggcgacggcgggcgtgaaaacgccggccaccggaaaggcaacctgggcaaagatattcacccaagcgacctgcctgagccgttgttgtgttgtccactgcttgcgttgttttttaagcatcttcaatcaaccttcagaatcaacattatcctcaccagacgggggttaacccgctgatggcttcgactcatcctggagtgctgctgctatccccataatgagttgacaattagtaccaaactgtcaactaaggggtttttatctgaaaatgaggaagtcgcagaaaaacaaacccgctaaagtgaacattttggaggatacgtctttcgaatttgaacaaagtacaggattagaaaattatctaggaagatcagtaaaaaaagacgtgaacaacgcgggtgggggtattctcagaagggggatttatttagggtttactatcaataaattagcgtaatttttgcggggaaggaaaaaattaactacggttaaaataagcctgtttaagtgagttgacagtttggtactaattgtcaactgttttcgttttcctttcccgtcccataccgtctcgaagcgacccgcattactcgcggtgtagcgcacggtatgacggatgtttctgtgccctaaatagtcctgaatcagccgggtgtctacgccattgtctgccagtgcataaccgcaggcgtgcctgagcatgtgcggattcgcgcaaatcgacaattttgcctttaaactggtctggcggatgattttatacacttgctgacgtgacatccgctggccgctacgggacaggaataaccagtctgagacttcgctgttggcctgtggtgtccctggcaaataattcgggcgtccctttagccactgacgtagcagttgaatctcacgggagaccattggatgaatggtggaaaagccatttttcaggcgctgtacgcgcaggctgcggctgtccaaatccacatctgacagctttagactgaggagttcagacacccgaaacccatgaataaatcccataaacatcatgcagatattgcgtgccgcatgagcatgtttgcctgattcagtcagcaacatttcaatttcagattgcgtcaggtacttacgttttaacatggcatttgccccatagcgtgattaatcagacaataattaaatgtaacattgatcagtgttgctgattatttacggagtgcaatgtcagcccgcagaaaaattcccactatggtgatttttttggcgatactctttcggcgtcaggccattgtagcgtttgaataactctctgaaataacgggtatcttcgtaacccacttcatggctgatttcttcgatggttttctgggacttttccagccagtgcttggcctgtgacaaacgtatctgctggatatactggatgggggtttttcctgtggcgattttgaagcgccgtttcatttgtcgttcacaaaggtggattctattggctaaatcagccacagataaaatttcggaaggtgaggtgtgcatccaatcttgcagtttgtggatgagagaatctgaatgttgacgataaggggcaaaactgatggaatcagacgaaactttggggtcatgttcgccaaacaagaattgtgaacattgttctctggcatattgtccgtaaatcaattcaacaatactcatcatacttttgctgcatccataggcactggaaatgcagaaacggttattgtcacgggtgatttttttgtcggtatacagggaaatatggggaaatagatctttgaattcgcgggaaaaatgagggtgaatggttgcgctggttttcagtaacccggctttggcaaggatgaatgtgcctgagcagactgaaacgataggaatgtgcttcttatccatcgctttgagccactctattatttccggtgagcagtattgcggctgccataccgggaaacccagagaaccaaccagaataatatcgggttgttggccgtgatagagatcggaatgggaagtcggggtgggttcggtcaacagtctgtttgtcccgctcatttcctggtttgctggcgagataatgcggacatggggaatggggccgccaatggcattggcggcgatggtgagtatttcaatcggcatagcaaccgatgtcaccgaggtatgagaaaataccagagctgtgatagctaattgtttcatagttatattctcttccttaagaacattttttatgttgtgttaatttcgttaagaaattaattttaagccgaaacaagtttcatgtcttcaatgaattctctatcgtgatagtcattctgtttgttgatgccaaagttgtgcatacagtccgttttgttgcaataggtcatcatgggagccagattcgacgattgttccttgatctaaaacaaaaattttatctgcatggcggatcgtattcagccgatgggcaatgctgataaccgtccggttgtggcggatctcgtccagattgctcataatggctgcctcggattcataatccagcgcggaagtcgcttcatccagaatcaggattttgggatcattcaacaaggctcttgccaatgcgatacgctgccgttgcccaccggaaagattgcttcctttctccccgacagaatgggcaaatttatgcggaaattcattgatgaagtcagttgcacccgccaaagtcgccgcccggtagacttcttcatcgctggcattgggtttacacagacggatattgtccgcaatgctgccggaaaacagtatgctttcctgcaataccacgctcatgttacgtcggagtgatacgggatcggcgatcgccaaatccataccatcgaccagaacctgaccatgctgcggcacatacaggcgctgtaacaaccgggtcagggtacttttacctgaacccgatggccccgttatgccaataaattcgcccgctttgatggtcagtgacagatttgccagtacttcgggcgtatctgcgtgatagcggaagcgaatattcctgaactcaatctggccggcaagttcaggggaagctgccagcccctgtttgctactctccattggctcatcaagaatatcgccgacccgtcgcaaagcgatcaaagtatgctggaaatcctgccagacttgcgccagccgtaagatcggctgggtgacgtgtcctgccagcatattgaaggcaattaactctccgggggataattcgccgttaagaacgcttctgaccccccaccatagcagtaatgccgctacgattttctggatcaacgcgatcccctgtccggccgcaagcccacttttctgggcggaaaaacgccggatcaattgctggcttaacactttttgccactggcgcagaaagcgtttttctgttgcggtggtcttgatagtttcgatgcccatgacggattccgtcaggaaactggtggcatgggcatcggcttcatattcggtttctactttgcgtcggatgagaggtccaatagcgatccaaagcaggaaatagagtgccagcgaactgattacgatcccggtcaatagagtggaataatggaacatgacgccaagaaacaggatgatgaagatcaggtcgagtagcaacatcagggtggagccggtcagaaattggcggatttgtgccatttctctgacgcgcgcgataatttgtccggtttggcgttgcttgaaatagggcaggggtaatcccaccagatggcgataaagcctgccggagagttccgcgttgatctggcttgccatatgtccgaacacggtattgcgcagaaaaccgtacaggggttctgccacggccagcgccagcatcgccagaccaagaacatgcaggctggataagctgcgtccgaccagtactttgtcgatgacattttcaaacagcaaaggagatgccagcgcaaaaagttgcagcacaatggcgaacaggaaaatatcccgcaactgatttttctgcctgaaaatcgaaggataaaaccagctcaagccgaatttgacttgctgtttggtcagcgatttatctgccaccagcaggattttatactcactgtgtttagcttcgtcaggtgtcgcctgtgtgccgtgcaatgggcgtatttcttgtttttccgtgatgggattgagcacggtaaactgatctgggctgacttcgagcagcacccaccagcattgacccaattcaatcagtgccggtaaaggcaacgtggctgcggtatcggctgtcagacgatcaaatttgctgtgcaggcctacggcatcgatagcttcgcgtagctgccagtctgtcagcgtcagggaatccagacccagcgcatgatgcaattgtctgacggaggcaaccttatgaaattgtgttcccagataggcgacacaatccagtgcgtgattattggtgtgatcttccgtgtctgtatcactcgtaaaggaaaatgcgtcaaccatgattatttttccctcaacgcttcagactgatattcctgaatcggactgagcaggtaatcaatcacccgtcgttgatcggttttgatttctgcggtgatggacatcccggcggtaatttcgacaggcttaccatcaacgatgatattgttttgtctgaggctgatttgcgctggaaaaaccagacccagacgcccatccgtcgtggagtcacgtgaaatactgagcagttcgccttcgatggtgccatagcgggtataagggaaggcatctaccttaaccgtcacatgctggccggggcggacaaacccgacatctttattcaggatctggatttccgcgagttgcacatggtcatccggtacaatcaccatcaaattctgtgcaggctgtaaaaccgcgccgagggtatggacgctcaattgctgaaccgtacccgccacaggggaacgcacgatctcaagggcttctcgctcctgcattttggaaagctcttgtttcagcacgcccagttgcatctctgcctgcttttttttctcaaaccattcccgctctttttgcatgttgatcccctttaaccgctcttccagactcttgtattgggtcatcaagatgcctagttctgctttttgttgcgtgatcacccgttctgtttccagcaattctttttcctgctccagatactccactcggctaatcacctgcttttggctcaatatttttcgtgcctgcaagcgctgattgatattttgacgcaggttggtcagagcctgaatatccccgtttttggctttttgagaagagagattgacgttcatttcagcgtaaagattggtgataatggcatcgaattcatgtttttcatgctcgtaatgcgtctggattttttcctgttgggagagagtctgctgctgaaagagaggcagtgattcgggatcatgcttcccgagcagtgcctgatagcggattttctcttcgatcagatattcacgttgttcaagtagtcgtgtaacgtcctgattaacgccgagcgtattcagcataagcagaggggcatttttttcaatgtgctgcccattttgaatatgaatagagagcagacggctttgttcataagcctgaatgacttgggaacggccggaagcgatcagacgcccggtggcggttgcctgtacatccaattttcccagatacgcccatagcagtaccaccagtaccccgatactcaaggtgatcgccgtataacgggcgaacggggaaggaggacgttgtgacaaggccagatgtgtgggtaaaaaatcataatggggcgaaggagtacgcaggtttttaatccctttgcgtaagatggccttaaacatgggaagtcacctcctgtttcagttcctgttgcaattgccagagttttcgatactgcttgccctgttgtagcagttgttcatggctaccttgttcaataatttgaccttggtgcagtacaatgattcggtcgcactggcgtaccgtggagagtcgatgggcgatggtaatgaccgttctgccctgcgcaatgtccgccatattggattgaataatcgattgtgactcatcatccagtgcgctggtggcttcatcaaggatcagaatggtgggatcagacagcagggttctggcaatggccagacgctgtcgctgcccgccggagagggattggccgccttccgcgatgatagtgtcgtaccccatcggcagcttgagaataaaatcgtgtgcccccgccagtctggccgcttcaataatatcagacagaggagcatcgggtcgtgattgggcaatgttttcatgtacggttttattaaacagaaaattttcttgtaacacgatgcctatttgctgtctcagagattcaatattgaactcctgcaatggaatgccatccagtgtgatggtgccatgttccggggtataaagccgaagtaacaggcgcgcgagggtactttttccagaaccggatgttcctactacgccaagcgtttctcctgcccggatatccagcgtaaaacggttgatggttggggagagatcgggctgatagcgaaatacgatatcagagaatgaaatagcaccctgcaatgagactcgctctttgcctgactgctgttctgtcggcagattcaacatatcccccagtttatcaatggcaatacgtgagcggataaattgcccccagagttgcaccaacttggccaggggttgctgggtatggctgaccatcatattgaacgcgatcaactggccgatggtcatgtgcagggagagtacttcggaggcaccaagccagataatgaccgcactggtgactttttgtaacagcatcacaagatggctggagcggttatcccattgctgcacatcataactggtactcaccatattctcggtctggctatcccagcgccggataaagcggggttccgctgccaggcttttcagtgtctcggcaccggcgacggtttcggtcaggaaagaggtattgatcgcagcatgaatgaattgcttttcgactgctttctcgattttgggcgtgacccaccatgccagcagaccatagaaagggatggtagccaaaaacagcaaagtcagtgtgccggatagcaggctcatcacgtaaatgaatacgaacataaacaggacatcaatacacagggtgaacatggaaccggttaaaaactcccgtacggtttcgagttcacgtacccgcgtcacaattgctcccacttggcgggatttgaaaaacagcaaaggcaggccaagtaggtgccgaaccagttttaagcccagtttgatatcaatgcgattggctgtatgggcatactgatattcgcgtagcccacgtagaaccacttcaatcaggcttgcagccaccagaccaaaaatcaacacatctaaggtggataacgcctgatgaaccagtaccttgtccatgacaacctgcacgaccaaaggagaaatcaacgctaaaatttgcaaaatgaacgaaaacagcagaatttcagtcagattcttcctttgccggataaattcgggaataaaccaacggatattgaattggttacttttttgttttatttttatccagcgtccgctccataaacggataaagctttctttatccaatatttcaggcgcttcctgattaggtttttgaatcaatactcgttgctcatcatgttttgctaaaataaagggatgcccattatcatcgaacagaatagcgggtaaagataatgtgtttaacttcttatttactgaacgtttatttttaatggaaacatgatgttctttctttaatttatttaaagtaaaaagataatcatcattattatttatgtttttatcgggtatgataatgggtttaccattagatatcattattattaatttaattaatgatattgttgttttttctatttcattcatatgggtaaatttattttaataaaaaccaaaacccaaattaaggaaagaaccagaagaagagtatggtatttctttataagataatcttaataaatacgataaaaggtattatctgttatcaatgagtatatcatggttggtaattaggacaaaatgtggtggttaaacagacattattatttttatatgttgattttaaaaagcaaatagatatattttcgttcaagcagtcgataaatcatttgttttctaataacctattttttctgagtttaggtagcgtttaaaatctgtgtgtactcattcctaattttttaacaaatgttgtgttcatgttgtttttgtctggtattttatattcaagttgatcgcaacaacgagatttaatgataaataaaaccataacgatataggtttttaatcatttaatttaatatatttgcaacattaagtttgaatttaatatatttgcaacattaaatttaaatttatttaatggataatgatatgtctgaaaaattcgttcaaaccatttcaagtgttaattataacaaaggcgtgttctctctttattttgttggacaagagcctaaccgaatggcaaatggcatactggctgaaaacgatcaggaattacaattaaagcaagtgattcacatgcctgcatccggctttatgtatatggtttccatggtgaaaagtatgcttgaagaccctcggatggaagccgaaatgaataagctgatcgcagccggattcttgcctgtacctgaaatgagtgaaggtgaaatgccagccccagccgagccggaaactgcggttgcagagaccattgagcctaaaaaacgcccagcccgcgatacggaaaaatcaaaataatatcaggtatcagtaaaaacatatcagatggttgctagcttatgatgatcacacatcaaccggcaacgctgagtgacactgaaatacaagcaatgataggtggggtgatgttgctttgtcagcattcacctttacaccgacgctatttagttgctgagtggcaacagcgtatctttccttcattccagctcaatcagttttgctattacgaagatgaacaccaacgcccagttgctttttgtaattgggcttttttgtctgatagcagtcgggatgcgattctttccggtgaacgggagatttcgcaggaagactggcgctcaggacagcatatcttttttccggaaatgattgccccttttgggcatgcgaagagtatcgcccgtgatcttcgccggcgtgtctttgcagcatggaaggggcaaaaagcctgtactgtccggggaatgctggacacacaaaatgaccactgtatccgtcgggtacagtggtttaccgtttaatttttctgcccaataccaggattacttatgggaaaatcatccaaccgaagtgcagcatatgcctttaccggtaaatatgaagatgataatgatggaaatacaatacacgccatcggcattggcggtgtcattaacgcctatggcggaaatgattacattgtcgtgggttccgttggtgcaaccgtcaatacaacatgggggaacgatactgtcgtgggggcggccgggtatctgaatattaacgatacaagcggtactctgacggtaaaaggaggttcaggttatacctccatcaataaaacaagcgatggcacgatagattttgctggcgctgccggtggactgaaaatcaatcacacaggtgataagggtcgaatcgattattctggcgcgtctggctacaatggcatcacccgcaagggatgggaaggcgatttcacttttaagggcgcaggggggtataacgaactctggcatgaaaccaatcagggaaatttctactttgctggcgtggggggtggaaacaagattgatcgcacatggttcgaccgttatcagggatctcacggcgatctgacctttaacggcgctggtgcggcaaacatcatcagttccagagttgaaagtggtgatattgtttttgcaggcgcaggagccgctaacaatcttgtccgcaggggaaaaaccggcaacgtcaccttaacgggtgcaggggcttctaaccgtattgaacgtacccgccagaccgatgacgtctattctgaaaccaaaggtgatatcaagtttgaaggcgcgggcggttataacagcctgtattctgatgttgcacacggtaatatccgttttgcaggagtgggggggtataaccatattacccgcaagggaacggccactgacttcgataacgaaggcatggaatatgccaaagccgaagatatcgtgttgaaaaatgccaccatgagtggtgactggattggctacaacgtgcaggtgacaggtcttaaatcggcacgggaatcgaacacttatctgtttgcgtttgctgatggcatgtataccaaaatcaacaaagttcagctccgcaatgatcctgaaaccggcaaactgatctatcactcgacgtcttggtataaggaaggaaaccatctcaagacgttagataaacaggatatctctgttcagggtggttttaaggatgtcaagattgacggtgcttacaccctgtcaaacttgacggttgaacaccagcaatctgttaccgttcacgctgttgaggaaaaactggctgaagaccaatggatgaatcatggcgatggcgtgctggttgatgtggcagatgtcacattatcaaatgccaaaatgggtggctatgcgattgacagtaaaggaagcaccgctgatgtacaagtggtgaaatccaaccataaatcgaacacttatatctatgccaagcgaatcgataaatacaccaaaatcgtggttattgaactgaggaacgatccaaaaacaggcatgctgcaatataacgcacaggcttggttcagtttggaagatcgcatggcgaaactggcgaacgaagatatttcttctgctaatggttatcaggccgtgccagcgggtatctatactctgagtgatcttcattacagtaccaaggcagtacgtacagcttcagggcgcgtatctggcatgcacgaataccgtgatctggcgttattcaaatcggcgaccggcagcggtgaaagctccggtgatgtccggtatacaggcgcgggtggcggcaacgttatccaatcgaacgtaacccgaggcaatgtctattttgatggagccggtattgccaatgttattgaacatacttctgagtttggtaacacggaatttaatggcggcggagcggcgaacgtcatcgtcaaaaaaggcaaagaaggcaacctgaccttcaacggtgtcggcattgccaacgtactgctgcatcaaggcttgcgtggcgacatggacgtgaatgcgggtggtgcggctaatatactggttcgcgtcggtgatggccgctatcttgcccatcttttggcggtcggcaatatctccattcacaagggcaacggcaacagccgtatctcaatgagcggtggtttcaatacccacacacaaatcggtcatggcgacgcattctggtctggtgtcggtggcttcaatgtcttgactcaaatggggaaagggcatgtttcctcaattctgctgggcggcgccaacgttctgagcaaagttggcgaaggcgatcttgaatccggcatgttaggcggcgccaacatcattacccatatcagcaatgatcgtgagacgtccaacacgaaagccatcgcactgggtggtgccaatatcctgactaaaaagggcaaaggagacgtattgtcggtcatgggcgggggtgccaacgttctgacccatgttggggatggcaaaaccaccggtatcctgctgggcggcgcgaacattctgactaaagtcggcaacggcgataccacgggcatcatgttgggtcttggtaacattctgactcatgtcggtaatggacagacgctgggcgtgatggcggcggcgggtaacattttcaccaaagtgggagagggtacaaccatcgcggctatggtgggtgcaggtaacattttcactcacgttggtcagggaaatgcctgggcgctgatggggggtattgggaatatcttcaccaaagttggcgatggtgacgcactggcattaatgttggctgccggcaatgtgttcacgcacgtgggtgatggtatgagcgtggctttgatggttgccaaaggcaacattgcgactaaagtcggccatggtgaaatgctttctgccatgattggcgagggcaatatccttactcagattggtaacggtgacacctttgccgccatgctgggtaaggcgaacattctgactaaagtcggcaatggtctgacagccgcgttgatggtgagtgaagccaacatttatacccatgtgggtgatggaaccagcatcggcctgtttgtgggttctgtcaacgtgatgaccaaagtgggcaatggaaccacccttgcggctatgtttggcaaagccaatatcatgacgcatgtcggcgacggtttgactggtgtccttgcattgggcaaagccaacatcatgacaaaagtcggcaacgatttcatgggggttgttgcggcttctgaggctaacgtggtgacccatgttggtggtggcaccacagcagccctgctgcttggcaaaggcaacgtgctgaccaaagtgggcgacggaaccaccgtgggcttactggtttccaaaatcggcaacgtcatgactcatcttggtgatggaaccaccatcgggttcgccaagggtgaagccaacatcattaccaagtcgggtgatgggttgggcatcaatgccgcttggggcaaggccaacatcatgacccatattggtgagggtgatcgctataactttgccaaaggtgaagcgaatatcatcactaaagtgggtgacggacaggaaattaccgtagtccaggggcaagccaacattgtgactcatgtaggcaatggcgatgattacacgggtgcctggggtaaggctaacgtgatcaccaaagtgggtgacggacgtaatgtcgtacttgccaaaggcgatgccaatatcgtgacccagatcggtaatggggatagtttcaacgcactgtggagtcagggcaatgttgtcaccaaagtcggtgatggcatgcaggtcacggcagccaaaggtaaaggcaacatcacgacgaccgtaggcaatggcctgagtgttaccaccgtccacggtgatctgaatgtcaataccaaagtgggtgatggcgtttccgtcaatgtggcctggggcaaactcaacgtcaatacccgagtgggtgatggcctgaatgtttccgtcatgaaaggtcaggcaaatgccaatatccgtgtgggtgacggcttaaacattaacgcctcttatgcccgcaataacgtggcgattcaggtgggcaatggcgatttctatagccttgccgttgcagaaagcaataccgagagtaataagctgagtgccttgtttggcaacgtgaagcagacactgcttggtgtggcaggcagtcagggtatcagccatctggttaatggagacgaagccaacacatcgggaactcataagggacgcggtgcaattgatctgcccgaagtttctgcgctgaatggcttccagttgactgaagtgaagcaggtcacatctgatttgcagcaaagcctgaaaggttcggtgacaggcgttgatactccagacattggcagtatccagaataccttgggcaatgaaaaacggttgaagtctaatcaatcgcgcaatctcattgtcaatggagactttgagcagggcgcagacggctggcaggccaccaatggtattgaagcctcttatgctgcacaggcctatggccttagtaatgagggtcatggcgaacgcgtcagtgaactcgatgctgatacccatgctgataaggattctaataccagtatttatcaggatattagtgatctcactgcgaatgaatccatcacgctgagttttgattttgcaaaacgcgccggtatttctgcggacaacggtatggaagtgttgtggaacggaaaaaccgtgttctcgatttccgcaggtaacgcggaatggcaaaacaaaacattgtcattaaccgcacagacgggcagcaaccggctggagtttaaaggcacaggcacaaatgatggtctgggctacattctggataatgtcgttgccaaatctgagcagccagacagtgctattgctgaccatgtgcagcaggacgccgccgcacagaatgcgttacaggataaagaaaaagccgaagcggatcgccagcgtctggaacaggaaagggatacacaactggccgcagtttctggctctcaggcacaattggaagccacggatctggaggcgctgaataggaatggacaagaccagcgcgatgcaataaatcatgaagcccaagctattaccaaagaattgacggaacaagctaaagggttgtcagcgctcgatagccacagtaaacatcatggaaaatccggtgaacagtggcgagcccaatttgcggagggtttgttaggacaggttcagacacaactgaatagtgcagacgaaacagcacagcagcagttggatcgctcacagcacgcggcttcagaacgtttcggtgatctcagagacgcagtggccaaatcagaagccggagtcagcaaaggcgagcaaaaccagcagcagtctcaaaaagagattgaacagacccgcaccaatgccgaattcaggaagcagcaagccttaagccaaaagacacaggctgaacacgctgaaagtaacgctaaagccgcagtgcagaaagccggacagcgtggtcaacatgaagtttctgaggcagacagccagacagcacgggtgcaatcggatgccaaagccgcaaaacagagtgacaactacaaaccgaaccgcacgggtgcagcaggcagtggtctgtcaggctccgcctatgagtccaatgccgctgaaaaccagcctgagcgggtaaaaacggataatcctatcggttttgcaccgaaaaatgagacaaataccgggttcagtaaggaattacaatatctggatgaagacctcgacgagttggctgaggcaaaagaagcattgaatcgcttacagatcaatgcaacaaaacgcggtaaaaataccggggctaccctgatatcggcttatacagaaacgtctgtcggtcagccggtcagcaagaccgcagatgtgtctaccgaatgggtcagaaacacgccgaaaatttccggtctggatctcagtggcctgcaagcactgggtgaaacccatgttcagcagggatctgccgatgcaccagaaatgtctgctactgccatcagagcgcaaaaagttgcagatgtttaccgttggctggacagtgacaacaacattgctacagatacttatattccggtgcccgggtttgagcgtggggatgctgatattcccgagaacatcagacagaaactggtgacctttattgaaggataccttgagggaactgacaatagtgtgccgaaagatcaagtcgccccgttggcgaaactgttcgttgatgccacgattgattgtaactgggataagcgtgtcgaatttgtctcaaaactggaacaatatggctatagttttgagcctgtccatggcgataaaagcatcgtgtcgttctggtctggcaaaaacttcaagcaataccgcagtgttcttgatgccgtgcagaccgacggcaagaaagtggtttacgatattgatgtgaaaggcaactcttttgccatcgaactgaacaaaaccctgatgcgttggggcaacgtatatctcgattctgacaatgccgaacataacgcattacaaacggccattaatacttcggcacggagcaacaccgggttctggagctccctctatgccaccggatcacgcgatgatgtgtatgtgatcgcagaaggtggcctgcgtcttggcaactacttctggaatgttgaactgccggtattgcgccaattgcagcgtgaagggctggtgggagaaatccgtctgctggataaacctgcccgtgaatatcagggtgcggcaccggaatctattggtcgcaggctgacggaagccggcgtctctgtgaaagcacgttttgattctctcagcattggcgaacaggaaagattgcttacgctgaatccgactgggtataagccggatacactgattgatctcgacataaaactgagcgccatcgacaacatgttgaatcaggcattgccattctacggactgcggacagagcgcaacctgctggtacgtgaagctgatgatgaaggctttgaagtgcgccggtggccgggtcatgatggtgatgacttcaagacgatcattgtggaagatgcgggagatccggctcagatcagggccattgagcgtttcatcctcgccaactacgacgattacggaaaactgccggatgctttgtatttggtggcagaccagattgtttcccacgagcaggggcgtacccgtatcgtggctaaaaaagcggatggcagttggaactacaaaccgaagactgacttgatgtctgccagtgagtttaaggatgcggcttacgttaaaggtaaaatcctcggtgacagttaccgcaacgtactggaagcgttcggcagttacgaaaaagccctgcaaaacggcgcagactatgatctggatgtcgtggagaaactcatcagcctgcatcagcaagttgaaggttatctattggggcatcctgattcaaaacgcttacccgccatgacaaacctgttgtcacaaatcaatgtgcgcatggaagaatcgcgggtactggcggaacctacattgacaagtgtgggtaagggcaatttcagtgagttgtataacaaactcggcaatgccaacctcaaagattcaaaacatctttatattgatgagcagggtgattttgttacccgtggtaaatctaatattcagatagcgatgaaagcggaaggagcggaaaaagcggtcgagcagatcaaagccgccgtgaccagagaatatggtcaggaagtagcagaaaccgtcttttcaaacctgaaatcccgtgatttgtcaaaagatggcaaaggcattgatgtgtctggcttgagaaaggtgcatcaggcaattgaacagcaactgtctccggtcagtgccactctgtttgtctggaaaccgagcgatcacagccaactgggacatgccgccctgcaaattgggcaagggcgttttcaggttagcgcagaagatgccgaaggcttcaatgagaaaaactatgtgagctggtggccgaaaggcggtaaatcgaccagccctggacacatttttaatgtttccactgaggaaaacccagacgtgagtctacgttggcgtgatctcagccagccggcttctcagaatgagacgctggcatttgatgtcggctctgaagaaggggataactttggcttgaaggatgggacatacaagctggagaaatttattgaaaaactacaggctgccaaaggcgttgatgcaaaattcgaggatatcagcgagggctttgccatggctgcgctggctaaccctaacctgcttaaatcagccggtatacctgagcatatttcccgaccgtttatcgaacaatgggaaaatggcaacattgacatgcaggacattggccgagattttgccgaagcactgcggacagccgcgaaacagaaagtcacgcctgagctgactgaaaaacgcatcactaatatcattcgtcagtttgccgaacgtgagttgagcgacattcaggatttcaaggccagcgaagccgatcagggacgtgtattccgcatcaatctggcaggtttggatactgcggcaatgcagacagaatggaacaaaatcagccagaaccctgatgcccgctatcaaatattgaacggtaactgttcaagtattgtagccaaagtgctcaaggcaggtggagccgataaagtgatcggtcatacatggcggccaaattttggtatctggaccccaaccgaattattcaattatgcacagaaactgcaagaagcgcagattgagataatagccaataagccgaaacgcattgtgggtgaagatctggaagcgctcggccagccggataaaaaagacaacgtgctggaaaaagttgccattgacaacgacggcaaaccaccgcgtgacagagagcccttcaatccggtaacccgcttcctaaacaatgagctttacggcgctaaggaagaacgccgcaatgtgtatgattacactcaaacggcgctggacacggctgtgaccaacggcacggcggataaagtcacgttacggggcgacgcagggcgtctgaccggttattaccatcagggcgaacagaaaactgatgcgtcagccgaaccgaatacagcgaaaaaagtagtcctgttcattcatggttctggctcctctgcggaagaacaagccagtgtcatcaagaatcaataccagaagcagggtatcgatatgctcgcagtgaacctgcggggttatggttccagtgatggccgtccgagcgaaaaagggctgtatcatgatgcccgcacgatgttccgttatttggtcaatgatcgcggcgtcaggccggaaaatatcattattcatggctattctatgggcgggccaattgcggctgatcttgcccgttatgccgaacggaacggacacaccgtttctggcctgctgctcgatagaccaatgccaagtatgaccaaagcgattactgctcacgaagtgccaaacccagcaggaatgacgggcgtactggcaaaagcggtcaatggtcagttctcagtagagaaaaacctgcaggggagctcgaagcaaaccccaatcatgttgttgaccgataatgaaggcttgggtgaagcgggagaaaaactgcgcgctaaactggttattgatggctatcaggtatcgggtgaacataccttctatagtcatgaggccagcagccggttgatgaaccaatatgctgaacagattgtgacaggtttgtttgatgtgaagcgtcagccggatgaatcaacggcacttaaaggtctcaggagtgatctgaagcgctatggtgaagcgctggaacctcagaaaagtgcaccgggtaaaacgaaagatatccgtgcgacgcaagactttcttaccggttatcagcaagggcatgcagagcagaccgttgatggtttccgttcagacatgaatatcaaacaactggtggatctgctggttaaaggtaactggacagcagaacagaaaggctcactggcctgggaaattgagagcagagccttgaaggtgaccttccagcctcaggcggagaagcacaatcggctattcaatgacgttgtttcgtccggggtggctgataccaaagcgagcaagcatcttgcaccacaattgttgttattgaacctgtcgaatgacggctttggcggacgttgtgacccattgtcgaaactggtgctggttgcgaaacaactggaaaacaatggtcaggatggcgttgcccgtaaactgctggaaaaaatgtattctgcggctgcggtacttagcaatccaacactgtattcagacactgaacgcggcaatgccaacaaactattgggttctctggctgcccttcatgcccggaacccgatgcatgacacttccataaaggtgtggcaggagaagctggaagataagcaggccttgaccgtcaatggcgtgattgggaaagtgactgccgcaaatgccgatggcaaacctgttttgcttgagctggatgcaccaggccatgcgatggctgcatgggcgaaaggcagtggtgataatcgcgtttatggtttctacgatccgaacgcgggtattgtcgaattttcatctgcggagaaattcggcgattaccttactcgtttcttcggcaaatctggcctgaacatggagcaaagctacaaactgccaaaaaatgccgcgggtgaaattatcttcaaacgtgtggtggtgatggatggcagcgtactggcgacttacaacccgacaagggctgacaagaccaccatgcagggtatccttgatctgaatatttttgatgagacgccaataaaaacccattcagatgtggaaattacccatgaggtgaaagtccccctcaaggacaatctaccggaaggcgttgaccgtgtggttaacaacgagaatgtcgaacattgggagccggcttttgtcaaaccacaggcagaagggggtgacagtcgctttaacagtcaggtcatcatccagacggaaaatgatcctgtcgcagctaaggctgccgcacgtctggccggtaaacatcctgattcaagcgtgattgtgcaacttgatgccaatggccgatatcgagtggtgtatggtgatcctgcgacgttgtccggcaaactgcgctggcagatcgtcggacatgggcgtgatgaatcagtacagcaccacactcgtatgagtggctacagtgctgatgaactcgcgttgaaactaaaacagttccgtaccgacttcaagcaggccggttcgcctgatcatatcagtcttgtcggttgttctttgatcagcgatgataaacgcgatggctttgcccgtcactttatctcagagcttgataagcagggcatccgaaccacggtatctgcccgcagcagcgaggttgcggtagacagcattggtcgtaaatttacacgtaatgccgaagaacagtgggttcataagctcatggacaacaagattgttctgggctggaatgacaagggagagctggaaacccacgctgaacggatccgccgtggcatctctgaaaacgacattaatttgtcccgtatcggtcacatcgatactgatgcgaaagcgaaaggcgcgattgcagaaaatgcagaaacattccacgccccggaacagcacaagaaggtgaatgatgatgcatcagccacgtcatcggcgaagtcatccaacaataaactgagctattccggcaatattcaggtacaggcgggtgatggcgaatttaccgtcatcaactggggaacgaccaacgtcggtatcaaagtcggtacaggtggcttcaagtcactggcttttggtgataacaacgtcatggttcacctgggtaacggtgatagcaaacacagcgtcaatattgccggttatcaggcactggaaggcgcgcaactctttatgggtaaccgaaatgtcagcttcaatatgggacgcagcaacgatctgatcgtgatgatggataaatccattccaactcccccgttggtcaatccatttgatggggcttcccgtatatctggtgtcttgcagaacattgccggctcctttgagtcaccagattggctgaccgcccaagatcagcagtggacactggagagtgcgaaaaaatacgtcagcgatctgtcaggtctcgatctgaccagcagtgttgattacaacactctgaccgatctcgatacggagaatgaaaaaagcagtcgtggcctgaaaagtgatatcgaaaccacactgaacaagaaatacaatcagtggttgggcaggaacggtaatgctcgtgaaatgggtaacgtcagtcgggcggataaattccgtcaggagaatgaaacgctggcctttaacttcgccgttggcgggcagggtgctgatattcaggtaacaacaggtaactggaactttatgtttggtgacaatatccaatcgatcctggataccaacttgggttcactgtttggcctgatgacacaggaatacacttccacgggtatggctaaaaccacgtttactttcagtccgaaggacttaccacgccagcttaaaaacaagctgctcggcaatctggcgggtgtcagtgcagatacgacactggcagatatctttggtgttgactacaccgcggatggtcatattgtttcccgttctggtcaatcggttgatggtgttgcgattctgcgtgaaatgctggaagtgatcggtgaattcagtggtaatcaactacaggcatttactgatccggcaaaactgctcgacagcttggaagccgggctgaatacaggggcagatggtgttaaatcttttgcggaaagccacggcctgcaagcaaaagcgcctgaggaaaacaaagaagggcatgtgtcaatcagtacagagggtaaacctgttcaggaagtcgcagaattaccatcagatcgtgcccttggctttaacctgccaagcctgttcacaaccttgttcaagcagaataaacaggttgagatggcatcactggtcgctgatctgaaacagaatctgaccgctgatttgctgaacatacaggacaaaacgtttgactttctgcgtaacagcggccatctgcaaggtgacggtgatatgcatgtctctctcggtaactataactttaactggggcggagatggcaaagaccttggcgcttatctgggggataacaacaacttctggggcggtcgtggtgatgacgtttattactccgtaggaacctccaatatcttcaccggtggtgaaggtaatgatatgggtgttctgatggggcgtgagaacatgatgtttggtggtgcgggcaatgacgttgctgtactggccggacgcattaactacgcctacatgggcgacggtgatgatcaggtctttgtcttcggtgaaggtggtgtgattgagggcggcaaagggcgcgactatatcgtggcttccggtaatttcaatagcatccatgcaggagaaggacaggattatgttgttgccattggtaacaacaatcaggtgagtttgggggaaggcgacgactttgccaccgtattcggcaactataacaacattgatggcaacgccggcaataacgcgatcaaactgatgggttatcacgcggtgatcaatggcggtacgggtgacgatcacctgattgccaatgtagcctccaagttcagccaattgaacggcggcgatggcgatgacctgctggtactgggcggataccaaaacaacttcaagggtggcacgggcgttaatagctttgtggtcagcggggatgtgattgacaacgtggttgaagatatcaaacgcggcgacaagatcattttcaacaacctcaactggcaaaagctgtggttccagcgcagcggttacgatttggttctgctgactggccgtgatgtgacagacacctcagcacaagggaagtttgaggcgataggttctgtgaccttcaacgattacttcaatggcaaccgtgcggatattgtcacccaaatgggagacaaagatacacagggtgaacgtgaatatacggcgctctctgccaattcggtggattcgttggttcaggcgatgagcgggtttgcaccaaatatgggcgacaccggctttattgatacacttgatagccagacgaaatcgactattgtgaccgcttgggcggacaccacaagcggaaaatccaaactggcctgatagccggaaagggtttttaagcagtaatcttcagtaaatataatggctcacgaaagtgagccatttttttgcgatgtcagtaatactgatatcacctacaaatgagactaatatcacattaatatagtagagttaaatatatctattttttagataaatctgttttatttataaatcccaataacaaatttacagtttattctttcactcgatgctttattacctatcaattattattttttttactaaataaagaataattccaatatcaaattacgttaaattatattatatttcattttttatttcaccataagataatttaatattattgctttatttaacaggcgacgtgtcacggtatgaggtgaaaaccctacagtaattatatgaaaagaatagtgtgtaaaaggaatgtgtgatggatcaatttgaacgctatttccaacgggaactggcctacctgcgggaacttgaaaagtgtgtacgtgaggaaaaaccccatctcaatgaagtcctcggtggccgcgatcccggtgtggaaaaactgaatgaaggatttgctgctttagcggcaccgatcagccagaaaatcgacgatgctttcccggaactgacccagccgctgctgcaacggctcaaagtgcagcccgtcaggggtattcctgccacggctatcatgcaacttgacggtggtgagggcgctgatgttgcgttttcactgcccgcaggcacgaaaattcagaccgtcagcgagcaaagttttatcacaccccgtcagtgtgacgtcctgccattgaccctgctgtcacgggaaatcacccatcagactgatgaaaccctgattatcctgacctttcaatacacaggtaaagatggctattgggatacccaacccatagagctgttcctaagccacgatgaatcggtggcggatgctctgctattgggattatgccgtttttgtggcgacggcgaactgtaccacaacggacaaacctatgtgatggataccctacggtttattccccacgctggcgagtcgcggctggtgttgtcacccccggcagcggccggtaactgggcaccgcagatgttgacggaatccctctacctgcctcacatccatcattttctgacgctggatatgccgtatccggtgaaatcccgacggctgcccatgacggaaagcaacgtattcagcctgacactgaaattgaacacccttctgcccttgtctgaggcgcagatagccgagtctttcctgctgcattgtgtaccggtggtcaatctgcaactggaacggctgagtctgccgtttatagcggataacgtccgttatccgctgcccctgcccgcccatcaggggctgctgaatatcctcgatatcaccctgaagggcgagccgaatgaacaggggcagtcacggggagaggccgggcgcttctgtccggtcagcgaactgacggcgatgtcccgccatcagccggaatacgagaatgcctggttctatgcgctggaggtcacccgcgacgcactgggtagactgcggtacacgctggctttctatgacagccattcccggccattggaaaacccacccaaacgccagtttacctgttactttgtcggattttcccaggcaccaatccagctggccgtcggcgaaacctgtcgcgccgaaagtctgcctgaccgttttcagatgaaaaacctcacccccgtttcaaagagttaccccccggtgattgacgatcagcggcactggcaactgttgtcgcattattccatgagcagctacgtactggtctctgctgaatcctttagacaggtactgaaagactacaatttttatggtgagacggatcggcaaactagccgtcatctccagcggatgattgatggtattcaggccatccaatccactccgggcgattggctggagcggggacagcctttccgctgcctgcatgttgaaatcacactggatgaaaccgcctatgccagtccgggagaaatgttccggtttgccaacaccctgtaccagtttctgccgtttttcctcagccatgacatgagaatgcggatggacgtcaccggccagccttccggtgaacaatggcgcctgttcccgcttcccctgcggggatatcgtcccattatgtaaggagtgataacaatggatggattagtctttacctgtcagataggcaggctacccggaacgacgtttcaggtggcggatttcagcctgcgggaagcgttgtcagaactttatcacctgacacttacggtggtcagcgctcttgataatattgtactcagtgaacagttgggaatgtcagcctccctgactatcacccgtgatggcgtagtggaacgtaccattaatggtatcgtggcaggggctgaacagggcaataccgacggacgccgcacgtggtacagctttaacgttcgccctgagatgtggcgaatgacactcaatcaggatagccggctctttcaacgccagtcggtgccggacattctcaaacaattactgaaagagcaccgtatccggtcagacagcaaattctatgaggatgaagggcatcacccggtgcgggaatatactacccagaagcgtgaatcggcttatgatttctggtgccggctggcggcggaagagggcatcactttttggtttgaggaagataagctctttttcagcaattcccacctcggcatgctggcggggatttttctgacctataaccctcagccggaaactgacaataccgacgcttccgcatggcagtggcgttacggtgaatttttgtgtcctgatgaatttacccacaaggacaacaatttcctgcgtccctcctacccgttacagcatcaggcgatgtcggaaccgggatacggtcatgccgtgtttgaaagttacggccgtttccagttggatgctgagggtaaacccctttccatgctgcggctcaaccagctgaacagcgaaagtaaacgagggacggccaccaccaactgcattcagctccggccgggtaaaatctttattctcagccatcacccgataacggccatgaatgaccgctggcaggtggtcagcgtcagtcaccacggtgcccagccacaggcggctggcattgctggcgaaggtactacgctaaccaatgaagtgacctttattccgggcagggataactggcggcccccttatcgctacaaaccgcaggccgacggcgatgaagtcgccactgtggtggggccggaaggtgaggagatttttgttaacgaacacggtgccatcaaagtgcatttccactggaaccgatatgacgcgccgggggatggttcctcctgctgggtacgggtcgctcagggctggaacgggcacggtttcggctttatggccattccgcgcatcggtcaggaagtgctggtttcctacctcaacggtgatatcgaccgccccatcgtgacgggctgtacctacaacggtcgcaaccgcccaccgctgaacttaccggccgagaaaacccgcactaccttcagaacccagacccacaaaggacagggcttcaatgaattgcgctttgaggatgccaaggacagcgaggaagtgtatatccacgcccagaaagacttcaccggccagattgaacacgatgtttgctggcacatcaaacacgaccagaaacagagcattgatcataaccactacatggatattcagggggatgagcactcacaggtgatgggcagccgcaaatacagcacggaaggggatatttctcagcgaattacgggctcgcagcatattcaggccggagacgcactggtcagcgaaagcggtcaggaaactcaccacaagagcggcggcaaaatcgtgctggaagcggccaccgaaatcactctgaaagtcggcggtagctttctcaaagtcacacaggccgggattcagtcctccgcgattaatgtcggtcagggatcaggcggcagcgggcggggcgtttcgctgcaattgccggaaggcatcccgccgctgcaggcggtcaaattttcggtcaaaaaatactgtgcacttcaggcacaggagcaggccagttgggtaattaagccacagggcggtcaatcatgacagtctgttggataacatggctccatgcgcaggaaaaagcgccgatcttctttatcgtcaatcaacttgccatccccaatcccgttgacaccttttacgccaacggctgggtggaacaggcttttccgctctacaacggcactccgctggcccacctgatggagcaggggccgtggctgatccagccgacagcggacagtctggtgccccttggccgtctgctcgaccgccatgccctcagtgattccagttggggctgggcgtatcgcagtgacgccacatggcaggcgcagttgcaccattggaaacgccatcagcttgccactctgcgcggggagtcggtggtttttcgcctgatggatacacggattgcccgtaccctgatgccggccatgcagccgaccgactggacttccttgctcaaccccgtcacggagttgatgctcgatttgctggtacccaccgttttcagccgtccggctgattgcccacccagtctggtggaacggccctttgtattggagccacacctgatagccgcctgggagcagtccgatttggcactggaaggctatgccgacaccctgacctatgaactgtgggaagcgcagggcgcattggccttgcaactggatacacccaacggagcgctgcaacaacggcttacacagtggctgacacagcgcagtcggcagggttcacgtcttcaggcgctgaccctgcgtgattttctggcagacagcggccttgataccctgcgggcttaagcaaaaaggaggtaagttgatgaataatacaggaagattagactgcgctccctgcgatgacattttcaagcactggctggagttccagcttctagacttgcagggtacacctctgactggtattccctaccggctaagaagccgggatgggataattgatgcccggggggttaccgatggtcaggggctattgcgtgaggaaaatttatcgccgttgccgatgaccctgcacgtcgatgggcaggcactggcggagcaactgaccgaaaaactcctgacagagaaccggatctccacgcagggcggcacccatcaccggatccagccgggcgacgtcagtgacgccctgccggatctgcccggctggacaagggaaaacctgactgcctcccaattttaccccgatcctacgtttggcggatttcaggtcatgccgtctcataaccgtcggcacgtactggaaatcgcccgtatcgtggagccggtgtttgccaaatcctgcctgcaatccgccggttgtaccgatgccggaacggacacggagccgcatacccattttggggaaacatcgatattcatgccattctctgcttctcagccccaggagcaagcgcaaaagccggctcaagcgggttttttcctgcttcctcagatgatgacgcaaagtactaccagcgcattgggagtgggagccggagctgctgcaaataaccagaaaacggaagggacaccgccgcttctctctcgcaacgaaaagcaggtcttgaatggggcatgggacagggcatttccggattatcagctgatgagtactatgcagacggtactgggggtgatgatacggggcatatggaatggcagtgatggcgatttactgacccgtgataatttgacaaaaattgccgacgtaaaaggcaccgcgcctacccgtgtgcgctaccgttttgtggaagatgctcggacagggcaattaaatgcagtgggataccataccagcaaggaaagtgggctggatcaggtgaaagttcgtaatatgtcccataataaggaactgaaccggtacgaattttgggcagatgaaaatgcgaatgaacccaccctgatatggtacccggataatccgggttttattgcacccaatagtacgggtaatcagcaagttttggatctttccagccgcccaactgtcttgccaataccggaagatacaggaatccaaatagaaagctatccgatgccagaagagcggagttttcaggattatattctggtgttcccgatctcgaatatcccgccgatttatgtttatttgagtgcatcactcaaaggtaaagaagccactgacgcggctaaaaaattgggatatgatcaacgaataccagcacaaaaagcaccttttaattctcatggacaaactgtattttttaataaaaaaacaaaaacttatattactccggatgtggatgggcataatgttaataatggttggaaaatgatggataaaaaaggtaaaaggataggaacttatgatagcgagcttaatagacttaaggattaatttatgtttaatattgtaacaaaagattctgccgttaaattttttggcgaattaactttaccatcatcaataatcattgatgattttaaagaggagtttcacttaccaatcacttattggagtttaattgattataaaaaaagttggtataatgccttaaaggaaggattgcataaaaaaaatcatgctgcattagctgtttctatgtatgatccaattagtgttaattttatttttatatggataatatattttgaaggggaagatgtatttttgcagaatcaaacgctatttatagaagattgtcaaaatttttctccgagtaaacttaatgattttattgatcctcgttatacagagactgaaaatggagatagagtatccgaatggagtacagatataaatagtatattagaattttataaagaactagaaaattcaatttaaagtttaaaatatcatctatatttatatgatgttaattatatggatgatgttttggtcatgactccaaagcattaattttatattcttgtgtttggtggattcgactaataagtgcaatgtcttagaaaggcggtcagttgctatagcagggcgcaagcatagtttgattaatattataagttcaaatattaatcnaantatgcttgcgccccgttgcaagcaactgaccgcctttctaagacattgcacttattagtcgaatccaccaaacacaagaatataaaattaatgctttggagtcatgaccaaaacatcatccatataattaacatcatataaatatagatgatattttaaactttaaattgaattttctagttctttataaaattctaatatactatttatatctgtactccattcggatactctatctccattttcagt

SEQ ID NO: 14955 - DNA, 51183 bp, Xenorhabdus bovienii
  Genomic contig Name=Xb4151_4152.C414
atctgctggatcagagacatggcttacatgctgaaatacattaaccatggccgcttaacggtactgttgaagttaaaaatggtcagctggttgttaacggcaagaccatccgcgttacatctgaaagagacccagctaacctgaaatggaacgaagtgggtgttgatgttgttgcggaagcaaccggtattttcctgaccgacgaaactgcacgtaagcacatcgctgctggcgcgaaaaaagttgttctgactggcccatccaaagacgacacgccaatgttcgttatgggtgtcaaccacaacgcctatgccggtcaagagatcgtttccaacgcatcttgcacaaccaactgccttgctccactggctaaagttatcaatgacaaattcggtatcgttgaaggtctgatgaccactgttcacgcaacaactgcaactcagaaaactgttgatggcccatcagcaaaagactggcgtggtggccgtggtgcagcacaaaacatcatcccatcttctactggtgccgcgaaagctgtaggtaaagttatcccagaactgaacggcaaactgacaggtatgtctttccgtgttcctactcctaacgtttctgttgttgacctgactgctcgtttggctaagccagcaacttacaaagaaatctgtgatgcaattaaagaagcctcagaaggcgaactgaaaggtattctgggttacaccgaagatgatgttgtttccactgatttcaacggcgaaaaactgacttctgtatttgatgcaaaagcaggtattgcgctgaacgataactttgtgaaactagtttcttggtatgataacgaaacgggttactctaacaaagttctggatctggttgctcatatctctaaataattgaatagcatcgcatccacgttcataaagccaccttaaacaggcggctttatttttatctattccgatttatctcttaaaaacattgagctattcttgttcctagtcaaccaccaactcaggtttacataaggtcatgacagatgcttgataaaattttctcattaccgattgtagaacaaatatctccttatattagccagcgaaatattgaaggatttccgttgattgttctgtcacacccaaaagtacgcggcgcaatcagtattcagggggcacatcttattacatggcagcccagtggtgaaaaacctgtattatggttaagcgataacactgaatttaatacaggtacagccattcgtggtggcattcccatctgttggccctggtttggttcgacaagcgctcccagtcacggttttgcacggatcttaccttgggaattcagggcacaccatgaaaatgaaaacggcgtgatcttgacatttacactacaagataatgccgagacacataagttatggccgcacgagttcacactcattgcccgttttaagttaggggaaacctgcgaaatagagctggagtctcacggagaatatcaaacaacatgtgctctccactcttactttaatatcagtgatgtcaatcaaatccgtgtcagcgggcttggtgctcactttatcgataccgttgccgataaaaaacagtacgttcaccaagatctgacttttaaaggacgaattgaccgcatttatactgaaccagaagatttcagtctactcagtgatacaccgtggaaacgaactattgaaattcaccattatcaccatagtgatgtagtttgctggaatcccggtgccgaactttccagcagtatgaaagatatgagtaaagaaggttacaagaatatggtttgcatcgaaactgcatgtatcaactccccacaactatccagaaataacaaccctgccaggctttctgtggttatccgttgccgtaaaaatccttgatggaaataaacgataagctgaactctgtcatgactattttgctatgactatcttgaagagttcagcttttcatctttcttgacataaacaacatctgtcagaaagtataagtaatacccgaccagatagtaccggagtatgagcgattggtcatcgggctgtttttcacttcgcttggtaaatgttctacacgccccatcatgaaagcagtccaattattatcgaaggtataataaccagataattcaagataaggactccagctatcgcccggtgtatattcagccagaccgctgcgaacagattcgttctttttgatgccataactataacggttctgttttttgctatcccagacaatgcctatccctggttccaataaccagccgttttgcttgaaactatataagtaggcgaaatcagcactgataccgttactttcgcccagtatatcggcagctaatgaggcacgcaggctcccccagtcttcatgatgtttataagtgaaaccacccataaccgtgtcacgacgacgatccagttttttcatctgctcatctgtactatccttggggtggaaagctcgtggagcatagaatagatctacagaaagcttatcctttggctggttccagaggtaataacctgccgccagagtctgaaaataaaagttttcactctcataagataccatgggaaccggcagtatcttatcttttgttttcaatcccttgtaaggtttagcttcatacaatgccgacaacccaatagaccattcgccagcatatgccacagaagaagacaggcaaagccccactactgcaataaacaccttattagtcattataagttatttcctgtcagacaaattgttgtgaaatcaggcataaagtgtatgtatccggtgatttattgccaagcaattgataatgatttttaatttaatcgcactatatgcataaaatccggaactggcagcttgatgttaccattggttaaaaatcatcaagtgacaacgtcacacttagatattatctgaatattaattttgctgatgttataaaaaaatacaggcattattccaaatttcggtacggaaaaatgcctgaaagagataagatcagttaacaactaccggaacacgtatagctaaagcacagagcagttcataaccaatggttcctgcggattcggccacttcatccactggcaagttttccccccataactccacggtactacctatttctgtttgtggacacggcgtcaaatcaaccgtcatcatatccatcgatatggcacccagtaactgtgtacggacaccaccaacaaggatgggggtacccgttgaggcgtgccttggataaccatcagcataaccacatgccaccgtacctatacgggtaggatactgggttgtataacggctgccgtagccaatttttgcccctttgggtaggtcatgaaccgcaatgatttcactgtgtaaactcatcgctggtttcaaacccacatcagcaatatcacgccattttccactcggggatgcaccatacaggatgatacccggcctaacccaatcaccatgtgtcttcggatgccacaaaactgcaccagaattggctagacagcgaggaagtaagtccattttcagacattcaacaaccgcaaattgctcatcaataccaatctcattatctgaattagcaaaatgagtcatcaacgtgactgacttgatattttttatgcaattcgccattgagaccacttgtgaatattcttcgggggtaaaacccagccgattcattccgctattgattttcaaatagatatcaatggggttattcagtctggcttcttctattgccttgagttgccagtaactatgcactgtagttgtcaggccatattgatcaatgagctgcaaatccgaaagtttgaaaaaaccttccaataacaggattggcccttgccacccgtgttcccttaaataaatagcttcattcatatcaagcagcgcgaatccatccgtttgcatgagtgactgccatattctgtccaatccatgcccatatgcattagctttcactactgaccagattttgctgtcaccgactttctggcggataaccgccaagttatggcggaatgcatcgagatggatcgtcgccaaaataggacgtggcatgacgaccccttataatttatgcagtatgtaaacgatgcttcactcgaagcacttttgtattgaatccattgatatatctaaataccgagagatcatctgccgcgatttccggcgtcttgccagaaattaaatcagacaataacttccctgaaccacaggccatcgtccagcctagcgttccatgtcctgtgtttaaatagagattactatatttggttgggccgacgataggagtaccatctggcgtcattgggcgtagccccgtccaaaatgcagcttcagcaatattgccaccgctgtggtagagatcctgcacaaccatttttaacgtttcacagcgattattcggtacattcatattgaaaccgaccatttctgccatgccaccaacgcgaatacggttatcaaaacgagtaatagctatcttgtaagtttcatccagtacagttgaggttggcgctcttgcttcatccataatcggcatcgtcagagaatagcctttcagcggataaacggggattttaacgaattctttcagtatgttggtagaataagaccccatcgccaccacatagttatccgccgtcatgatgccaccatcacaccggatacccgtgattttgtttccatccaccagaatctgtttaacctgattgctaaacacaaacttgactcccgcctcttctgccatttttgccagcgctttggtaaatatctgacaatcacccgtttcatcattcggcagttgtaacccacctgtcaatttatgggaaacatgggcaagtgcaggctccactgatgccagttgttctgcggtcaataattggtaaggaacaccttcttgttccaatactgcgatatcattggcggcattatcaaactgtctggcagttctaaataattgcagagttcctccctgacgcccttcatattggatgccagtatctgcccttaactgtttaatgcaatcacggctatattccgccaatcgcaccatcctgcttttattcatggcgtaatggtcagcatcacagttgcgcagcatttgccacatccagcgtagctgaaatagtgaaccatcagggcgaatagccagtggtgcatggcgttgaaacatccattttactgctttcagtggtatccccggtgctccccatggcgttgcatatcccggtgagatctgaccggcgttacctgcactcgtttcttcagcggcactatcctggcgatcaaccacagtcacttcatgaccttcctgtgccaaataccacgcactggtgacaccaataacgccaccgcctaaaataaggactttcattctgccccctgttgatatgagtaatatgtgcaagcataatatgctgaatataaaaagccaatatagaataatagactacaacaccattaatttaattttaggatttgaatcacatttttattacaaaatattgataatatcgtcattctaatttcgatcaaaaattaataaaaatcaaattaattcaataaattaaataaaaatttaatactgataattatcttatttcactacctgttaagtgattttcacggaaaaaagaaacataaaatttacaactccaaatttcattaaattattgtcaaaccaaaatattcagaattaaatatccaagcaagaacaattaggcagaataataatttaaaaaattgaattttacagtttgcgtaaattttcaacatcaattgaaaaataaaaataccggggtgtgaataagatggaaaaacaacctaatgtaaaagagcgcactaactaagctagtacgcttttagaatgtgatggcagataaaaaaacagaaattagaaatgaaatgtgatcagctgtgacgtgcttctgttaaatcattcagcataacactttgcatgtcatgccaaatggttccactttctttaccataactacgcacacaatccatgattttgtcataggattgttcccgacacatcgtactcaattgctgatagaaattcagtgccagcatacgggcatcaggatttgagaaataatagcggccaacgcgggtataaagccctcttaatccattgataatcaaaccgtaaattggatttcctgacgcaaaagccagcccacgaaaaatatcataatccacggcactgaaagattcggcggtatcttccacactctctttttctgccaatacttccaatgatttttcaggattatgtctaaatgcagtacgaataaaaatcgcggcgatattggtacgaaccgccagtagattatcaattaactggggaacgcgatcatgatcaagccgtgccagcgtctccagaatattaagaccagatgtttcccagaagttattgacctttgttggctttccatgctgaatagtcaaccagccatcacgggcaaggcgctgcaacacttcacgtaaagtagtacgggtaacaccgatcaactcagataattcacgctctgctggcagcatggaacctggtggaaagcgattattccaaatgctttcaatgatatactcttccgcgaaacccgcagggctttgagccttaattaccatattttaactattccaaagcaattttcttagctaataataatcatcgatcataccagaacgcgtctgaacgacatagttacatagtaaataaacagcgaaagagtgaaaggaatcataaaaaatggaattattcgctgattaattatgttctgatacccttaaattgctatcgtttagagcgtactatgactctttagatttgtcccatgtatccacaaagaggaatatttataataatggaaatcagtattcgacatgcagtggtgaaaaactttctcggcaactcgccggattggtacaaattggctatcattgtttttcttattatcaatccactggtttttttctttgtcaatcccttcgttgcagggtggatgctcgttgtcgagtttattttcacgttggcaatggcgttaaaatgttaccctttacaacccggaggattactcgctattgaagcggtcatcatcgggatgacttcgccaaaacaaataagtcatgaaatttccaacaatctcgaagttattttgctgttgattttcatggttgctggcatttatttcatgaagcaactgctactatttgttttcacgaagctactgttaactattcgctctaaaaaaatgctgtcactcgcgttttgcctggcgagtgcctttttgtctgcgtttctcgatgccttgaccgttattgccgtcgttatcagtgtctcggtagggttttactccatttatcaccatttcctttccgccagccaaaataacaactctgacctgaacgatgatcagtttattgacggcgaagataagaagcagactctggaacaattccgggcatttctgcgcagcctgatgatgcatgcaggtatcggtacagctttgggtggtgtgatgaccatggtgggcgagccacaaaacctgattattgctaaacacgttggctgggatttcgtaacgttctttattcgtatgtctcctgtcaccataccggtatttgtctgtggtctgctggtctgcttgctggtcgagcattttaaattatttggttacggcgctgaattacccgttcatgttcgttcggttttagaagattacgataaaaaaaccagtgaaaaacgcactcggcaggaaaaaactcaacttgccgttcaggcattaattggtatctggctgattttggcactggctttccatttagcagaggtcgggctgattggtctgtcggtaatcattctggctacggcattctgcggtatcaccgaagagcatgatttaggtaaagcgttcgaagaagctcttccgtttactgcactgttaaccgtctttttctctgtcgttgccgtgattattgatcagcaattatttacaccatttattcaatatgtgctgcaatcttcgccagcctcacaattgtcattattctatttgttcaatggattgctttctgccgtttctgacaacgtattcgtaggtacggtttacattaatgaagcgctaattgccttgaagaatggtttaatttcacagcaacaatatgaatttctggcagtagctatcaatacaggcacaaacttaccgtcagtggcaacaccaaatggacaagccgcatttttattcttactgacatctgccctgtctccattgattcgtctgtcttatggccgcatggtggtgatggcgctgccttataccattgtaatgaccttggtcggcttgttgagtgtggaattctggcttgttccagcgactgagtatctgatgaaactcggtctgatcactccgctttaattgctccgtaatttacctcaaactcaaccggatggtggaaatgtgcactgtccggttttttattgcccctttttaaaaagataatgtgattaattttatttttttatggtttttaaaacggcaaaatgagccatcatttatagttaaatttaaactatgggataaacagaaaaatgtttcgatttttaaaacagagttcacaagggcgaagcgcatggttactgatggcgttaacagctcttatattggaattgacagcactttattttcaacatgtgatgaagttacagccctgtgtgatgtgtatttatgagcggattgcactatttggcattttgggagcggctctgctcggtgccattacaccaaaaacgccactacgttggctggcaatcctgctatggctgtatagtgggtggcagggattacaactggcgtgggatcataccatgatgcagctccatcctaccccttttaatacctgcgaattttttgtcagattcccgtcatggctacccttgaatgaatggctgccttctgtgtttcaagccactggtgattgttcggtgaaacagtggtcatttctgactctggatatgccacaatggttaattggtatttttgctgcttatttggtagtgggtgttttggttctgatcagtcagttttttattatccggggtaagaactgaaaacataacttaattgcaaaaagttatttattgttatcagtttaacgaacttccgagatatcaggaataattgcaccacgataaaaagaaacagcccttacgggctgtttcttaagaaaaaatatcgtacaaaatagcaaacacagactccaacatcgccgtcggtgtgtttacaataattgtgggttatttttgacaatcagaaaactcaaatagacgtacagccaccatccaacaaggctcgttcatcacagcgccgcccattcgctaattggcaaaccggcgtttgatttccattaatctgtattgccctcgcgagaattccccctgcatcaaaacagttcatactggcattttcactcagattgattcccagatcagaatactgataatttttatggcgtttagatgaatgatcagtttgttgcccactgcaacccgctaatacccatcccatcagaaaaaagctgcccaaaacgagcctacgttgcaaaaacattttttctcccactgtataaccgatacattagatatttttgtctcttatttcataataatgctcacaaaccaagcaacaaatcaatgaccagtgcttttgaaaacaggtttaccaaaacttggtacatatttaatatgtggttattatacaaatatttaataaatatttgtataatccatcagaagcggaatcaccctatatcaaaactcaggaactggcagctcgatgcagtgtaaaaccacatactatcaggttgtggtgtggtaatgggaagcaaagaagagaaagcttcccaaaacctaattaacgaaaaaaagatttttattaccaaacttttcataaaccctaagccatgcttatctggaagacttttttgccaactctgattgataatcccttttcatcctctatcattgtttccttttttatgttatccgccataataaactgatttcagttttttaaaggtctttcaatccattgctaaacaggcaaccaaaaaagtaaagaacaatcagaaatgaataaccataaaaatcaatataatttcaataaattacaaaaacgcctgcgtcgtgacgcgggtcaggccattgcagatttcaaaatgatcgaagaaggcgatcgtattatggtctgcctttctggtggaaaagatagctatacgcttctatccattttgcagaacctgcaaaaaagtgcaccagttaatttctctctggtggcagtgaatctggatcaaaagcagccaggattccctgaacatatcctgccagcctatctggaagagctgggcattgagtataagattgtcgaagagaacacttacggtattgtaaaagagaagatccctgaagggaaaacgacttgttcgctctgctctcgccttcgtcgtggtattttgtaccgcacggcaactgagttaggggcgaccaaaatagctctgggccatcaccgcgatgatatcttgcagaccgtatttttgaatatgttctatggcggtaagttaaaaggtatgcctcctaaattgatcagcgatgatggcaagcatattgttatccgcccacttgcctattgccgggagaaggacattgaacgttatgccgaggccagagcgttcccgatcattccttgtaatctgtgcggctcgcaacccaacttacagcgtcaggtcattaaggatctgctgcgtgactgggacaaacgttatccaggacgaatcgaaactatgtttcgtgccgtgcaaaatgtggttccatcacatctcagcgattttaatctgttcgatttcaagaatattactcatggcagtgaagtgattgatggtggggatttggcctttgatcgtgaagaactgccctcgcagccagccgttgaatcagatgaccaacttgattttcaagcagatcgtctggatgtggtcgaaataaaatagcgaaaaaaatagccgatgtaaaaactgacatcggcaataattaatcaattattctgtacaaaactcaatttgagaaaaactacaattatggagcacaacgttcatcacccaacgttgtattcacctgcgaaggctatagtgccttaattgtaggatctaattattgatatatctcaaaccagataacattaaccgttctattttgcgataacagccagtttgaggatagtaaactattaaatcgccatatgtctcttacatttttatttagttccctataaccatttggttcgtcttaaccaccaagcaaaaatagttatcagtatgaatagtaagagacagaatatgccgaatccaaaccgatactcattgccaggtattccaccaaggttaacgccaaacaaacctgtcaaaaaggtcgttggcaggaataccatcgtcaacaaagacatcatataaatgcggcgattcatcgcatccgccatcatagacgatatttcatctgcaaggactgctgtcctcgctatactgccatcaagatcatctagcccccgcccgagacgatcagcgatctcctgcatcagacgacgatcctcatcattcatccaaggtagccgttcactggccaaacgcaggaatacatcacgctgtggtgccatataccgacgcaaaacgattaattgtttacgtaataacactaattctccgcgtccggggactttctgctccagaatatcgtcctcaaaacctattaggctatcatgtagctcttcaataaaatcgttcatttcatcggtaatggccccggctatttcaaccagccaatgacccgtacttttggcaccaacgccattatgtaaatcatccatggcttgatcgatacaacgaactttccggtgacggctggaaataatcattctgtcattgatatagatgcggaacgagaccaagtgatcaggacgtgcattttcattgcgattaactgtccgcaaggtgatcatcgtgccttcgccagtgcgaagcacttttggtcggatactttcacctgacaacccttctttcactgaggtcggcagcaaagccgtacccatgatccatcgctggctagcctgatttttataatcaaggtgctgccagaatggctgttctgctgttgcggcttcgttttccccaaatgccatgatacctcccttgccattcaactggcaggaatacacagcgtcggaatctttaaaaactgagccataaatcgtttccacatctgctcctttttagtgcttgatgatgtacatactatgactataggccacgtcttcaggattggtgatcgggtatccttttagccatgatttgatcaatcggccattggtatattgataaatcggagcaattggcgcttgttcggtaattattttttctgcctgattgtaatcacggtttctcgccatttcatcagtttcctgactagcttcttttagcaatgtgtcataggcagaattgtggaatttagcgagattgccactatgcgttgaagtcaaaagagataaaaaacttgatggctcattgtaatccccagtccaagatgctctgacgacatcaaaattaccggtgttacgattatcaacataggttttccattcctgattaactaatttcacctcaacacccagtttctttttccactctgaacttattgcaatagcgatccgttggttattttctaagttgttataaagcagggaaagttttaatggattaccgaagccatatccggcctctttcagtaatgttctcgcctgatcatccaattcctgttgggttaaaacttcatgctggcttttttctggctggaatccagcagtgacatcaggtgtaaagcgccatgcaggtttttcgttcgttcccaagatttttcctgcaatcagtttcctatctatcgtcatggaaagcgctcgcctaacgcgaatatcattggtgggtgcccgctgtgtattgaatgcgtaataatacgtacctagttgatccggcgtgaatacttctcctgggatatcccgcaatagtttctgatacctatttttagggaaagattcagtaatatccaaatcccctgccaaataacgcttggtcgcgtgggattcctgattgataggtaaaaaagtgacttttttcaatacagtacttttatggtcccaataataaggatttggtgtcagaacaattttttcatttacaacacgtcccgtaagcataaatgcgccattaccaaccaaatgaccgacccttgtccaatcattcccatatttgtcaacactctgtttatgaacgggataaagactaaaattggttgtcatattaggaaaataaggaacaggacgatctaggctgacttttaatgtatatggatcaatcgcttccactcccaacttttctgatggtaatttgccatcaataatttcctgtgcattctgaatgcctgataaagccgcaaaccaagaaaaagaggatgcattagcaggattaaccaacctccgccagctataaacaaaatcagatgccgtgaccttgtcaccgttagaccagtgtgcattctgccgtaacgtaaatacccacgtctggttgtctgttgtcttccaatcaatagcaacgccagggatgggctctccataaacatcctgattcaccaatccttcaagcaggtcacgcagcacctgtgcttctgtcaagccaaaggatttaataggatccaatgatgcaggttcatctttcaattgacgaaccagttcctgacggccgtcaagttgagttccaataggtacattagcggcagaaacagaaaaagaaagtccagtcatcagcaatacagagggaagcaacttaaaattatgcatgaatttttgccttgtgagtctaaaaattatcctaagaataaattataaaacattgttaactaaaggaaggcagagtatttctgaatatcgcgtctattttggtgggcaagatcgcactcttcctttacactgataatgcagtttacttaatcaaggaataaaaaccatgacacaaacagtcaagtttcaaggtagcgatatcaccattaatggagattttccacaggtaggccaaacaacaaaagaattctcactggtagctaaagatctcgccgatgtgacactgagccagtacgcaggaaaaagaaaagtactcaatattttcccaagtattgataccggtgtttgtgccacatccgtccgtaaattcaatcaagttgccagcgaactgaataatactgtcgtgctttgcatttcagcagacttaccttttgcacaatcccgtttctgtggtgctgaaggtttgtcaaatgtggtgatgctttctacattacgtggtggtaaatttcacgaagattacggtgttgcgataagccaaggcccattagttgggttaactgcacgtgccgttgttgtcttggatgaaaataatcaggttatttatagccagctagttgatgaaatcaccaatgaacctgactatgacagcgcattatcaatactaaaataaaataaaattacttttgttttccaacatggcaaaccaattgttttatagataaaatttattttcttggcggcgagctatttgtagttgccgccaacttattttatcagtacaccaaaaaaatcctcatttcagtaatgataactgacaaaatacacagaaatcatacaacctaatatcccccataaaaaataatttcaaatcaaaatattaaaaaccacctatttcttaaattcattattttattatttgacagtcatttctataaataaaattaatatcaatataatttaattgaaaagcaattaactatatgaaatagttcattcaaattagtaatatgaattacatggaaaggtacatcctgactatggtgaaggatgatgtttcacctacaggtatcgttcgagcaaggtgagtttcaatacacaaattagatctgtgttcaggagaacattcattatgcagaatactcataataactactcaaatggcgagttttctctatctcatacacttcctatagggtattgtttcaacgaatttaaaattgaagaagtcattggcgaagggggattcagtattgtatatcgtgcatggaatcaccgactgagatgcactatggctattaaagaatatatgccttctattcttgttgtacgtcgtcaggatctaaagctaaatctacgcagagcaagtctcaaaaagagatttcaggtcgggctacataattttatgcatgaagcccatttgatgtcctgttttaatcacccctgcctgccacgctttctgcgtttctggcaacaaaatagtactgcttatattgcaactccattttacagtgggataacattaaaaaaattacaaacgaaatgcccgaagatcatcaatcagaattggatttataatatgttgtttcctttgcttgatgctatcgatacgctccaccaagcaggatatctgcactgtgatatttctctggataatattcttattcaagatgatcagttacccatattacttgatttaggctctgccagaaaagcaacggaacgtttgtcagatgaaaaggaagtgaccataagtcctggatttacggctgttgagcaatacaccgtcaacgaagaagggcaacaaggtccttggacagatatttactctctaggagcggtattgcataccttgattgtcggaacccctcccccagtcagtattgtgcgaaatattgaagataactatctgccattgagtaagctttgtcctgcgggatattcttcatcatttttacatataattgaccgtactttgaaaataaaactatcagaacgcccattgtctataacagaactaataacgcagataaaagcgtcgactataaagacatgacgagtctctgtattattttaaacccgaccaaacacctttacggcttacattcctcccgtaagttcaaacagcgaataatcaccaggtaatcctttcatttatgaagtccaaaaattggccccatcagataaaatatttgatggagctaatacttaacaacagctaatttgatgaaaactactcatcatcttcatgttcggccatctgttttttcccgcttaaactatattcacgtaatttattcgcgatggctgtgtgagaaactcctagccgtttagccagttttcgggtgcttggataatgacggtaaaggcgaatgagtacagaacgttcaaaacgtttactaatttcatccaaagagcctgacaaaatatcgtcactgaatgcaacctctgtctctaattcaggtaactgaatatcctgagggcgtaactggtgaccttcaaactgagttagtgcccgataaatagcattgcgcaattgtctgacatttcccggccaatgataactacacaaaaagtgttccagttcatgagcgaatttaggcttttctaacccctgttcttcagcaaagcgggtaacaaaaaaatccgccaacggcatgatatccgcctgacgttcccgcaaaggaggcaatgtgatagtcaatacattaagccgataatagagatcctccctgaattcccccttctgcaccagctcgaccaagtttttttgggtagcgcagataatcctgacatcaactttgacttcatcatcttcaccaacacgacgaaacgtcccatcattgagaaaacgcagtaacttgatctgcatttgtggcgacatttcaccaatttcatccaacaaaaccgtgccgccattagcctgctcaaaaaaacctttcttaccttccagtgcattcggataagctcctgcggcataaccgaacagctcgctttctgcaacatcatccggcatggaagcacaattcaatcctagaaaaggctgttttcttcttgaactccgcaggtggcaagctttggcaaactcatcttttcctgttcctgtatcaccaatcagcaataaaggtgcatccagcatcgctattttacgtatttgctcaacgacatgaaccattttcgggccgacagcaacaattttgtcaaaagcactgtcatcgctcacagtaaactttttacgcgatgggacaagagcaacacgcgtggttgaacgaagcataatcacagctcccacacatttaacagactgattttcatccgttaattgcatgggaataatatccatgcagtaatcttgacctttgatgactaaatttgccgaatgaggttgatgatgttcactctcaagccagcggaggaaattgtaattactgataaggtggccaatgtttttttgaccaattctctctttgttgagaccaaataatactaaagatgccggattaaccagatcaatatttcctttcatatcaatagaaaatatgggctcaggaacagactccagcaatgtccacattgccctgtgctctttttctgacggcataaaagcaaccgtcctgacatctattactccgttaatacggcgaatttccgccatcaataagcgaaaggtgttgaaatcaatttgagtaaaattaaggtaaatacgacgtgcaggagaaatctcaattcctttcaggtcaatatttcgtaaaaccaataaatcaagtagctcgcgtgtcaacccaattcgatcctgacaagtaacttccaatcgcatttattccgaccttatttacacgatgttcatagccgtctgaaatgttacccgttacggtgcaatagatgaagcccctgtcagtaaaagttgacgataaaacagggcgtcaaaataacgtgacagtaaccactatttgattactgcgctgttctctgttccttttactgcacttttcatcttcgtcggtaacgtgcttttaagctgagtgatcaactggtgacggaaatcccccagttttggcttatcactatcaatccacggtaaaggacggcacagttccattgccttgatacccaagcgtgccgtcagcaacccggcaccaataccttgagcggcacgtgccgaaagccgggcagcaatgtcctgtgacagccaatccataccaacttccctgaccagctccgatgcaccagcaaaagctatattcaacaaaaccaatcggaacaggcgaatacggctgaaatagcccaattcgatcccatataatgccgcaatgcgattaataaggcgaatgtttcgccatgcaataaaggccatatccacgatagccagtgggctgacagcaatcattaaagccgattctgctgccgagcggctgatctcctttttagcctgaacatccaaaacaggctgaacatgtttgctgtagagcatgacgatttcacgatcattatgtgtctcatgtaccgcagcctgccaacgttgcaatgccggatgctgctgcccgattccagcctgctccgccagcttctcacaaaattgacgccctttacctatgccatgactttgcaataatgacttcgctatatcgcgctcttctgtccgttgacgcaaacgataaagacgctgccattcgcttattacagtacctatgcctgcaaaaacaatcatgctgcctgcggcggccacccccagcgaaatccaatcgtgttgctgccatgattggtatatccattgaataaactgcgcaaccacactaatacccaacaacagaaccgcaccagaaaaaacttttcgccaaaaactacgctttggtttcagagcggcattgactgcgccttcaaactcgcttttttgctcttctgcttcccgttcaggcgcgactggacaaaactcattttcctgtccattgaattctttcttagatttcaatgagggttccgactgggtctttaaacaatcgtcgaaatcaattctcggtttcaagggatcagtcatgttagtttatctcccaataaaaactccatcgcactgtccatacggatgtgaggtaacggtgtatctacatttacttgttttggccgaaaagattcaaaattaaacccttgtttttgccagaagtcattgttcggtaaacgctgtggcacctctcccgggaaaaacgtcagcaatttatcatctgacaaccgatttcccttgatagcggggattttttcaccatcgtgaagcacaataccactttcagtagcctgaacagatgctaaaccaacacaatccatgctgatcccttcaaaagccgcattctgccacgcttcctgaactaattgctgtaagagagatatgaggttagcgtgttgatcagcagtcacgtgatcagctttgcttgctgcaaacatcaatttatcaatgcaaggtgaaaataagcggcgaaataaggttcgcttaccataatgaaaactctgcatgagctgtgccagagccagacgcatgtcgttaaaagccggtggaccgctgtttaatggctgcaaacaatcaaccagaacaatttgtcgatcaaaacgaagaaagtgctctttataaaaaccttttacaatgtgatcgcagtagtaggcaaatcgttcccgcaacataccaatattggtatgtttatccgccttggccagttgtgactccccgatgccgttaatatccagccacggaaaaaattgtagtgccggcgcccctgccagatcacccggtaatatgaaacgacccggctgaatgaaatgcaacccctgagctttgcattgatgcagataatgcgtataagcctgtgcgattctggcaagcaaattttcatcggcaggtgccaggggatcgcactgttggcataattcgagccatggtttagcccaatctgccctttcccctttcagcataccgttcatctgtcgtgaccatgccagataattctgctccaacatcggtaaatccagtaaccattcccccggataatcaacgatttccagatacagggtggaagtttctttgagataacgcagcagggaatcttcagagcgataacgcagagccagacggatttcactcacgccctgcgttggtattggccaataagggggtgtatcgtgcaatgcggtaatattttcatcataagcaaaacggggaacaccaaaatcccgttgaggcacccgcttcacaccaagtaaacgcccatcccgcacagcagaaaacaacggcaatctagccccgctgtggacatgaagaagctggttcaccaaagaagtaataaatgccgtttttccactacggcttaatcctgtcaccgccagccgcaaatgacggtctactccacgattaacaagagatttcaattcgttttgcaaccgtttcatgtttctcctaaatggaataccgtgactcaatttatatccggcctggtaacatcaacagaattattgccaaaatttggcatcctcactgtcgttactggccagatttcatatttatctatggcttagatgctattgcataaagtttgccacggtttaaagctgacgaaaacggctgcgcacactgtaggtatcagaggtgatatagcgctccatctgacgcaggcgcatttcacctgccctcagttggtaatcaacctcatccagtatcttttgtcccgatggcctcttatttatgtcctctgcctgatatcccgctggcgcgggatccataacaaaggtcaagataatatataccaataccgtgaagccaaataatccaaagaacaacgataataccgtgatggtacgcatgagcggaaccggtacattaaaataactcgccaacccagcacaaactcctttcaccatcccctgctctggaagacggtaaagtttccggcgataagtattcgacattatgattgcctccagtttggatgctctgcatcaagtatctcttccagcgttttaattcgctcctgcatatgccgtgcattctctgccaattgctccaaacgctgaatttcattgctccctaactgaccccgactctggttactatagtgcaaccacaaccagatgggtaaaacaaaaagcacgaagaggatcagcgggattccaagaaatatatagcccattatctttccttaaatggtgagtcaatgattaatcattgtgaatctttgacactcattttagctttcaaggctgccaattgtgcactaatttcgtcatccgcttttaattctgtgaattgctgctccagtgatttctgtttgcccagcccaatagcttccgcttctgcttccatatgatcaattcgacgttcaaactgttcgaaacgtgccatcgcttcatcaattttaccgctgtccagttggcggcgtacttcacgggaagatgcggcggcctgatggcgcagggtcagtgattgttgtcttgcacgcgcttctgtcagtttgttttccaattcagttacttcccctttaatacgtccaagggtttcatccagaatagacagttcatttttcaacgcgtaaatcaaattactgattttctgtttttcaatcaaagcggcgcgagccagatcttctttttctttacttaacgccagttcggctttttcttgccagccttctatttgattctcaccaacaccgatacgacgcaaaagctgttttttctctgctaatgtgcgggccgatgttgaacgaatttccaccagcgtatcttccatttcctgaatcatcaggcggatcattttctgtggatcttctgctttatccagcagggaagagatattggcgttaacgatatcagcaaaacgagaaaaaatacccatagtcataaacctctttcattagaatgtatgtatgttatgcctgtgtactattaaaacagatatacggtaaggcacttaattaaatacaagatacatgccaactttcataccttgcttatccaattgaattatttgatataatttctctttaactttttagcgctatagtttatcgtggttaaattgaccaactattggtgaaaaataccatgcatcaattcattgataacctattaggcgaagcaaactgctttattgaaattctggagcaagtctctgcacttgcaaaattaaataaacccgttttggtgctgggagaacgaggaaccggcaaggaattgattgcacgtcgtttgcactacctttccccacgctggcaaggctcttttatttccctcaattgtgctgcacttaatgaaaacctgctggattctgagctgtttggccatgaagctggggcatttacgggtgcacgttcaaaacatcaaggacgttttgaacgtgccgatgggggaacactgtttcttgacgaactggctaccgcacctatgcaggtacaagaaaagctactgcgggtaattgaatacggttaccttgagcgggtgggaggcaatcaatcgctacaggtggatgtacgattgatctgtgcaaccaacgaagatctacctgccatggctgcccgtggaaaattcagagctgacttgctcgacaggctggcatttgatgttgttcaaattccgccactacgccaaaggcagcaagatatcatgttactggcacaacactttgccattcagatgtgccgagagttgaacctgtcgttcttccccggatttaccgatgaggctaagcaacagttacttacttatcactggcccggaaatattcgtgaattgaagaatgtgatagaacgctctatttatcgacacagagataatgaaaaagaattagataccatcattatcaatccctttgcatcatcacaaatattttcttcacaaatgtctattcctgcgtgtaatcataacgaagtgatgccttattccctcccctgcttaccttttgatttaagacaatggcaaaatgacagtgaaaagcagttgattatacaggcattggaagaaagccagttcagccagaaaaaagcggcagggaaactcaacctgacctaccatcaactgcgtggattaatcaagaaacaccatatcaacattcatgtcatggattaaaagggaagaggaattagaggataaagggataaaaaaatagccagcacccgagctggctaataaaaacactggaagcaatgtgagcaatgtcgtgctttttctgagaaaacatatttagtatcacaagatgtctctccaaagcacggtataaatgataatgtttctcaatagtatttgtaaagtattttattgagaatttttctcattatagtgatctacccgttgtttttgagcagaaagcgttaattaagttacaatgcacaaactcttttttatgattgatgttttatatgcgctatttgatttactggatcatattattgctttcagcatccacactggctgctgacaatgctattccagaaacgactaaagctactcaccaagcgattcctgacgacacattggataatttatcctatatgtcggctgccttgcggcagaatggttttatttattgcgttaacggcaatctgaatacttttaaccctcagatggctatcagcggcctgactgtggacactctggctgcccagatttatgatcgtctcttaggtgttgaccctctgacctatcgtttgataccagaactggcttcccgctgggaagtgcgggacaacggggcaacataccgtttttacctgcgccataatgtcgctttccaatcaacggactggtttacgccaacccgcaccatgaatgccgatgatgttgttttcagcttccgtcgcttattcgataaaacgcactattaccattatgtcaacggtggggattacccctattttgatagtttgcaatttggtgattctgtactgagtattcaaaaaatcgataaatatacagtcgaatttcgccttaatgcacctgatgcgtcgtttccctggcacttggcaactcactatgcctcaatattgtctgaagagtatgggcaaaaactgcataagataaatcggcaggaacaaattgattggaaaccagtcggaacagggccattcatgctggaagattatcgggcggaacaatttattcgacttatccgtcatgataagtattggaagggcaagccatacatggaacaggttgttatagatgccggcgccggcggcacaggcagaatttctaaactgctgacgggggaatgtgatgtattggcctatcctcccgcgaatcagttcagtgtgctgcatgataatccgaacctgcaccagacattacgctcaggtatgaatatcgcctatcttgcgttcaatactagcaaaccaccgctggacaagctggcagttcgtcaagccattgcatatgccatcaataatcagcgactgatgaaatccatctattatggcacggctgaaacggctgcctcaattttaccacgcgcatcatgggcttatgataatagtgcggaaataaccgaatataatcccgaaaaatcacgaaaaatgctaactgaactgggattaaatggattagaactgacattatgggtaccaacggcttcacaatcttataacccgagcccattgaaaatggcagaactgattcaggccgatttggcacaggttggtattaagatgtctatccatcctgtcgaaggccgtgctcaggaaaaccaactgatggataaaacccatgacatgactctagctggctggtctactgacagtaacgatcctgatagttttttccggccactattgagttgtgcagccatcgcttcccaaaccaatttgagccattggtgcgactcagcctttgatgatgcactccatcaagctttattaaatcagcaacttgcatcacgtattgaaaactatcatattgcccagaaaatccttgcccagcaattacctgtactaccattagcttatccaacacaactacagatatttcgttataacattaaaggattagtattgagcccatttggcaatagctcctttgctggagtctaccgcgtacaggaaacgaccacgcctactggaaataaaaagggaagcaaatgattatttatattctgcgtcgtttattgcttctgcttgtgacgctgttttttctttcattaatcagtttcagcctgatgtatttcacgcctcatggacctttgagcggtgcatcattgactgatgcctatgtgttctatctccacagcctgttacagtgggattttggcatttccagcattaatggcgaacgtattattgaacagttgtacagcgtttttcctgcaactatggagctttgtattctctctttttctatggcgttattaatcggcattcctttggggatcattgctggcgtctggcgcaacaaaaaggcagatacaatcatcagtacatttgccctattgggtttttccattcctgttttctggctggccctgttactcactctcctcttttcactgtatttgggatggctgccagtctcaggacgatttgatttactgtatcggatggagcaagtgacaggttccgcactggctgatgcctggctgtccaaagaaccttatcgcaatgaaatgatcgtgaatgtcattttgcacatgatcttacccgtcatcacactagccgttgcacccatgaccgaagtcattcgtttaatgcgcaacagtgcagaggaagtctccgcatcaaactatatcaaatcggcagccactcgcggactgtcacgattgacgattattcggcgccacttgttgcataatgccctgcctcccattattcctaaactgggattacaattttcaaccatgctcacgctggcaatggtaacagagcaggtattcaactggccgggtttgggacactggctcatcatcgccattcgccagcaggattattcagccatctcggctggcgtgatggtgatcggagctttggttatttcagtgaatgtgctgactgatattattggcgcgatagctaatcccctgaagcataaggaatggtatgcccttagataatttctaccgtgaaaagaaaatgccttctccactgaaagttatctggcgttttttctatgctgatatactggcaatgacgggtttttatggggtactgattttaattgcattaagtcttttgggtggacaaattgccccctatcaacttgatcagcaatttatgtaccagcttatgcccccgtcatggtcacaccacgggaatgtcgcctttttccttggaactgatgatctcgggcgagatattttcagtcgtttgctgattggcacgtcttccacatttggagcggcattaattgtgactgccgcagcggcaattgctggattagctatcggtagccttgctggtatgactcatggactgagatctgctgtcttgaaccatattcttgagacattactttcaattccctcactgttactggctatcattgtcgtggcttttgtaggagccagtctgcaacatgcaatgattgctatctggctggcattactgccgaggatagtgcgcacaatttatactgctgtacacgatgagctggataaagagtatattatcgcagcacgtctggatggtgcttcaaattatcggattttgcgatatgccgtctttcctaatattacagcggcgatagtcagtgaattaacccgcgcactctctatcgctattcttgatattgctgcattaggctttctcgatctaggtgctcaattaccatcacctgaatggggagccatgctggggaattcattagaactcatttactctgccccttggaccgtcatgttacccggtgctgccattacgctcagtgtcttactggttaatttactcggtgacggactgcaccgcgccattaatgcaggagtcgaataatgcctctgctcgatatccgaaatctcaccattgaatttatgacgtcagaaggccccgttaaagtggttgaccgtatgagtatttcactgacagaaggtgaaatactcggattagcgggtgaatcaggatctggtaaaagtttgattgccaaggcaatctgtggtgtcacgaaagacaacctcagcgtcaccgcagaccgttttcgtttcaacgacattgacttattgcgcctgacgttaagacaacgtcggaaagtcatcggacacaacatttcgatgatttttcaagagcctcagtcatgccttgatccatcagaaagtattggcaaacagctcattcaatccatcccgggctggacctataaaggtcgctggtggcagcggtttaattggcgaaaacggcgtgccatcgaactactgcatcgagttgggattaaagatcactatgccatcatgcactgttatccttatgagttaacggatggagaatgtcagaaagtgatgattgccattgcactcgccaaccagccacgactgctgattgcagatgaacccaccaacgcaatggagccaacaacacaagcccagatattccgcttactatcgagcctaaaccagaacaacaacatgacaatcttgctgattagccatgatctgcaaatgatgagcaaactggtcaagcgcattaatgtactgtattgcggtcaaacagtggaaagtgccacacccgatgaattgctagtgacacctcatcatccttatactcaggcacttattcgctcaattcctgattttggcaacaatccattgcctcataaaggccgtttaaatactttatcaggggctattccatcactggagcatttaccgataggatgccgcttgggacctcgttgtccctatgcccagaaaacctgtattgaaaccccacgtttgcggggagttaaaaatcattccttcgcctgtcatttccccttgaacatggaggaacagtaattgattgagacattactggaagttaaaaatctgactaaaacattccgctaccgaaccggactgtttcgccatcaccaccttgatgctgtaaagcccgtaagctttactctgcagcccaaaaaaacgctggcaatcattggtgcgaatggctccggtaaatccacgctggcaagaatgctgtcaggtgttatcgaacccacttcgggcgatattctgattaataaccatcaactggcctatggggattacagttatcgcagccaacgtatccgcatgattttccaagatcccagtacatcattgaatccccgtcagcgtattgggcagattctagatgtgccattaatcttgaatacggagctttcttcttctgagcgagagaagcaaatcaaccagacgttacgtcaagttggtttgctgccagatcatgcctactattatccgcacatgctcgcttcaggtcagaaacagcgcgtggcattggcacgggcgctgatattacaaccacagattattgttgcagatgaagcattggcttctcttgatatgtccatgcgttcccaaatcattaacctgatgttggaactacaagagaagcacggcattgcctatatctatgtcacccagcacctcggcatgatgaaacacatcagtgatcaggtgctggtaatgcatcagggagaagtagtagaacgtggcaatacagcggaagtattggcctcaccattacacgatattacgcgtaaactgatatccagccattttggcgaaccactgtccgccgaagcatggcggcaggatatcacttaatatttttttactactggacgtattttattcactgctcggagcagagtgggaaactcaccacatttttctccagcgtggtagaatcattcccgtttattaacaacaaataccctagttatagtaattatatatttttgttactccacaatataactctggtgttgaccactaagaacaataaggatactgctatgggtttcatgaccggcaagcgcattctcattactggcgtagccagcaaactgtctatcgcttatggaattgccaaggcaatgcacgatcaaggagctgagctggcttttacctaccagaatgacaagttaaaacttcgtgtcgaagaattcgcggcatcattggattcgaacatcattctgccatgtgatgtggctgaagatgaaagtattgacgcattattcgctgaactaggtaaagtatggcctaagtttgacggctttgttcactctattggttatgctcctgctgagcagcttgatggtgattatgttaatgccgtcaaccgtgaaggtttcaaaattgcacatgatatcagtgcatacagcttcgtcgctatggcgaaatcatgccgcaacatgttgaatcctaactcagcccttctcactctgagctatctgggtgcagaacgtgcaatccctaattacaacgtaatgggtctggcaaaagcttctctggaagctaacgtgcgttatatggcgaatgcaatgggtgctgaaggtgttcgtgttaacggtatctccgcaggcccaattcgtacactggcagcatctggcatcaaagatttccgcaagatgctggcacactgcgaagcggtaacacctattcgccgtactgtaacaacagaagatgtaggtaatgcagcagcattcctgtgttctgatcttgctggtggtgtgacaggcgaaattatgcatgtcgatggcggtttcagtatcgctgccatgaatgagctggaattgaaataatttcaataactcattgatatcttaaaataagcctggtgataactgtatttctgggcttatttttttccctccacctctgtattatcttcatctatcctcatattgttctaattgaacgctaccaacaaatcgaatggctgagttatgtcgccagcgaaatacatcgaagcctctgggcattctccccagcaatggaggcaccagaaagctatccttcgattactcgccataaattactgtaaaaatttacttaccttgatgatattttgtcaagacgctcgtatattgctggcgatcattttacagtcatagatgcttatctcttcacaacctgtggctggacatctgatataaaactggatttatccgaactcagccatttgagtgcctatctgcaaaatatcagacagcgctcacatgttcaggatgctttaaaagcagaagggttaatttaaatctgagaattatcgcttccggtgcgccaaaaaaataatttaagctaccggaagcataactttatcgacaatcttgatcgtcagtcaatttgcgccgcactgaattgatgtgttggaatgaccattttatcttgagcggcaataatctgtaactcatattcccctctctcctgagtctccagcatcacttcgtagactgctgatgcaacatgctccagcgccgcttgtaatgcttcatctgttagagatgtacttttcagtaaattgacgagcaacaaaccactcgttaaatcaccaacacccacaggttgacgttcacccgtattaatcaatggacgactaatatgccaactatgttctttagtcaccaaaagcatttcaaagcgatctgctctgtagcctgcacgattgaggtgtttgactaaaacaatctctgggcctttttcgcacaatgcgcgggctgcggatatagcttgttctacattttcgattttccgcatgctcaacgtttccagctccagtaaattaggagcaatgatatcgctgatgggtaatgctttctcacagaggaattctgcaattccaggagcgacaatacaccctttttctggatgtcccatcacgggatcacagaaataccatgcttcgggattggcttgcttaacctgtcttacaatatcaagaatatggtttccctgttccgcagaaccaatgtaaccactcagtaccgcattgcaggaaactaatttatcaatttcaccaattccctgggcaatttcagccaaatgctctggcggcataacacaaccacgccattgaggatattgggtatgattggaaaattgaaccgtattcaatggccatacgttcactcccattcgacgcattggaaaaacagcagcactgttcccagcatgaccaaaaacaacatgagactgaattgaaagaacatttttcatgataaggcctaatttattattttgtgattcatgagcggcttattaacaagtcgaattttttaagggcaacattgctgttgcccttaactttgtttttcactgtgtctttaactacaactacgtctttatgagttatttccagttgataaggcaataatgctttttaccacggcgtaacaaagtataacgctcaaacaaacgatcgctgtccgcgaacgtatattcagcatcggattgtttttcaccattgatggaaaccgcattagaaccgatcatggtacgagcttgaccacgggaaggtaccagcccagcggtgaccagagcttgttgcaaatcagcgtctttttccagttcaatcgctggcataccatcttgcgccaattgagcaagatcttcttcagtcaaatctgcaacaatgccagaaaacaggctattagtaatgcgtttcgccgcagcaagaccggcttcaccatgtaccatacccgtcacttgctctgccaatacatactgggcgcgcggagccttaccgctgttcttatcttcttcttccaaagcattaatctcttcaatgctcataaaagtaaagaacttcaggaagcgataagcgtccgcatccgcggtactaatccaaaattggtagaatttatacgggctggttttctttggatctaaccaaactgcaccaccttctgtcttaccgaatttagtaccatcagatttagtgatcagtggcactgtcaaaccgaaaacttgtttctggtgtaagcggcgcgttaagtcgatacctgaagtaatgttgccccattggtctgaaccgccaatctgcaattcaacaccatattttccattcaggttagcaaagtcatatgattgcaacaggttataagaaaactcagtgtacgaaataccaacatcatcacgatgtagacgctgctttaccgcctctctgttgatcatctgattaacagagaaatgtttcccgatatcacgcaggaaagtaagcacatccatttccccaaaccactcatagttattggcaatttccgcacggttttcaccacaatcgaaatcgaggaatggtgaaacctgtttacgaattttttcaacccactctttaacggtctcttctgtatttaatttgcgttcagttgctttaaaactgggatcgccaatcaaacctgtcgcaccacctaccaacgcgataggcttatgcccggtcagttggaatcgttttaaacacagcaagggaaccagatgccccaaatgcaagctgtcagcggtaggatcgaagccgcaatagagagaaaccggaccttgcgccagcctctctgctaacgcttcttcatccgttacctgggcaacaaggccccgatcttgcagttgttttatcaggttattgctaaacatcaatggctccatcggtttgtatactttacctatataatgacctatataagtaactcgttataaattgcgtgctatagcataaaacgccagtaatttaagtaccagtattaaaaacagtaattaatctcttagggtgcaaggcgatcaatatgccactcttcgccttcccgctggtataaaaaacgatcgtgaaggcgatacgcgcctccctgccaaaactccacagaatcgaattcgactttgaatcctccccagaaactgggtagcggcacttctccactctggaatttctgtttcaactccagaaatttaccttctagaatgcctctagtagaaatacgggaagattgttgtgacacccatgcagcgatttggctatctcttgggcggctatggaaatatttcacaacctctgtaggagataagcgttcagctttgccaaggaaactgacctgccgttcaagctggtaccacggaaaatggaggctgattcggttattctgggtcagatgcttcgccttgcggctaccaaggttggtataaaaaaccaagctacgggcatcaaaatgttttaataaaacaatacgttggtaaggctgaccgtgttcatcaactgtagcaatgcacattgccgtagggtcaataagtttggcttcacaagcctgtttcaaccaaagttcaaaaagttcaatcggttctttagtaagatcctttcgcctcaatccaccacgtatatattcgcggcgcaggtctgcgatacccgtttcattatgttctgacatttctaactctcgatttcttagtgagtattaacatatcattgttatctgctggcaacaggataaattgcccctaaaatcgtttccctgtccgcacccgttactgacggcaagttacccgacaatccagacatagtgcggaatgccagccaagcaaatgccagtgcttccatatcgtcaccactcaacccatatctgtcggtcgtagcaacttcagtaattggcaataaatcagataagcggctcattacacgtggattccgtgctccacctccgcagacaagcaaacgctcacacccaccactcaagatgacctgttgtgcaatacttaccgcggttagttcagccagcgttgcctgaatatctacagatgagacgtcgggaaaatctgccaactgtttttccaaccatgccatattgaagtactcacgccccgtactcttcggtgcaatacgtgcaaagtaaggatcagaaatcattttttggagcaagcgttgattgactattccttcattcgcccactgagcatccttatcataaggtaactgcttatgccgccatatccatgcatccatcagcatattccctggcccagtatcatatcctttaacagcagaatctggcagaagtgcggagatatttgcgatcccgccaatattcagaataatgcgtctttctgttggatgcccgagaaccgccatatgaaatgcgggtactaaaggtgcgccctgaccaccataagccatatcacgccgcctgaaatcgcccacagtagtaatattggtcaatgcagcgacacgattattatcaccgatttgcatagtaaagggtttttcgccgtctggttcatgccatactgtctgcccatgacagccaactgctgtaatgtcgcttgcggttagcccagctttattcatcaggccttttactgcttcggaaaaaagtgttccaagttcatagtcaaactggccgaccatagataatgtcgtctgttgaccttgacagatggaaagcaatttttgcttaagctcttgtggaaatgggtgagaataactcacttgctgtgcaacaatcttatcgctaatctccgccagaacaacatcaactccatccatgctagtaccagacatgacaccgatataacgtcctgacttcataaatactcccctatttaaagagtggattacatttcgttcgtagattacatttaatcttacataaactatgaaacacatctatttggactatatatgtttagcagtcaatatcagagataaaatctgagttttggagagtccttcacaaaacatgctaaacttttggtcaggaattattcctttaggagttcgtcttcagtatttattatttatcgagaaatgcgctgttagtgtatcggcaattagtcgccagactgtcgctggcaatagtagcctaatgcttggttgtaggtttattatcaggctttcccattgggcattaaaattaggagtaactatgttcaaacgtttcctggttggtgcagttgtagtaacaacattgtctggttgcgcagacatgggagcactttctagtgatacctactctattgatcaagccaaacaagttcaaaacgtaacctacggcactattctgtctgtacgtcctgtgtatattaaaggtgctcaggctggtaaccaaaatatgctgggtttgattggtggtgctgttttaggagggttattgggtaacacagtcggtgatggtacaggccaaagacttgctacagccgcaggtgctattgctggtgggatggctggccaggggattgaaggggccatcaataaaacgaaaggtgtcgaattagatattcgcactgatagcggaaggaatatcgtcgtagtacagaaacaggatcaagtcgtcttcagcaaaggccaacgtgtcaagatcgctgacggtggaaattcgactacagtatcgccactctgacattattagttcacgtacaatcaaaccaaaaaaatcgcggcttgccagtatctactggaccgcgattttctctttatcggttaatttttatattacctgtttatgcaattggctaatattcttctcaatcttttttattacagaagcaagcagaattaactcatcatgagtaattccctccaagatatctttccttgtagagccaataacactgtcaacttctctgataaaagtttccgattcctcggttaatttgattcttttcgcacgcctgtcattagcacatgtgtgacgtgtaatcagttgcttttcttctaattgatccagagtcctcaccaaagagggttgttcgataccaatagctttcgcaagttgtatctgtgactgctctggtggtaactgactaatattgtatagagtaacccaatgtgtctgagttaatttcaacggtttcaaacgatgatcaattaaagcgcgccaaacacgaactaaacgtgctaggtctgatcccaatgtcaattccaattacccctccttataattagagactcatataacatcaatgaattatccaatcagtttattcatatgaataatggatacgcacctatatcatgcttacattagcagagtcaggaatttcgctaattacctaattagtgtcgcgttggcttgttactcaaagttgacatcttcgtcgccctaaagagcgaagttttacggcgcaccgaataaaatcgcgcattaatccaccaacgatataaactgtataaaataatcctctagctaaactattgtaattttaaatatcaaaaaaataaatacaaaccctaaaaatagatacagttccactcggttaaagttctataagaataaccgccatccaaatactaatctatatatttttacattaatatcatttttctcttacaacgatagttcatattataataaataacattaaaaacaataagatagaaaataagctcttttattgttcaataagtaatactttgataagaaaattttatcgaaacacggtaattagtcaacatgaacgatatttaaaaatgacctatgttaaataaaaagcgtgtaatataaattatacatcatttaatactagtaatatttcttatttttaaggtaataataaactattattcatgtaagtgttttttttaaacaaatcagtgaaaaatcaaaataattcaggttaattcaggttaatatcgtattttttccttaattctttaaattatttagatgactttaataacataacctaaatatttctattttttgtctatcggataatttcatccacataaaccacccttctctgctccgataacatcctcggcaaaaaccacgggaatcagattcacaaccccctttgcaaggggttggaatagcgaaaaactctaattgttcagccatctaatcctcctgtatctagacctaccaagcacttaccctgtgagaattgacatactgacgcaggataagaacaattgtgataatttaaaattaaatagtaatagtatgaaataatatatgaaagttgaaaggacaaattgaattattttatctatacaagttatagttatagctaaccacacatatgtagttaatgagcgaaatttcgccataatattatcccaaataaggactttcctaaataaggatatttcgcaataaaattataaagttcaagaggtaattatgcgtttactccataccatgatccgtgttggcaacatgcagcgctcgattgatttctatactcaagtgatgggtatgcgtctacttcgcaccagcgaaaatccagagtataaatattccctcgcttttgtcggttataccgatgaaagccaaggtgcagtcattgagttaacctataattgggatgttgaaagctacgaaatgggaaccgcatttgggcatattgccttgggtgtggacgatgttgcggcaacttgtgagcgcatcaagctctctggtggaaatgtgactcgcgaggctggacctgtcaaaggcggaacaacagtcatcgcgtttgttgaagatcccgatggctataaaatcgaattaatcgaaaaccaaagcggcagtagtgcattaggaaattaactatttctacatgcaaagggcattccccatgcccttcatttctaaattggataggcattacttctgcaatacatgccaaattttgtcataatatccactatcatgaagttaagaactgaatcagatgtctaataaaaaagatcaaaacatgctaagtggacgttttcgtggctactatcctgttgtcattgatgtagaaaccggtggttttaatgcacagacagatgctttacttgaaatcgcagcaattactttaaagatggatgaagagggttggctgatgccagctgacacactgcattttcatattgacccctttgaaggcgctaaccttgacccagcagcgctggcattcacagggattgatccgaccaatccattgcggggagcagtcagtgaatacaccgcattacatgccattttcaaaatgatccgcaaaggtatgaaagacaataattgcaaccgcgcgattatagtcgcccataatgccagttttgatcacaactttgtcatggcagcagcagagcgttctggtttgaaacgtaacccatttcaccctttcgccacttttgataccgcagctctgagtggtttggtgctcggccaaacaatcctggccaaagcctgtatcacagcggaaataccatttgacagcaatcaggctcatagcgcgctgtatgatacagaccggactgccctgctgttctgtgaactcgttaaccgctggaaacgactaggcggctggccattaccttccccaaataacgaatcctgataaatcaagccccatacctactgaagatgtatggggctttaaccattattcaccaaaatgataaattattcgctatcgcagcctgcctgttcacggtacttgtcagcagtatctttgatcaacgcttgtaattcaccactctgatacatttcaatgagaatgtcacaaccacctaccaactcaccatctacccaaagctgaggaaatgtcggccagtttgcatatttaggcaattctgcacggatatcaggattttgcaggatatctacgtaagcaaaacgttcaccacaggcagacagcgcctgaaccgcctgagcagagaaaccacagtttggcagctttggggaacctttcatgtacagcaagattggattttctttgatctggcgttctatttttccaatagtcgttgtttcttcaaccgggcgttcgtttttctcaatactcatcatttttacttccttaaaccacaagcgctgtttatcagcatcagaaaagattgattcagaataccactttctaccgcgaattttctaccgcgaactttcttatgtaacttttatgttgcaatctgctatagatggctatgtgatgctttcatcccctgtgatcgtttacaatcagtactacagttcagttccactccaaatcgcagttaagtcgtatctttttccctgttatttagctgaaaagttgttaagataattatcaaaatagcaacatgataataagcttgaatttgctctgcccatggttgtcaccttgttaaccatggcttgtagagccaaaaacccgatattaaaaaggagcatgcaatgtcttttgaattaccagcattaccttatgccaaaaatgccctggaaccacacatttcagccgaaactctggaatatcattacggcaaacatcataacgcctacgttgtgaacctgaacaatctggttaaagataccgaatttgccggaaaatcactggaagaaatcatcaaaacatccgaaggcggcatcttcaataacgcagcacaagtctggaatcacactttctactggaatagcctgtcaccaaacgggggtggtgaaccaactggaaaagttgcagacgctattaacagtgctttcggctcttttactgagttcaaacagcagtttactgatgctgcactgaaaaattttggttcgggttggacatggctggtcaagaaagctgatggtagcgtggctatcgtcaatacttccaatgccgcaactccattgactggtaaagataaacctgtactgacagttgatgtttgggaacacgcatattacatcgattaccgtaatgcgcgccctcaatatctggagcatttctgggctctggtcaactggaaatttgttgaagaaaatctggcttaagttttctgagataaacgctcaagccagtttgaaatagcaagggtagactttcccaattccataagtcttggatagcgaaagtttacccttaaaacaaaagcaggcgacgctgcccttcaattttttctagaccaggcaaagacttgctagagtaacaatcattactaatgcgctactggcagtcaataatcccaacttcaaatctatatccataaaaccctcaatgtgaaaactaaggccccgcaataccataaactttaaatggttattcaccctattacataaaaagcatcatttgacatttagtgcatatactttatagcatcgattattgctttcacttttgagctagatcagacaaaattcaaggtttaccgctaaattattgccagccttcatcctatataaatatactggcaaacgattaacaaagatctataaatttagaccataaggtcaggagtcttttttatcatggcaacgattaaagatgtggctaaacgcgctggtgtttcgaccacaaccgtatcccatgttatcaataaaacccgtttcgtcgccgaagatacaaaaatcgcagtttgggctgccataaaagaattaaactattctcccagcgccgttgctcgtagtttgaaggttaaccacaccaaatccatcggattactggcaacttcaagtgaggcaccttattttgccgaaatcatagaatccgttgaaaatagttgctatagcaaaggctatacgttgattttgtgcaattctcacaacaatctcgacaagcagaaagcttatctcgcaatgctcgctcaaaagcgtgtggatggtttactggtaatgtgttcagaatatcctgaacaacttttgggtatgctagaagattatcgcaatattcccatggtggtcatggactggggtgaatctagaggagatttcaccgatgcgattatcgataacgctttccatggtggttatttggccggccgctatcttattgaacgcggtcaccgtgatattgcttccattcctggaccattagcaagaaatacaggtggcgggcgtcatcaaggttttctcaaggcactgaaagaggcaaatattgacattcggaatgaatggattgtgcagggcgattttgagcctgaatctggctatcaagctatgtatcagatcctgaatcagaaacatcgccccacagccgttttctgtggtggcgatgtgatggcaatgggtgcaatctgtgcagccgatgagctaggtttacgtgtccctcaagatatttccatcattggttatgacaatattcgcaatgcacgctacttcacgccagcgctgacaaccatccaccagcccaaagaacgcttgggacagatggccttctcgatgttactggacaggatcatcaataaacgtgaaaatgtacaaactatcgaagtgcatccgcgtcttgttgagcgtcgatctgttacagatgggcctttcatcgattatcgccgttgacgatcagtcctcctgcaaccattcagcattaagtgtttcactatctccaagataatcaagcaaccagcttaatgctggtgaatggcttttttgcgaccatgccaagcaacatgggctatcaggcaatggttgttcaagctcaagtgcgatcaattttccgcggcggataagtggtaatgcacgatgcttgggcaccattcctacacatagaccatccatcaggcaagccaacccaatatcccaatcaggcacaatcaatcgccgttgattatccaaagcccatgtatcacgcttgggcaggctgcgagaagtatcttccaggcataaactggaataagctcgcatctggtcgtcatgcaatttttctgctatcgaaaccagttcatgtgcagggctagcaacgcataaccacggcataaaccccatatccctgaaactgtatcgttctccgaccggagaagcgcgggtggcaccaatggcgacatcaacccgtccatctaccagtgcatcccacacaccattaaaaacttcaggatagataagcaactcaatatctggaaaatgccggtaaaaatccagaataagttggagcgttcgttcaggttttacaacttgatcaacggcaatgctgaactgccctctccaaccattagccacctgctgacattgatggcgagtgtgatgcatttttttgataacagaacgagcttctttaacaaaaatacctcccgcttccgttaattctacatcacggtgacgacgctcaaataaaggtacagccaaccattcttcgagttgttttaccgtatagctgatagcagaagggacacgatgaagttctgatgcagctgcactgaaacttcctgttctggctacagcatcaacaacttccagcgagtattcagaccacatatttattcctttcaatttttttcataacatgatgcaaatattaccgtttcacaagtaaaaatcatgccatatagaataagccttgtatcttcttatcaattaccacaccaagttattaacacaatgacaacaaataaaaattccatttcattcatgttttatctcgctggcctgagtatgctcggctatttggctattgatatgtatctacctgcttttggagtaatgaaaacagagttaaatacatcagaaagtgctatcagtgcgagtctcagcatttttcttggcggttttgcctttgctcagttgttatgggggcaactgtctgaccgattaggaagaaagcctgttcttattatcggcttatctctgttttccattagctgtctaggtatgctctggataactgattccactcaactgcttgtattgagatttcttcaagcggttggagtctgctctgcggcagtttgctggcaggctttagttgtcgatcggtatgatcctgaacgtactaaacgtgtttttgccatgataatgcctctggttgccctttcccctgcactcgctcctttggtcggtgcatggctattgtcacacgttggctggaaaatcattttccttgtcttgatggctgtaacacttttactgctgatacccacatttttcctgaccaataaacacaaagctatcgataccgactctgataaaaagggagtttctttctttaccttattgaaatccccaatattcagtggaaatgtactaatttatgctgcttgcagtgctggtttttttgcttggctaactggctcaccaacaattctggccgatatgggttatgatcctacagatatcggcttgagttatattcctcagactctggcatttatggtcggtggatatggttgccgtattcttttggaaaaaaccaaaagtgagacggtatttccattcttactggcaggttatgccgtcagcatggtgatcatttatttaatttcccaattctatgaaccttcatttatggctattctcatccctttctgctttatggcagcaatgaatggtgcttcttatcctattgctgtagcaaatgcactctctgtttaccctaaaaacagtgggaaggcagcagcattgcagaatgccctgcaattagggttctgttttgtcgcaagcctgatagtctctgtattcatgaaaaaccctcttttatctaccacaacagtgatggtttctactgttgctctgatggcaatagggtattggttgcaaaagcaaaaatatgacaagaaagattaaacatgaatttaataatcacgccaaaaaataataattaagaacattctcatctaaaggttgcgtcataaatgtgacctttagatgattgtttaaatattatttcactcatatactcatacaggttcattattataaaaacttggaatttgaggcttgtaagggcaatgaagctctgtttgctttcaggatgaatgagtatatatgtttttacttaatgttctatattatttccgaataaaacctttttggttttaacataataagtaatcagccacaaagagatacctcaaaattcccttgtataaatattggagagtatatgagttcatcttgcattgaagataaaaaaataattactgatccgtggcatagaatcgccagtgagttgcttcaagaagctgatattgagatcaacggcaagcgccctttcgatatacatgtcaaaaatccaaatttttataaaagagtgttaaaagaaggctcccttgggctgggtgaaagctatatggatggctggtgggattgtgaacgtttggatgtattctttcataaaatactgcgagctggtctggagtaccgcattcccaaaaatgccaaggatattctgaaaatcattaccgctcgcatatttaacctacaatcacccaaaagagcctgggttgtaggggaagaacactatgatttaggtaacgatctttttactcgcatgctcgaccctcacatgcagtactcatgtggttactggaaagattcaaacacactagaagaagcccaaaccagtaaactccgcctgatttgcgaaaaactacaattatcttcaggtatgacactattggatatcggatgtggatggggtggtctggctgcctatgccgcaaaaaactatggtgtatccgtcactggcgttactatttccgcagagcaacagaaatatgctcaggaacgctgtaaggatatggatgtgaaagtcatccttgaagattatcgcaatttgaactttcagtttgataggattgtctctgtcggtatgtttgaacacgttggccctaaaaattatgctagttatttcaatatcgtgcgcaaaaatctgaagcctgatggcctgttcctgcttcatactatcggctctaatcgtgataaattgaacgtcgattcatgggtgaacaagtatatttttcccaatggttgcctaccttcggttgcaaagatagccaaagccagtaatggaaaattagtcatggaagactggcacaactttggggcggattatgaccgtacgttgatgtcatggtatgaacatttcaccgcaagctggagcgagatagaacataattacagcccacgctttaaacggatgttcagttattacttaaatgcttgtgcaggtgcattccgtgccagagacattcaactgtggcaaattatgtttagtccacgaggaattgaaaacggcctgagagttcctcggtaagatgttaacctaaaaaggttgtacaaaaagctacagaaccatatttctgtagctttcccctgtaatgagaaatgtttttttattcttcttcttccgtctgtgacaatactttttcttgttctttctgcgccataacccgttcaacggtatctacgattgcctgtgtctgtgggtcaatctcaatattgactttctgcccaaggcgttttttacccagtgtcgtacgtcccagtgtttcggggatcaagtgaacacagaatcggttattcacaacatctccaatcgtcagactaatcccatcaataccaataaatcctttgtgcagaatatatttcatcaactgcttatcatgaatgcggaaccaaatttcatggttattttctgaagtgaaaattttggcaatttcagccatcgtaataacatgaccggacatcagatgcccgccaatttcatcaccaaattttgctgctctttccaggttaactaagtcacctacgttaagatcaccgagattagtcaagcgcagcgtctctttcatcaaatcaaaactaatcagattgctatcgatattggtcactgtcaggcaacaaccattgtgggaaacggaggctcccgtttcaattccgggtaataattcagccggaaacttaacaatatgagttcgaaaatgcgctttttcatcaatcgcaactatcggcgcttttccctgaatgatgcctgtaaacatgggaacctctttcgtcatttgcataaatgaattagtttaacccacccatcatttttaaacactatttcgataagtacgcgctctcattgagtattagtatcgcgcagcgattggcttagtaaaacgagtcctatacaatatccgcgttaataagcgattaatttttcaataaaatcgtttacccgtagaaatattctttgtttttctaattaattttcaatcaaaaaaggtgtagtacgtgcagaaatacttaaatgaagcgcgtagtttgctcgctctggggatcccaatcatcatcgcacaattttcacaaactgcgatgggtttcgtcgatacagtcatggctggtaaagcgggtgctgtcgaaatgtctgcagttgccgtcggtacgtcaatctggttaccaactattttatttggtcagggtttactgatggccctaacgccgattgtggcacacatgaacggttctggtcagcgaaaaaatgtggcagttcagatccaacaaggcttctggctggcaacttttctctctattttagttatagctgttttgtataactgccgattcattatagaggcacaacacaatgttgatcctgtgttggcacaaaaagcaataaactttatccatgccattatgtggggtgctcctggctatctgttctatcagaccctacgcgggcagtgtgaaggattgtcgaaaaccaaacccgcaatgattatcggcattgtgggattactggttaacattcctgtcaattatattttcatttacggtaaatttggcgcaccagaattaggcggtgtgggctgtggtgttgcgacggccacggtctattgggtcatgttcctgttactacttgcgtatgtaaaacacacgccttcacagaaagatatccatacgttcgataattttaccggccctaattggcgtacacaaaaacatattgtgttacttggcttacctatcgcactggccctgttctttgaagtcacactttttgctgttgtttctctgttggtatctcctctcggagtcgctgccgttgctggacatcagatcgcactcaatttcagttccatgatgtttatgtttcccctgtcatttgggatcgcagcaaccatccgcgtgggctataaccttggaaaaaaatcgactgaaggtgccaaaatttcagcttacacaagtcttgctgtcggtttgatgatagcctgtatgaccgcggcttttacaactttgttccgcgaaccgatcgcacttatgtataacgataactatgaagttgtcactcttgcatcccatttgatgctgtttgcagccatttatcagatttctgattcagttcaggttattggttccggtgtattgcgaggatataaagatacgcgttccgtcttctttatcacctttattgcttattggatcttaggactacctagtggttacattctggcgctaacccattatgtcactgaaccaatggggccacagggtttctggattgggtttattatcggcttaaccgcagccgcggtcatggtaggtctccgaattttgtggttacaaaagcaaccaactcactttgttctggaacgctctgctcattaatttagtctattaggtcggaaaacaagaggaaaagccgcaaattcactccaaaaggtgtaaatacgagcaatcgaataagaattcgcgtttttcctcttgccagaaggccacgtgatcgttaatattcttccccgttgtcagccacagaaatgtagattgcgtccgtagctcagttggttagagcaccaccttgacatggtgggggtcggtggttcgagtccactcggacgcaccatatatctgtctgacatagaaaattttatgtgcgtccgtagctcagttggttagagcaccaccttgacatggtgggggtcggtggttcgagtccactcggacgcaccatctataggatagtatcctaagttcctttctagccatttttttatttcacactttgctgaactctacttccctaccatatacttaatgttacccaacctatcgtgcgatactaacaattcaattctatcccgtttgcgcaacaactctctgatttccttaacatgagccagaatatttttcgctttttactcataaatatcttcaagaatcatttttttgattcatttcacagaaattagcctctataatacgctcctgtcataagttgaatggtttcagccaattgatttaccgaattcagaaaaaattaccgatgcttaatcgattcaagtccacatatctacacatgcctgacttcacgcaaaaaaaaccatttgacactttctgccatccgttttccgttatgttgcgcaacttacaaagccagatgatgctggcataaatgtcaatggttggtgattcattcttttaatccattaaaaccagtagatagattgtcatgaaaaaaaccaaaattgtttgtactatcgggccaaaaacagaatccgaaacaaaactgaccgaattgcttaatgcaggcatgaatgtcatgcgcctaaatttttctcacggtgactacgaagaacatggccaacgtattaaaaaccttcgtgcagtcactgcgaaaacaggcaaaaaagcagctatcctactggataccaaaggccctgaaattcgtaccataaagctggaaggtggtaatgatgtctctctcactgcgggtcagactttcacttttacaactgataaatcggttgttggtaatcaagaatgtgtcgccgtcacttatgctggtctgccagcagacctgaaaccgggtaataccattttggttgatgatggtttgatcgccatgacagtaaaaaacatcaccgagactgaagtcatctgtgaggtattgaacaacggtgatttaggcgaaaacaaaggcgtcaatctgccaaatgtcgccatcaacttgcctgcactggcagaaaaagataaacaggatcttattttcggttgcgagcaaggtgttgatttcgtcgcagcatctttcatccgtaagcgttctgatgtactggaaatccgtgatcacctgaaagctcacggtggagagcacatccaaatcatctccaaaattgaaaatcaggaaggcctgaataattttgatgaaattatggaagcttcagacggtatcatggttgcccgtggtgatttgggtgttgagatcccagtagaagaagttatcttcgctcagaagatgatgatcgaaaaatgtaatgcagcacgcaaagttgtcatcactgcaacccaaatgctggattccatgatcaaaaatccacgccctacccgcgctgaagcaggtgacgttgccaatgctatcttggatggcactgatgccgtgatgctttccggtgaaagtgcaaaagggaaataccctatcgaagcggtttctatcatggcaaccatctgtgaacgtacagatcgcatcatgaacagcagaattgaaaatatcaaaacccagaagctgcgcgttactgaagcaatctgccgtggtgcagttgaaattgcagaaaaactggaagcccccctgattgtcgttgcaacctatggtggaaaatctgcaagatctatccgtaaatatttccctaacgcgcctattctcgctctgactaccaatgaaatcactgcccgacaattgctgttggtcaaaggtgtttccacacaaattgtcaaagaaatcgcctctaccgatgatttctatcggattggtaaagaagcagcactggcaagtggtatcgccaataaaggtgatgccgttgtaatgatatctggtgcgttagtaccaagtggtacaacaaatacttcttcagtccacgttctataaatttgcaccacgcccaatcctgaataagctgcccagacattgggcagtcttgttagcgatgttaataactataaaaagatccaagtttggtttatatccaaatggatctttttatatttctatgccatatcgttatcattataaactttataaaagttatacaattacagtgagcaaatttatctacaggttccagtacaaaaacatttactgtttttatttatttgtatttagagtaaatattcactatatggcgaatccaagataactaaatagactatgttgacagttaccgaccttctctatttattagtctaaaacatcgaaaatggaatgcatatcacgtaattattgatgattgttctgatgaaatcactgaataaaccactaatttattgcagttatctaaaaattattggcttactttacgattaaagaacagtagaatttttttcagtagcaaaattttattctctttctaaaaaagtttgtgtaatacttaggtagctacttggagattaatttaatctagagggtattgtaatgaatcgtactaaagttatatttggtgcagtaattttggcttccactctgttagcaggttgttcaaacgcgactaaagttgaacaacttgccactcaggttaacactctgggttctaaagttgaccaattgagaaatgacctcagcgctgttcactctgatgttcagtcagccaaagaggaagcagctcgtgcgaataagcgccttgataatcaagtgcgttcctacaagaagtaatcttgcagcagataacaaaaatggcgtaccaagtaaggtacgccatttttatattcgcccatccatttgttcttctcagaaatcaattaccaatccccctatctcaagtcaggataagggttcagtctgataaatgggactaggctgatttaatggcggtaatttaactgggctaacactgtgaatggcttcttcgtgagtctcaatcggccttgaaacttcttgctcttcctgattagataaagcaatacctttatttacccgcacaggtattcctgaacgtcgaatgatcgcctgatcaacaagaacagcgtctgtttcacgattatcaataaattttatcaacccttttgtgcgctgaatcggcctagtctgagggtcatcggcctgtttatctgaaagtggctgatgaatttccacgtaacgtttccccgttggctccactgtatatttgattggttcattaattacctgaacacgggttcctcgtggaacgctataaaacaaattttcaatatcatcgggacgcaaacgaatacagcccgaactgacacgcatgccaataccaaaatttgcattcgtaccatgaatcaaatattctccacggccagcagccaaacgcaaggcaaaatcccccatcggattatccgctccggcaggtactaccgttggcaaaataatccctcggctcgcataatctttccgaatattggtagttggtgtccatgttggatttttaatcaattggctgacagacgttgtcatcgtcggtgtatcacgttcaagctgaccgatcccaatgggatagacgacaacatagtttttccctttggggaaataatagagcctaaattctgccagattaatgataataccttgacgaagagtatcgggaagcagcatctgtgatggaataatcagcttagcgcctagtttcggcagataaggatcaacgccaggattagcctccagcatggccagcaaacctatttggtatttggcggcaatggcttccagcgaaagggcatcatcagatagggaccgagctcgaatcgtatcg

SEQ ID NO: 14956 - DNA, 39062 bp, Xenorhabdus bovienii
  Genomic contig Name=Xb4151_4152.C415
gagaaaggaaaagggttattaagtattttgccactgtctaatgatgagtgggtgactccctgtgtagccttactagatatctccgattaagattgtgatgctcaatgtgctgtgtatagcgctttatagtggccaaaatattcaggtaatatttaaatcatcttccccttgcaacagtaaaaatgtggttaattactcatcagcattacaagagaatttcttttatgaatactcatattcttagaagaatcatctttaaaactgaggctaacaagtaaattaattgccgatgctataaatattaatccgccttgtattatcctattaaaagatgttatccttattagtaaaataattaatgcaattaatattattaatttagttaattatattaatttggagtaaataaatggtttcgaataaaaataaaaaaagtttaattacggctggttaaaagatttatttttagagtgtcccgaagagtctttctggattattgttagtgcaatggtaattttagttttattcccaatctggttttgcgaagactgattattgatgacatgaacggcttatcgacctgatggaatcctgacataaaaaatggctctctgaagccgtgcggttttttaggcttatcaggtgcggaactcatcgaggcgcgggcatccctgcccatagtgacgccggatagatttaagcaagccaacatcaatcaaaaatcagtgttgcaaaaaaggtggggaccatagattttttatttcagaggcgaacaatgacattgcatattatcgagggcgccaaaggcggcggcggcggcgggggcggcggacatacaccttatgaaatgcccgataacattcaatcgacggccacggctaaaattctggtggccttgggtgagggtgagttcgtcaatgatctgacggcaaaagatatctatctggacggcacacccttgcagaacgacaacggaaccattaattttgcaggcgtgaaatgggaatttcgccccggtacccagcatcagaactatatcaaaggcatgagcgcggctgaaaatgaaatccgtctgggtacagaaataaaaaccgctgtgccctggacaaaatacatttccaacaccaagttatcggccgtccgtgtccgtctcggctggcctgcgttgagaatgcaaaaagaaaatggtgacacggtgggctttcgcgttgattatgccattgaattgtccaccgatggcggcagctatcaggctgtgtttgatacccatattgatgccaaaacaaccaccctgtatgaacgctcataccgcattaatctgcctgatgccaaaacgggctggacggttcgtgttgtcagaaaaacgccagacagcaccagtgagcggatcaacgacaaaatgaatatcatggcgttcactgagattgttgacgccaaattacgctacccgaataccgcgctgctgtacgttgaatttgacgcccggttattcaatggcaataccccgctgatttcatgtaagcccaaggggcgcattattcgcgtacccgccaattacgacccggttaaccgcacgtacagtggcatctggaacttaaccttcaaatgggcgcacagtaataacccggcgtgggtgctgtacgatatactgctaaacgatttatgcggccttggcgacaaaatcgaccgcacgcaaattgatgaaatcgaactgtatcgcgtggcgcagtattgcgatcaattggtccctgatggcaaaggcggtggtggcatggagccgcgctttacctgcgatgtttacatacaatcacgcgaagaggcacataaagtgctgaccgatattggcgccatattccggggttcagtccactggggagctaatcagttcgtggcagcggcggatatgccggatgacattaaatatattttcactcaggccagcgttatcaatggcgactttgtctacagcggcggcggcgagcgtaaccgcagcacggttgccatggtgagctggtcaaatccaaacaatcattacaatgatgaagttgaagttgtttcagacgataatttaatccgacgttatggtatcaaccagattgatatttccgctattggctgcacccgtcagagtgaggcgcaacgccggggaaaatgggcaatcctgaccaactcacgcgatggcatgatttcatttcgtgtagggctggatggtcaaatcccgatgcccggtcatattattggcgtggcacataaaaaccgagccgggcgcactatcggtggtcgcattcagtcggtgaacgatcgcaatatcacactggacagaaaacctgatgtgaaggcgggtgatcgtctattggttaatttaccgacaggaaaatcagaaggccggacggttcaggccgtcaatggtaacattgttaccgtaacgacgacttatagtgaatcacctgtatccggtgctggctgggcggtggatgcccatgatttatttattcagcaatatcgcgttgtcggcatcaaagataacaatgatggcacattcgaaatcaatggcctttaccacgatcccgacaaatacgaccgtatcgacacgggtgccagaatcgacgaacggcctatttccattattccggcgagcgtccagcagccaccgaattcaatcaggattgagagtttttcgtttgttcagcaaggcatttccaccactaccgtgcggattgcatgggagaaagcggaaggggcggcggcctatgtgggagagtggcgccgggatagcgggaactggatttccattccccgtaccgcatcgctgggttttgaaatacctaatgcttactccggcagatatcaggcccgcatcaaggccatcaactcctttgatattcccagcttatttatctcctctgaagaggtcaatatcgttggaaaacaaggtaaccctccggcaccgctggggttcagaacaaccccgatcatcttcggtatccagattgactggggttttgcgccccagaccgacgacacgctgaaaactgaaatccagtacagcaggacgaatgacggcgagggtttactgttgctggccgatattccctatccccagcgaatgcacacaatgcagggactggcggcaggcgttgcattttatttccgtgcgcgtctggtggacaagtccggcaatcaatccccgtggacggcgttcgtcaggggagaatcgtcttcggatacgaattggatcattgatgcagcaggcaaccagttcctgaccgccgaagccgggaaacgattacaggagcaaatggattatcagtcggagtccatcctcatcaacggtacagctattcagcaaaatagccgcgaattactcacccgtgatggtgagaacaaagcggaaatcaaacgactcgatcgtgtattcgctgatgaaaaaaccgcatgggcacaatccattaaggaagtaaaatccagcgtcggggaaaaccgttctgctgttcaggaaaaccagaaatccattaacaaactggattcatcattagctgagagcgagcagcgtgttcaggctcaattcaaacatcaatcggccctcattgataccaaggcaaccactgtttttgaccatataggcggttctgcgacgtacacagtgagggcaggtattaaagacgctaatgggaattatcatagtgcggggatggttattggtgctcagatggtgaatggccaagtgagaacggatattggttttaatgccaataattttaccttcgtcaatcccgcaaatgacaaattcgaaccctttgtggcggctaaaaatggccagttgtttattcgggatggatttatagaagatggcagtattaccaatgccaaaattggcaattacatccagtctggaaattatattgctggccgggcagggtggaaaattgataaagggggtggggcagaattcaaccatgttactgttcgtggggagatacatgcaaccagcgggacgttcaccggaacaatcaatggcgctgatggccgtttttccggcgcagtatatgcaaccaaaattgtaggtgacgttgtgtctgttactttggggaatgtatcattaggcaaccgtgacagcattttttttcataaaaggctaacggaagctatgccgtttgatcgggtttttatttatggaccgataatgactcagcgttacgtcggatctttgggtggttcgggggaggcatccgtttcggtatacgttaataatgtgcatgtggctgggcaaaactttttcatggagtcttctgatcgcggcccgcagtgcatctctggtacgttgttttcaccccctataacaattcccgccaatacaacgccgaccattaaagttgttctcgtaacccacggcgcgggcattacataccctactcccggtattggtatgctgtttaaggctagtagtcagtggtctaacatgtaaatattaatttcattagctaaagtataccgcagtagcgcagcattttagattcaaagaaggtaaacacataagaatggcgatataaatcgccattctttttaatggaaatattgcagtactttgctccaccattttttatggtttatatctatgtcataagcactttcaaaatctccaacgactacaatataaaagtgtgtgtccaatatatcttgtgggtttttttctggtaatgtaggatttccttcaaaaaatgagtacatattcatcatcttaaaaggtgacgtttggcctatatatttatcctctttatcatataaaaccacaaaaataggctctttctccattatggttagataaatcccaaataaattaataggttccggcttgtaatatttggcgtaatagtcactttcaccagagttaacttcgctcagcgtgtcactttctttcaaaaaagtaacatgtgataaaaaaaaccaccataagaaaagtatgatcagcataaaatataaaatatactttgctgttttttttacaatcataaataaatcactctatcctttggcagcggagaaatccataaaacatctgaaaaaacaataaaatcccctcctttattgtgtttcttttgccattctctgaaatttctattatatacagggacgtgctttgaatattcccctgtcgctaactctctccacatattatcgttataaaaacccatgtatacagctgtttttactttacttaaaactccatccctgctccagaccccaaggaattcatcagggttaaaaaagtcatagctatcttttaagtaaatacccaatccctctgtaataaatacattttttgtttttattttatctgcatgccctctcaccgctaattttaatgttgctttacctatagcgccaaaataatcatcgatggtatccgtcaaagagccaatttctttatagtttacttgtgcatatgtatctaattcaattgctgaatcagaatatcctattttatttgaatttacgttaagtcttttttttaataattttattccattaggggatgcccatttctgtacaagttcctcggtagcttcttttacttgattgaaattcatagcccattccatttttacaatagaatcattgactctgtcttttggtatatctatggaatctatttcttttatatatctgactttttcttcttgagtaaactcaattttaggtctttcaaaccagtggcgcataattttaggtgccatttcccaacccattttttccattgagttaggaatttcatttaacatgaaaatatctacatttatatctgtaactgcgccacccttaacagtcttagctgaaaaaattgccataatcaaatccctatctttgtttgaaataaatattctacattgaggttttcttcttgttttgtgtcaaattgctttgtcacaccagatgtttgacagacaccttctaccggtcccttatttgttttcacgccatatgcgatatgttgacagttatcgccgttctgttgattttttagcttgaactgatggctaaacaaagctgtgatagtttccgctaaaggcagaatagacgaaaaccccgaaagcagcggcctttcctcttcacgcccctgcaattgcgaaatactatagcctgtcgttcccgctgcgagatggctacatgtaatggacttgtaatcaaggagcactgtttcagacggtatctggtcattgtcgtctatcgagtggggataatggcaggagaaatcaacaagggtggcactggtgagtttgacttcataaaagcgttccaactgtcccattgggctgattcggtagaacatgaaaacagcatccagtaattcgttaccgtctattgccattgctaacaggggggaggatttatcgatgggctttacaaaactgacagggtggtgattgatgttctggtcacgggtcatcatatgattcagacttaatacttgtatctgatcttcccgtcctgcctgataccggttcccgatagattcaggggttgaacaccctgccgaaattaaaccttgcttcttaccttttaacgacaaataaattaaatatgacatccgtagttacccttctagtttttcatttaaatcacctgagccagatcataaggcaggatacaacagtatggtttatgtattccagaatgaatgaaagtacagaataaaaattgtgattaacttctcctcctaaacaaaatcaggtaattgcctattttaaatttcatgttatacaacaagattattaacaaggtattttttacatatggttatttatagttaaacagggtgaaatatcattcataatcaatatggaaagataaacaacccatttaaataatatatattttgacatcccatcaatatctgatttgtaggtattgaatctatataaggggtgaaactccagatttatataacctactgattttacttaattaccgctcagagccggaattctggctctctggcagaaataaacaatatcaatgagttaagttaaaagggaggattgtcccctttaaatgctaagttttatcaatcagccataggcaaatagattttaataatgtcctgccagccattccgtgccatcctaatcagaagttctctccagtattgatgaacctattttattgatgttcacaggcggagaagtagcccgccttcatgttatttagcaatgtgtattgttgattaaatgagggaataactatgcaagataaaaattctgagacaaagggattagacgacagcagccttgtgactgttaccacaccggaatatgtcaaagattcaatcaaagaagcgatagaaaaacatgccctaagtcgcaaccatccagatgcaacgctacaagataaaggatttgttatcctgagtaatgatgtcggtagtgatagcgagactaacgcagcaacaccaaaagcaataaaaacagcatatgatttagccaatacagccaaccagaacgccaacaatgcaaatagcaataccaatacccgcttagcgaaagaccagaacggagctgatattcctgataaagacgattttgtaaacaatctcggattacgagatacagtcaatcaggcagaaaatgccttgcaaaaatcagctattgttcaacaaactggaatatctaatgatcttgtaatgagccagaatgtgacaactatgctgattagtgagcgcatcaaaaaagaagatgctgagttgttggcagttcccatcggtggcattttaatgtggggcagtgatctaccaccccccaataacttcctgccgatggagggcgggcaaattgaccctgataaatatcctgaattactcaaacactacccttcgggacatttaccagattggcggggttatgtgcctcgtggatgggataaaactggaggagttgactcggaggttgggagggcgctgggatcatttcaggctgacgctatcagagatatcacgggagtaattaggacaggtggccgtaaaacagatgagatctccgataatacaacgggagcattcaccaccatcgaccaaggtagaggaagtcacgtttactctgacgcgtttggggataatggctacgtttacgaggatcgagaatttcgtgcatctgccgttgtcccgacctcggttgaaaataggatgaaaaacgtggcagtgctatttttagtaaggggaaggtgatggttcagccaacagtccccgatattgcatggccggagcagccgacataatgacaggggcacgtagctcctgatagttattctggttcagctaattttctttgctgttgattccagataaaatcctccagcatatggacatggacatttaagcgacacctctctggaatatcacagggttcatcctcggcacagtaaatccttccaccgttccatgatggcttttacccgccagtactgaaaccattcaaacaaatgcacgtgctaaagtgattcactgagacaacacgaaattaagaattaatttcttatttatcaatgtgataataactattgacgaggtgaaaattaaaattgagacaacataaaatagaccgtgttgcctcaatttttaaatattaatcattataaaacaattggttaagtgggttgaggcaacagagacaactgagacaacactgtttgcttaacttatatattaatgagaaataaaattatcgttattcatgagaatcaatttgaaagtgatattaatgactgacgacgaatttcgtcggaagtgaatctataagagcgaaaaagcatctttaattttaacatactgatttttatgatggttgaaataccaaccatctttaagtgacatagatgactcagatttgagtcatgactaatcatctgattttattaatgaaccaaaaactggatcatctcaaggtgggatatcacatcttggtttatatatgcaggtgagggtatggggattttcaccataccttttgctcatgtgggattctcacaactgaaaattttttgcagttgatgcttttgtacatacgggattttccctcatgtaacttaatgactaacgacaaatctgacggcagagcaaagccctaattcgggatttggtggtaaaccattgatatttatccagaccccgaattcggggtctgcttataatttgagcaccgataatgtcggtatgcaaaacccaatatctgataatcggactttgtgcgtaactattagttactcgcaaatggcattaactggacgaatttgtccggaacgctaaggcagaatttgagcgtcagtcatactgactcacaaaatttgcacaacccattgagaggtgcacacaaaagagtgagctagaaacaaggggttaagtcgttttgtccagcacataaagtaatcattgggatttccgcaatggttgggtcaaagtgacggcctcggcaaaatcaatgagttaatcaaccatcacggaaatcgtaatagttgccattggtcattgctcccgtgagcgtggtacagatatggcgcagttattttgcgtttttttcgctgaggcgtgatttttgaataaattcgctaaatctctattgtgaaaatcacaacacaggagggcttgagtttaagtcgtccagtacaaggttacttaatataactgagtgactgagtacgtattacgttcgcagtgagtcattttcatataattgattgatttttatcatgatgaaaaaaccagatcacctaaaggctgtggaaaatagcacgaagacagaagaatgccccctcgatagtcaccacagttacagggaagattaccgttgcctccaagcgtataaagtgccagacaggtaacgttactatgtaaaagcgcagtgattacccattgagtgccattgctttgatgagatggcgctctcggtgatgctgttacagaaaggtcaggcgatcactgttatggggagatcttcttactggcagggctatcagttagctgtcagctcaatcactcaataggttccgacgaaattcgtcgcgaccctctatagctcggaacgttaaacgtactaatctctttttgttatcagcaagcatctctatgtgacaaaagtctctttaatcaagatcaataataacgaacaagataatgcgtatgtacaataacctattatttcattgtatgggttatgggtatgcgaaatcgtcaacaagcgcagttaattgcagagcagatactaaaagaagatattgttatattagatacagagacaacaggattaaaaagcgatgatgaaattattgaaataagcattataaacgctgatggtaatgttttactagatacacttattaagccccaaaaaaagatacctcctgatgcgacaagaatacacagaataacaaatgaagatgttcaacataagccattatggagtgatgtctataaaaaatacagagagatagttgaagggaaaacagttgtcatttataacaaatcttatgatactaaaataattagacaaacatgcaaaaaatatgaattgcctacgccaagaataaaatcagaatgcgcaatgttgttatacgctaagtatgaggggattataaataaaagaacatgtgaatataaatggcataaactgacagatgcaatttataaaaataatatccaagtcactggagaggctcaccgggcactcactgacgccagaatgaccctagaattgttaaagtttatggcttgcgcagaagtgaatgtatcaccaagagttcatatgaatgattctgttcattacaaaaaaaacaagccatcaaattcaatccaacctaccaagaaaaaatctaactttcagaaaattattttgaaattcttcgttgtagtgatcttttttctcatgctcaatatgatatggcctcttttttaaagtcgctataaggtcagaacggttagcgtactgacctatttcatctcactgaatacgaaattcgtcgtcagtcattagttcaggatgtttagtgtacaggtcttactacatccatttagcctgatcttcctttcaccctgttctcatcttatgatttgcttatagatttgttcagtaatctatgtataaatatttgtataaacaaattaaaaaataaaataaatatattaataaaattacttatttatcaatatattatcataatgcgataagtttctttttcatgtgtccattttaataccaacgctattaaaatgataaatactaaaagtattgaaaattttaatactttggatattattttgaggtagacaggagaaaacgtatggaaaaaattttattatcagaatatgtgaagaaaaatggccaagtgaaagctgcaagtctggtcggtgttcatcaaaccgctataagtaaggcgttgcgagcgggtcgtaaaatatttttgatccgtcaggaagatggcagttacaaagccgaagaatgccggccatttcccagtcagaaataggctgtatagaagaattaaaaaatatcaggagtatgattaatcggtatctattattgaacggacttaattatctcattgattttattctgatgttttttgtgtatattgttcaggagaagatatgagttctaacatttatcattattttagagcgatagggagtattcttgacattatgcccgcaaacgattatcgcgagatcttggattctgatttatcagatagaaattcctcggaaagtcaggtgatttcttgttgttctgaaccgcttccatcccctgatgtgttgaagaactatgagtcaatcctgtctggttgtgcagaaagaatattctctttcagagaacaagagcagcacttccggcatgataatcaaaaaaaggcacttgatagcatgatcacaaaggatagaagggggcagtggatgggattttccattgcgatgtttatcttaaccatagcgactgtttttgcgttcaagggtgaaatgttatttgcaggaacgctaattactattgatctggttgggctggcagccgtgtttgccatagggcgtaaatcaaacatcaaatgatcctgaaataacaacggaaattattcataaaacatgtaatgattttaattcacttattccagctctgagcattatatgatggcagaaaaggcgcgtttattggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccaaataacgtctcttttggacgggtctgcatcctcacatccatcatgatggtatgaagatgttcccccgccaaacgacgacgagttgaagaatctggtgcatccggcatagggaaatcgaccgcaggcaaaaccttgatggtaattttcggaaaccaatgcagtttcataatctctttcaggcgcccaaaaatactttgctctgcgccatcaatacggattgggaccacttttgcgcctgatttagccgcgacaaaagcagcaccatcatagatcttcatgaaagagccagttatcgtgatccgtccttctggaaaaataacgataggacgcccgttatcaacctctttaaccaacgttctgactgccataggattgttcggatctaaggggacaacatccgcataaggcttaatcaatctgagaaaagcgggggtcgcaagatgagaataaacggcgaatactggcttcactggcagaaaaagcccaatcagaagaccatctagaaaagaaatatgattgggtgtaataatacatttgggatggttgaactgcttatcatcaccttctaccgtgactctaaagagcacacgaacaactaatcgtataaattttatgagcatatccatatctcaatataattaaataaaattaaagtgagttagtaaaatgatactataattggtataagcagtctgagatataaaattttacgtctatataaaaaataagcacaaagatatttgaatatatcaaatcaccctattttttggtttaaaatatagccattaattaaagatgaaatattttctgtcgaagaattggcatccacaatgaaatttgcacattcacggtataattgctctctttcagtcaagatgctttcgatttcttctgtgatcgatttacctgtcagactggggcgctgtgtattttctgggttgagcgatagtcgtttgattaaaacttccgctggagcctgtaaataaaccacaataccattttgttgcatatactggcggttttcagacgacagtatcattccgcctcccgttgaaataacgcacttattctgactggcattttttagtatttgactttctaattccctgaaatgtgtccaaccatattgttcaacaaggtcagcaatagtcattccacaaaaggcttgaatactttcatcagtatcaataaacgtatacgatagtgcttcagccaacaacttacctattgtcgtcttcccagcacctcgtgcgcctacgatgaatagagtctgtttcatttcgttgttttcctgaaggtatatagttaagcttaaacacaagtgtagtaactaaatatttacatcaatataaaaaatacttttcatcaagcaaagagccacacttacgataaagtgtgacttaacatcgcttagtgaacgctatctaacaatgaatttcgatattagcgacgggatagataatcgccatagccaatccacttataagtcgtcaacgcatccagccccatcgggcctctggagtgtaacttctgggtactgacagcaacttctgcccccagaccaaactggccgccatcagtaaaccgagtacttgcattcacatacacggccgatgaatccacatgactgacaaaataatcagcctgttgcaagctctctgtcaggatagcatccgaatgagcagtaccatatgtgcggatatgactaatagcctgatcgataccactgacaatctcaacattcatatccagtgacagccattcatcacagtaatcttcttctattacttcaacgaccttggccggaccctctttcagcagtgccatcgcagatactcctgcatgcagtgtcaccccctgctctttcattctggcactcaatgctggcagaaaatcagacgcaatttgttcatgtatcagtaaagtttccaaggaattacaggcacttgggcgctgaacttttgcattggtgatcacatccagcgctttttcaacatcgacactttcgtctacgaatgtgtggcagacaccaatccccccggtgataactggaatagtcgattgttcacgacaaagtttatgcaaaccagccccgccacgcgggatcaacatatcaacatagctattcattttcagcaattcagcaactaactcacgatcgggtttaccgatggcctgaaccgcagtggcaggtaaaccactttgctccagcgcctgctgaataactttaaccatgacctgattggtatgatgagtttccttgccaccacgcaagataactgcatttccggttttcaggcacagtgaggctacatcaatcgtgacatttggacgagcttcataaatcacgccgataacgcccagaggaacacggcgacgactaagttgcagaccattgtccaatgattgcccatctagaatctgcccaaccggatcagccagacgacaaacctgacgcacatcattggcgatggcactcaatcgtccaggtgtcagcaataatcgatcaagcagtgcttcactcatgttttgttcacgagcctgttccatatcttgctgattagcggcaagaatcacttctgtttctttttcaagcaagtcagcaatatgactcagagcctgatttttctggctggtactcaattgagccagttgccatgatgctgctttagctgcttttcccatctgctctagcatggtggaatccttaactcactatcaattacgatcagttaactaacttacgatcatatcatcacggtgcacagcaaccgcgccatactcataacccagtatctggctgatttgctgtgaatgatggcctgcaatcaggcgtaaggcatcgctattgtaacgacatacaccgcgggctaactctttgccggacaagctgcggacacggatcacttcaccacgggaaaaattacctttgacgtttttaatcccttttggcagtaaagaactgcctttttcaaggatggcggcttctgctccgtgatcaacgatgatttcccctgcgggaggggcgccaaagatccagcgtttacgattttccatcgggcaggcctgaccatgaaaacgagtgccaactgatttgccttcaatgacatctgcaacaacttccggtctattacccgcagcaatgatgacatcgacccccgcacgccccgcaattcccgcagcctgaagtttcgtggccattccacctgtacccagacctgaaacgctatcccctgccatcatttttaactcatcactgatatcatgcacttcaggaataagcttcgcttcagggttattacgcggatcggcagtataaagcccttcgatatcagtcagaagcaacaatttatctgcactgcccagaatcgcagccagcgcagaaaggttatcgttgtcgccgactttgatctctgctgttgcaacggcatcgttctcattaatgatggggataatatgattatcaagtagtgcctgaagcgtatcccttgcattcagaaaacgttcacgatcttccagatccgcacgggtcagcaacatttgcccaacatgaataccataaatggaaaaaagttgttcccacaattgaatcaaccgactttgcccaacagccgccaacaattgttttgaagcaattgtagcaggcaaatctggatatcccagatgttcccgtcctgctgcaatcgcacccgaggtcacaatgataatacggtggcctttttcatgctgttgagcacattgccgaaccagttccacaatgtgagcacgattcaaacgacgagagccaccagtcagtacactcgttcccagtttcacaaccaatgtttggctgccattcatcatatttctgccattacagtaagtttgaaaaaacaatgctcagttttaacaggagaggagcgttatgccaaccgacataacgcaaaattaaaaaaaagcgggcttagaacaaactcatgccataatttgagtctgaagagcgatggtatttttggacgggatcaacgtcagtttgaaggtatcaaaagaatccgtcagacgtttgtgaaatgcctgcaaagttgactcaagatgctcaagatcagcaatttttttgatgcccatcgacttccattcaccatttttatcaaataggcctatttgatagttataaacaaaccctttttcgtcttcttctaattccagccaccatccccaaaactcccttttttctggaaccacctttgcactgacacaaacagctaggcagtcaaagaaaaaatagccattttggcattttaattcacgtatatacggtcctaatgcagaaaagctcttcaacaacttatttctagaataacttacgggtaaagccatacaaaggtctccttcatatacagaaacacggtttcattaaacggttttaaaatattattccctaaatttaggtttaggtggctttacctttcaaccatacacttgtttcatgtaacgccttattaaaaccactatagactggcgtagaaggaattgccaataacgaaccatccattgatgacattgcaataagttttgagtcttcccttgggctgaaaacgtcatctttccaataaacggaaagcattggcacagaacagcgacgtcccagcaatccttggtttttcagtgaataacagctcaattctaaacgtaaggcagcttcatcgacgtgatagatacccaaacgattagcaagcacatcgatgtacattgacggtatattctgctgtcgtttctcgtcattcagcaatgtatgaactatcggaccaataacggccacacccttaataagttgaggctccagataagcaagacgtactgcaatatttgcgccgaaacgaaatcccataacgcctacacgagtatgatcaatccacggaatttgattcaactgctgaagaacctgctgatggagtatgcacgtatcctgcgtcaatttgaatttggcagagtaaccaacagcaggcatatctactgtcaacatggcaaaaccgagtggagcaagatgatcacgaaacagtcgccagaagtcactctgcacattgtcaaggctggtacaaaccaatattgttgggcatggctcttgaacgttaggaggaagatgcaataagcctgtgacacttttgcccccttccaacttaaattccagttttttcaactcatagtcagaactgtgagccgcattttcataggatttactggccagcacagcggcctgctcagccagttcatcaccgcgcaaatgaggataagctgcaatgctatacagcatcgcagcctttagccaatatgtaccggcttcagatgtctgctccgcacgcaacgcctcccgttgccagtacatagcctgctgcgtccactcaaatgcccagtttcccttacgatagccgatcacagtatccaataaatggtcatcactgcgttcggcatctatcaccgcaatcctactgagaacatcctgaatttccagtggattgattcccctccagatccaagcaagccaatcaatcatccgataccagtgctcgcgacgctctccaccaagcatcctaccactggccgctgtggactgtgggcggatatattttaccagtgtagacgtttcctgctgtttaagctgaggcttgaacaacgactctgaaaggttttgtttagtcataacaaaagagaaatattacggcttattacaaataggtggaatgaacatcacacccatatcccatggttgttcgatccatgtatcttgcggaatatcgatcacataatcatccactaaaggacggccagccggtttagcgaaaatagtcacgaaatgcgctttaggatacatgttacgaattgcctgcgctgtacctccggtatcaaccaaatcatcgacaacgataaaaccttctccgtcaccttccgcttttttaacgactgtcaattcacgctgattatcatggtcatagctggaaatacagacagtatcgacatgacgaatccccagttcacgcgccagcaatgcacccggtacaagcccaccacggctaacggcaataatgcctttccattgttctacaggaagtaaacgttgtgctaatttacgggcatgcatttgcaacatatcccacgttacaacatatttttcgctcatatgatttgatcctggaaactaagaatgcctcagaaaagagttttttgcggaaaaaaaggttgcgcgggattatagtgatttggatcggcaaaaaccagtaaaaaacaagggaaatcctgatcctgactgcacatctcaaacaagaaaatgatatcctcgagcatggcatgggcattgggacagctcaagatgacaaaagcccccgatgcgtcagacattactatttccatctcatcaaaatgcagttacaggagattcgccgtgtccgcattatcaacattatcccctcaaccattatgggatatttttgcccagatttgttccatccctcatccgtcccatcacgaggaagcactcgcgttccatatcattgaatgggccaagagcaaaaattttcatgtcgaacgggatgaagccggtaatattctgctcagaaaaccagccacaaaaggtatggaaaaccgccagtcagtcgtgcttcaggctcaccttgatatggtgcctcagaaaaacaatgatacacaacacgacttcacaaaagatcctatccgtacttatattgatggtgactgggtaactgctgaaggtacaacactgggcgctgataacggcatcggtatggcttctgctctggcagtactggcagatgaatccgtcaaacacggcccactggaagttttactgactatgactgaagaatccggcatggatggcgcattcggactgcgatcaggctggttacaggctgatgttctgatcaataccgattcagaagaagaaggcgaaatttacatgggctgcgcaggcggcattaattttgtctcaaccctgctactttcccgcgaaacattgcctacgggttaccaaaccttgcaactgacgattaagggattaaaaggcggccattctggtggtgatattcatttgggattgggcaacgccaacaaattgctggcacgtttcctcgccgcacattcagatgaattgaatctaaaattgattgatttccaaggaggaactctgcgtaatgcgatccctcgcgaaggttctaccgtcattgcaattccgacaactcagctcgaaaaactgcaccaattgaaagatgactatctggatacgttgagaaacgaatatgcggtcgttgaagcaaatttgatcgtcctattggatgaaatcgaaacttcctcacaggcactcactacagattgccagactcgtttcctatccatgttgaataccatacctaatggtgttatccgtatgagcgatgttgctgaaggcgtagttgaaacttccctgaacgtaggcgttgtcactatggaagaagataaagtcgagattatctgcctgatccgttcattgatcgacagtggcaaggcttacgttgttgatatgctaaattctctggcaaaactggcagatgcagaaacagcaaccagtggcaactatccaggctggcagccagatgccaactcgccagtcatgcatttagttcgtgaaacctatcagcaattattcgacaagatccccaatattatggtgatccacgcaggtctggaatgtggtctgttcaaaaaaccgtatccggatatggacatggtttccattggcccaaccattcgtggcgcccattcgcctgatgaaaaagttcacatcaagagcgttggtcaatactggcagttgttaaccgctatcctaaaagcgatcccggttaaagagtaatatacgtgcctcccctgctcatcagccgtaggggagcttccctttcagcattaccagcccaatattaccactccagtaataattgccgttccaattgaggattctgtaacgtcacatgcagcccaaccaaccgcacgcccctcccttctctgcgaatttcccaagcctgttttgccacctgaatcagatccgatttatccaataatgggtgaatatgttcctgtgtcgtcaattgaaaatcatcaaattttaatttgataccctgacgggcaatgcggagatcaggttttaccttgcctaaacgtttttccaattctgggtaaagtttttcgatgagttcaacacaatcacgccactcatgaatatcctgtgccaatgttttttctacaccaacagacttacgtaagcgatcgggactgatttgccggtcatcaataccatgactgcgctcccaaagtgccagcccaaatttccccaattttttaatcaacgcaaccttgtcatagttttgtacatcagcacaagtctccaatcccatatcagatagacgcttggatgtgacttttcccactcctggaattttgcgtaatggcaatgacttgacgaatacctcaacctgttcaggggaaataacatattgcccgttaggtttattgatatcagacgcaatttttgccagaaatctgataggtgcaacgccagcagaggctgtcagttgcaattcatcaaaaatcacctgacggatctgttgggcgatcaacgtcgccgagccgtggcaatgttgacagtccgtcacatccaaataggcttcatccagtgaaagcggttcaatcagttcagtgtaacgggaaaaaatctggcggatatgctgagaaacttctttgtaggacgccattcgccccggtatgactttcaattgaggacaaagtttcaatgccattgcagtggacatagcactgcgtacgccaaaaaggcgggcaggataatttgccgtgctgatcacccctcgtctatcagcgctaccgccaacagcaatggggatatcgcggagtgatggattatcccgcatttcaatggcagcaaaaaagcagtccatatcaatatgaataattttgcgcatttcacctctgcatgcctctttccacaccaaaataactgtataaatatacagcttcatatcattgaaagctacttgctttttaagaattaattcctgctacaagttagcgctctatatgaagttttgtttatatttagccttgatgagatgaaatttttaatcgttgtgacaatttttatggtgtaaacgcgcgtcaatcagtattgggacaagtgcaataattgccagtaatgctcccactccagccacagaagataagccgtagcctgccccgattgcaaagccagccagcaagggggctaatgtaatcccgagctggaaagcggatacattagttgcacctgccagtgtcggcgcatttgcggcaatggtatagacccggttcatgacggcagggttaacaacgaaaccagacactccgagcagaaataccagacaagttgtgatcacgttttcagctaaaaaagtcaacgcaatagaagacacaatgataccaagagtgccaatcatcagcgtcttgaatggatatttgtctgctgtccgcccacctatagtcaatccgataaaagcaccgataccaaacagtgcaagcaccgcaggaacccaaaccaccgccagcttgctgatatcaatcaataatgcccccaaatagccgaatgtcgccatataagcggcggttgtcagcatagtagtggtataagctacccataatttcggttgtgccatggtttttaattccgtatctaataccggagcctctccctgacccggttgtatctccggcaacataaaccacaatgctattgccgtgactgatgttgctgcggcaaccgcccagaaaccggcacgccaccccgctatatcactaatcaccgttcctaatggcccgcccactaccatcgccagactcaatccgctgacaaccacggccaatgcccttgccgtgcgatcctgggttactaaattaactgctgtcgtcgcagcgactgcccaaaatccagcgtaagcgataccactgacaacgcgggcaatcaataacggccaataatcgggcgacaacatcccaatggcggtagcggcaacaaacagagcctgactcaacaataatgttgctcgtctgggccaacgcaatgttgctacagccagcgagggcgctccgaacagaacaccaacggcaaatgcagaaattaacatccccgcagagggtaacgagacttgcagatcctcagcaatttttggcagcacacctgcgattaaaaactctgaacttcccatcgcaaacagacttaagcccaagagatacacgctgatggggattttagatggcataatattcgtaatagacatgggtaaactcccgaattgttggttaaagtgatggaaatattgatcatcgaacaattgactaaaagtaaattacaacattatcattcaataaatcaatttaatgttttattaattgatttattgaaataaaaccagagaattagtgtggggtaccacttagcccatcacgctctgattcgataataaatattttaaaattagtttattgggggtcactatgagaatccgtgaatatttcgaacgcttactccatgatactccagacaatgctaatgccattgagtacgaacataattggtggacatggggtaaaagtcgcacaaccgttacgctcaatgcactacagccagtaacacggctcatagaagatattcaacggttggatatcaaaattcttatcgggagtaagtggggggagttagtcaaagcaactgtagttcttgtaccaaaagccacagtggaagccgccgaactgattaactggactaaagagcgaataggcactgtatttgcaccaaaagctatcgacttcgttaattctattccaacaactgaaaatggcaaacacgataaatcagtattacgcacatctcacagtcgatgattccattacaattttacatatagatcaaataaaaaatctagcatggcaaaagcgtagaagtcgcctttgccataacataaagaactaccccccgttcgggaaaatcaatgtctgacccggtgcttcgcgattcagatgaataaagttcagatgcttttcgtagtgatcgagaatatcgctgataatttgttctttggtgtaatccatcaagtcattgccctgagtcccttccatcaagaaagtttccaatcggtaatagtaagatttacccgatctggcacgataggtaaatccaggcacggaataacgccgcggccaaacctggtacacaaagttttgttcatcccccagttcgacaattaattcaagcgggctcagtcgttcgtccccttctgatggcagcgtattaaactgtactttcgcgccacgtaattccaactcttttgctacttcctgcatggcaggacgacaaaccatatccagcattcgttgggtacttttcgtgcccggaaaattcatcatgcggctcagacgttgtttccagttcaacgaaccattgtcatgtaccaatgttggcgaggtattctgcaatgaactggctttgcggaaatcttccacacgcaaagatttatacaatcctgccatgacaaagaaaatcacaaagctgaaaggcaaccccatgattaccgtcatattttgcaaagcagaaatgccatccgtcattaatatacccagtgttaatacaccaatcgccactgaccaaaagacacgtagccagttaggagcatcattattgatatcactgagatttgaggtgaaattccccagaaccaacgaccctgaatctgccgatgtgacataaaacagcaatcccgtgatcgtagcaacagaggcgctgaacgtgaaggccggataaagtgccagcaagccataaaaaccttgctctgggtgctccaataccgtttcggccaattgacgattaccatgcaggatttcatacaatacactgttaccaaaaatcgataaccataacagcgtaaagacaaacggaatgatcagcgttcccatcacaaactgacgaatagttctgccacgggaaatacgcgcaaggaataatccaacaaacggtgaccaggcaacccaccatgcccagaaaaacagcgtccagttattcatccattcggtcgggcgttcaaatgcaaaactattgagtgtcattcccatgaaacggctgatgtaatctccaacattttgcactaatccattaagcagaaactcagtatttcctacaaacagaataaacaggatcaagcccagtgccagcagtacattcaactcggacagaaacctaatacctttgttcacgccagaagtgacagaaacaatggccatcacaaccgacagcagtatcaacccaccctgaacccccaaaccttgaggcagtccaaacagcactttcagaccataattcaattgcaccaccccaatgcccaatgtggttgcaataccgaaaatcgtacctatcactgccgcaatatccacggcatgaccaatagagccttttattcgattgccaaaaataggataaagtgcagaacgaatggtcaatggcagattataacgatagctgaaatatcccagtgcgatccccatcaaggcatacattgaccagcccgtcaggccatagtgaaacagtgtccacaccatcgcctgacgagctgcttcaatagtttctccttcacccgttggcggccgcatgtattgtgtgactggctcagccactgagaaaaacatcaaatcaatgcctatccctgcggcaaacagcatcgcagcccaactaagcaaactgaattccggcttagattgctccggccccaatttgatagaaccaaaacgagaagcggcaacaaaaataacaaatacaatgtaaagcgttgcggccagcaaataataccaaccgaatgttttggacacccaatccagcgtattttttatccagatacttgtcgcatcagtgaaaaaaatcgtgaataaagaaaaaacgataatcagccctgccgaggtgaaaaaaacgacagaattaagagtatccttctgagtgttttttggactgtctggtgtgttcataggcagttcctgaagttaatgaaaataaaaagacaaaaaagaataaaacaactaactatttgaataaaaaacaaaaattatgttacctcgaataaatttaaccaactattgtgaatatattgtaataaaacatatttaattttgattgaacattcaattaaaaaaaagtttaatggttgccaaatgattgattctctgagcataaaaacatgccaaaaattggaatgcagtcgataagaaaacagcaactcattgatgcaacattagccgtagtcaatgaggttggaatgcaggatgccagtattgcgcaaatagcccgaaaagcaggcgtttccaacggtattatcagccattatttcaaggataagaatgggttattggaagccaccatgcgttacttattacaccaactcggaatggctgtagcacggcggttacggctgctcgataatgcaaccccagcccagaggctgaaagccattgttgaaggaaattttgatgccagccaaatcagcagtgcagcaatgaaaacctggttagctttctgggcaagcagcatacaccaacccaatctataccggctacaacaagtgaacgaacgtcgtttgtattccaatatttgtatcgaattcaggcatgtcttgccaaaagcagaagcccgactggcagcacaagggctggctgccctgattgacggtatctggctgagaagtgcattaagcagcaagccttttgacataaaaagtgcgttcactatcaccttcgattatatcgaacagaaactcggaacaccttacacagcctgaattctgactaaggagaatccatgactcgttttggcttacaaaagctttatatccacggcacttacgttaatagcgttaatcccgataaaaatacttttgatgcgatcaatccagctaatggtgaggtcatcgctcaattacaatctgcgacagagcaggatgttgagctggccgtcaaaagtgctcagaaagggcagaaaatctgggcagcgatgactgctgtagagcgttcacggatcttactcaaagcggttgatatcctgcgcgaacgcaatgatgtactggctgagctagaaacactggatacgggcaagccactgtctgaaactcaatatgttgatattgtcactggtgcggatgtactggaatattacgctggcttgatccattctctcgaaggtcagcagattccactacgagaatcatctttcgtctatacgcgccgtgaaccacttggcgtcgttgcaggtatcggggcatggaactacccaattcaaattgccctctggaaatcagcaccagcactggcggccggtaatgctatgattttcaaacccagtgaagttacgtcactcaccgccctgaaattagccgagatttatactgaagcaggcgtgccagatggggtatttaacgttctgactggcgcaggtcatgaagtggggcacactctgacagtacatcctgaaatcgccaagatgtcgtttacgggtggcattgtcacaggcaaaaaagtcatggcaaatgcatctggatcaaacttgaaagaagtcacaatggagctgggtggaaaatccccgctgatcatttttgatgatgccgatctggatcgtgctgctgatatcgccatgatggcaaactttttcagctccggtcaggtctgtaccaatgggacacgagtttttgtcccgaaaacactggctccccaatttgaagccaaaatcgttgagcgcgttaaacgcattcgcataggctctcccctcgatccaaataccaactttggccctctggtgagctttccacatatggaatctgtattgcgttacatcgaaagcggtaagtcttcccatgcacgactactgtgtggcggtgaacgtctgctggaaggtgaattagcgaaaggtgcattcgttgcaccaacggtatttagcgactgtacagatgatatgctgattgtgcaggaagaaattttcggccctgtgatgtgtatcctgacctatgaaacggaagatgaagtgatcaaccgcgccaataacaccgattatggtctcgccgcaggattagtgacacaaaatttatcccgtgcacatcgcgtgatccatcaactggaagcagggatctgctggatcaacacatggggagaatctcaagcagccatgccagtaggtggctacaaacattctgggattggccgtgaaaatgggctggtcacattgcaaaattacacacaaaccaaatcaatacaggtggagctgggtcattttgaatccctattttaatctatgactgaaacagaggagataacaatggtatttgattacattattatcggagctggttcagcaggtaatgtgcttgcaacccgtttaacggaagatagcgatgtcactgtcctgctgctcgaagctggcgggcctgattaccgattcgacttccgtacccaaatgccagctgcgctggcatatcccttgcagggaacccgttataattgggcatatgaaaccgaccctgaaccccatatgaacaaccgacgcatggagtgtggccgtggcaaagggctggggggttcttcactgatcaatggtatgtgctatatccgcggcaatgcgctggattttgacaactgggcaacgctatcaggtctggaagactgggcttatctcgattgtctgccctacttccgtaaagcggagactcgggacatgggggcaaatgactatcacggtgatgatggaccagtcagcgtcactacgcccaaaccggtcaataatgaactttttcatgtgatgatagaagccggtatccaagcaggatatccacgtactgacgatctgaatggctatcagcaagaaggttttggcccaatggatcgtactgtcacccctgaaggccgtcgtgccagcactgcccgtggttatctggatcaagcacggtcgcgctcaaacctcaccatcattacccacgccttgacagatacgctcgaatttgagggaaaaatggccgtcggcgtcaatttttatcaaggtaacacatcgactttaacgcaggcaaaagcacgtaaagaagtattactttgtgccggcgcgatcgcttccccacagattttgcaacgctcaggcattggccctgaagaaatcctgaacgagtttggcattccggtggtacagatattagcgggggttgggcaaaatcttcaggatcatcttgaaatgtatttgcagtatgaatgcctcaagccggtttctctctatccagccttgaaatggtacaaccagccaaagattggcgctgaatggttattcaaaggcacagggattggggcgagcaatcaatttgaagctggtggatttatccgtaccagtgaaaaatttacctggccaaatattcagtttcattttttgcctgttgccatcaattacaacggcagcaatgcagtcaatgaacatggctttcaagctcatgtcggctcgatgcgttctccgagccgtggtcgagtcaagatcacttcgcgtgatccacgccaacatcccagtattctgttcaactatatgtcaaccgcgcaggactggcaggaattccgtgatgccatccgcattacacgtgaaatcatggcacaacctgcactggcttcctactgtggccgtgaaatcagtcccggcactgacatccagacagatgaacaattaaatacctttattcgtgaacgagccgaaaccgcctttcatccatcctgtagctgtaagatgggtactgatgaaatggccgttgtggatggtcagggacgtgtgcatggtgtcaaaaacttacgtgtgattgatgcttcgatcatgccggaaattattaccggtaatttgaatgccacaacgattatgatcgcagaaaaaatcgccgataaaattcggggtcgtaatccactaccacgcagtcaggcaaaatattatgttgccaatggcgcaccagctcgcaaatcggcacagaatacgccatcagtgaattaattttcgccaatataaaatcaacgaccagtacgagaaaattggatatatgcaatactgtttgcacaaccatatttctcgtattggtatttaaaacaagccagatattgatggatacctattttcaataccaagacatttttcttaaaaaggaagcaatgaaaaagtgattatgctaaatccaacgtcataaaaatatgttctgcaccttcttccaaatagatttccccacgcgcttgatagcctaagctttcataaaatggctgggcatggcattgcgaggataaaccgatgcctacaattccatttttacgcccatagtcttcaataaactccattactttacgaccaatgcctttgccgcgatacgccttcaataccgcgacacgtcctactttaagcatattgttgtccattgggactgcacgtaatactccgattggtttttcaccatcaaatatcaggacatgcagagcaatatcatcatattcatcaatatcaatttctgcatcaaatccttgctcatcagtaaatacttgtttacgaatggcaaaagctggctgaattaattctggattttctcttcctacgctgtattttatttccattattatgtcctgaatgtgatttgcagaatacatattaaattacgggtaagaaaatagctaagtcaagttgataacagaggaaaaataagggcaaccttttttcaggtcgccctttagtattaatttatttttactgacaggatattgaatcgcagaattaactttcttctgttttattgccgtcacttttgaaactattgataaaatcatcagcctgcttattggcatcagattttatttcttccgcctttgatttcacatcatctttaaactgattaaccttatcggtggcctgatgctgtatatcatccgttttggttttcaccttatccagcgtatcattcacagacttcgtaacttcatttttcacatctgccgctttggatttcatctgatcggccagatgattggcagaatgacttatctgattttgtacttccttagacttatctaccagactatgaccttcacgtatggcactttctttcacttcctgtgatttttccttggcactatccactattccagtggttttttgttcagcgtcatttttcatctgggtagcactttcttcagcttgtcgggcagagtcttccacttttggagaaccatcatcacaaccagcaagcaatgctacgagacctgcaagaatcagagaactgagaatctttttcttcattgactaaccccttgtacttaagaaaattgcacttacggaaatgacctcaccaatgagtgttctggccgtttagtaccacaacatcccataagcactttgatctcactgccaacgcagtcagcaattgagaaagcataacgacacgggtaatcatttcaatcatccagcagcaaacccgtaaaaatgtcagataacctgatctatcacagtacattccatcaccataacacttctcaaaacacacaaataaaaataattctcatttttatttgcccgatttaatttcttaggtgacttataacaatgcaatatttcattccatcatgtttcaggaaatttatggcaaataatagtcaaaatttaggaaaacgcccaattatggccatcattcgaaaaattttaagaagtacattctcaggtacattagtgttgggtagtgcattgtccagccaagttttagccgctgaaaatccatctgaccagaaatctgaaaagcaaaatgaggtggttaaattaccatcgctttcagttgtaggtagtttacacaacagcaccagtgccggcagctcatcgctaaaaaaaaccgatattgaacgcactcaggcagataatgttgctcagttgctggatcaattgcctggggtttctatgtctggttctccacgtcccggtggacaaactttgaatatttggggcatgggtgagtcagaagatatcaaaatcacgctggacgacgccccaaaagggtttgagaaatatctgcagggttccatctttattgagcctgaattaatcaaacgtatagatgttgataaaggcccgcacaatttgttgaatggcaatggtggatttggtggctccgttaagattgtaactaaagatgccggcgatttattacgtcccgatgaaaattttggtgggctgttgaaatacagctatcacacgaatgacaggcaaaatatttacagtggtgccatttacggcagagatccagatggttttgccgatgcgttgctgtatgccagcaaacgcgacggtggcaatattaaacgtcctgatggaacacattttgagtattcacagaataatcagacttcttatttgctgaaaactaatttttatctcaatgatactcatacgctgagtttttcagccatgcgatctgaatcggatggatggcagccctgggccgctaagcgagataagatgaatgttccatcagaatgggacatagagagatatggttgggaaggagcatggcagagaaaattggtctttcgcaatcagattgatcaaaactacacagccaaatggaatattgcaccagaggagaatccgtggctgaatctgacactaacctctgcctattctgtaaccaaacaaaacgatcgccgcccagaaggaaaagatgtaacgctgacttcagcaagcctaatgggacaaaaaagttgggttaaatacatcgatacgatggttgatatcaacaataaaagcgtattttcaacaggcagtatagaacacgaatttttgctgggaacacgctggcataagaatgatcgtgacacattaatattcgataaaaacacggttaataactctgaatttaattatggttattaccagccttattatatgcccgccggagaacagcaaacttacagcatatatatgcaggactccttaaaactgggaagtattaccattactccaggcgtccgttacgatcatataaagaatattggcgaagaaaataaagcgcctaggtataacaacaaattgcctgaaataaaccatgattatagtggtgtaacctatactggctggtctcctcacttgggtattctgtggcagacaaacaaaaatctttcgctctttgctgatatcagccgtacatggcgggcgccagtggtcgatgaacagtatgaagttcagtcagatagaaccagccttccgggttccagccgcaatcttgaagtagaaaaaatgacgggtatacgcctgggggccattctcgatttcgataacctgatgcttgagaatgacagcctgcaaattcgtaccacgctgttccgtaaccgtggcaaagatgaaattttcaaaactcgtggtgtttactgtaaagctcaggctgacggtgcatcatccacctcatgtgaaaaaccgatagcaaatcatcgtaatctgccgggatataccattgaaggactggaaatagaaacattctacgatagcaataagttattcgggaaactttctttctccaccatgcgcggtcagcgtgatgcttctatgcgtgatccgtggataggacaaaaaacctggattgcagaaatcccacccacttctgcacatgcaatgttaggatttaagatcccacaatggcagatgtctatgggctggaaaggtgattttatccgcaaacaggatcgttcccctgtagatggggatccaaaagcgagttattggtctctgccaaccagcaagggttatgccctgcacgggttgtttgccagctggcgtcctccttatatgaaaggcttcgaagcgagagtcactgtcgataatctgttcaaccgtgattactatccttatttaggcgaaacgatttcagggattggccgtaatttcaaattcagtatttcacagcagttctaactgacatttaatcaatcaattcatataatcaatagatttccagttgcaactttattgtctgcaactggaaagatgaagagtataacccccttaatttttgagagaattatgtctacaatactgcgttgactttcaatccataaatgaaaataataatcattatcgaatttatcctaccccttcaggcagtatcatcatggcggtacaaaaaagcacatgcgggcacaatgaaatagcccagaaactctacttcgaataccaccattggttatgcaactggataaggcagaataatgtctgccccaaccatgcagaagatctcacccatgataccttcatcaaattgatgcagtcggcagatcttgaaaatgtccgccatcccagagcttttttaattacgatagcccgtagaactattgccaattactaccgacggaaaaagctcgaagacaattatctggactatgtcagcacgatggcgaaaacgacaacaaactcgtcagaatatcggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccataatatcagggatctgcaatttaacttgtaccccgaatcccagcacgtactcgactggtttcatatcacgatgcgtctgaccgtattgaaacaatatgccagaggggtatcaaaaaacgcccctgaacttggtgcagaattattggactctttaaccagcacaaaatggtatctctggcatggaaatgcgattaaggcattagaacacctggatgattgtgcggcaatgtgtgatgaggacatattgcattatggtaataataaatcattgttaaaacatatagatgaaatgtatacctatattgaaaataacagcatgatgatcccgaattacggtgaaatgtaccgatatggtgaagcaatttcctcttcatttgttgaatcgacgatcaatgaagttatcgctaaacggatggtgaaaaagcagcagatgcaatggagccagcaaggtgcacattacttactccagacacgcacagcggtactcaatggtgatttaaaaacccaatttgagcactggtatccgggtataaaattaggtgacaaaacggatcattattggacagaggcagttgctgcataagtgccccacagatttttatggtctcgtggtatgagttggtcagcaaagacggatacgatgtctgagacattttggtttcactttctgcaatcagctggtcactgaggctttttaatgttgtagttgttccagaggtacatcggccaactttatcagtactccgacaaacgctctggtataagaggttggctattcggtttttttatcaaccaatccagtaaattatccgaaaatcgggcagctcgaagagcaagttaaggcactggaaagtaaataaactagataaagtcctcaataatgcagaaaaattaaagaaaaaataactaagtacgataaaatataaaaagtttaaattaggtcagaagggttaattaaatgtacaaaggaaacatggaaaaattaatgatagaaagtggctttacacctaaagatattaaatttctcgaatctataaataaaaaaaatggcactaatcttatggataatataattgatcttgataaaagattttataagttaatattcattgtacctcttattttttttgggttcgctttcttatttttaatagcggatgatgtaaatgttgtagggtttattatatccacaattataacaatccctcctattttatttatgctgtcattcagaatgtcttatagagcgtctatatttatgaaaaaatataaacgcaaggaataattatttactattattttgagggtcattataagaatcataagttgattttaatgtgaccccatcagctactacctcaaatgtaagagcataaccactcattaatttatagctggtgacataatcatcttttacataattaaataatcgccaagaatcaggttttaacacatttctaaatgcaccataaccagataaagcaatatctacacctccataaactaaatttgcggtctttttatcagatcccataaataaaaaagcatgttcgtatcctcttcttagatatcccttataatcaggatctttctttaataaggaatttaaattttcttctatattactcataccattaactatgagtgctgaacctgcgacataaccgactactgtttggcttgtagctgttaccatagccgcgccagtaattatctgagcacctccggcaactatgccaaatcccttcaaaacatacgtaaaaaaatctagctctttcttgatttctatgacagcgtacttttcaagtatattatttcttataatattttcttgttgtgataaatatagtttttctttttttaggtcttgtattgcctgcattttagatgctttcgttgatgacttgcttagtattatgtttaaattattgtcagtgaatttttttatttctgatttaaaatatgcctttatacgaaagttatttaggaaaatagaaacacttaatgccgattctgttacgcttctagcagttagcattcccattgtagcaaagtaatcattctctctatttgcatatatatccatatttaataaatcctgtcatcccaaatactatacccgctagttcctgcggtgtgatgctgccatgttatgcttttatattttaaagaaatactttcctgcggctgagcatcattatgagttaaagaatgagggcaaataatatcaatattacttatggttgcatttgtcacttttatagtaaaaaaaagcacaaggccaccgctattatctgttctataaatatcaaatatacattctaattcttcattatctgatattgccattcctaataatggagttgatttatctataggtttttttattgtaattgggaaatgatttacgttttgttctctagataacgaatgatttaactcgtatatgtatattttattttcatgaccattttgacagagatttccaatggagttttctgatgaacatcctgatgatattaaaccttgtttttttccattaattgttagataaataatgttagccatgttatttcctttattgtaaattaacttagagtgaaaaatacaaggtaatgaattattttgtcaatagtacacattatttaacagtatctagaattaactaataatagccttttttatgtttttttatgctgtttctaatgaatattttaaataaattaattttttataatgaaaattataatttaagtaatttaaaattttttcaaaaaatggcgaactaaatcgccatttttatttatttatcttctttgaattggaagtgtaaggtgactactgggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccgctgctatagctgctgtaaggtctttcagctgggcgtatacctatcaggcctgcaaaccccggcgttaaagaacagattgtcgatatcgcgatgaatacggggggaatcgtgacacgtccgcgatcctggaagtcgccacg

SEQ ID NO: 14957 - DNA, 39682 bp, Xenorhabdus bovienii
  Genomic contig Name=Xb4151_4152.C416
ctatctgggttgactgaccccgcgtttcgactctagaggatccccctgatgattattgcaacaaatttcacttaagttgccagtttttccagcgtaaggaagccataatctcgtaatacgggtcgcagagcctcgctatttaggtctatttttgtgcaataagccaaattatccgccgttgttaaaaataaactattttggttcttcaccaaccacaccgttctacgcgcaatagcagctccagaatcaatcaatcgtgtgccatcaggaaaaacttgtgaaagctcttctgcaatcagagggaagtgagtacaacctaagatgacagtatctggcggttctttcattctcaaccacggtttgagaattttttccaatatttccagtgggatcttctcaccatgcagttttcgttcggctaactctaccaattctgcagaacctatagaatgaacctgacaatccgtggcaaatcttgcaattaattctttggtgtagtcgcgattgactgtagcccgtgtcgccaataatcctattactcggttacaagtcaactttgccgcaggcttgattgcgggcacaacaccaacaacgggaaaagaaaaacgttcgcgcaatgcaggcaaactaaccgtgctagctgtattacaggcaatgatgacaatagccagggggtgtcttttctgaatttcatcgacaacttgaacgacccgctcaatgatcacttccgccgttttttctccataaggaaatgcttcattatcgaaagcatatatatagtggagctccggcaataattgtcgaatttcttggtatacagataaaccgcccacacctgaatcaaaaattagaatcgttggtcgggcggttttaggtaaatcagaagttgtagcttccagtgagaaagtattctcggcctggggtgcgatagccatacgctgtctcataatttttatcaaacagattggctattctagcacggattgtgaggtggttagtgattgggtatgatgcgctgatatcccataaactgacgccacccaatttaaggggcttcggaggataaacactataatctgcatcatcgcgctgaccgatatattgataggttactccccaatcaatattgtataattcccaatctaattgatatttaacctgctgtttagccctgcgagctagctgcttattattgccatcacgcggatcaacatactgtaatgtcaattggtgctggaatattccggtatccatggttcctgtccattcaacacctttgatttttgccttaccaatgttctcatagcggttattggcaaaatttatcagttgttcaatatcattatgataaacagataagcgccaattcagtgccccagttaatccttcaattccaccttcccactgtttacttttttctggtttgagactttcatttccccatttgctatagagttgattcaatgttggagccttaaatgcggttccatacgagacgatcaaccgatagccatcaatgaattcccaacccattccagtttgccatgtggtattccaattatattcagaatgacggtctgaacgaacagcaccctccagcgtgacatcatgaatcttttgctgtgacgtcaaatacaggccagtgttatctacgtctttttgtacaggaatattattcgaacctgccgcaaccgattctcttttccagtcaacaccaccgctaattgcgccatgactcacttgccatgaatttccccattgcacattgtattgtttggagttacttaggctggagcctttgccataacgcccatatttgggatcatagttgtaatctttgacatggctgtaactggtaatccattgtgcagaataaattccctgtgtaaattgaaggcctgcatcataagtacgactgaatagctctcgagtatctatcagcatctgattataactatcataataggcatcataagccgttcggttattcaatccatgcacacgagcaaacccactgaactgatcattaaatttatggtcaacgcccagccacagcattttgctcataaaaccatcacgatccggctgacgatacccgcccgtaccgccaccagccaccacatcgaatcctttggtataggtatatccagccgctgcggtcaataaggtattctcgccgagcttctgttgggtcgaaccattatagttctggtatccgtgcgagccgatacctgcattcaatgttgttcccttttgctctcgcttggtaatgatattgattaccccaccaatggcatcagaaccatatacggcagagcgagcaccgcggatatactcaattctctgaaccattgaaagcggtatctggctataatcggccgcacccgtgatacccgcctgatttaagcgaataccatctattagcaccaatgtatgatgtgattccgtacctcgaacaaataaagaagcgtgttgccctattcccccattctgcgcaatatcaatactgggtaggcgacgtagaacgtcaaccaagctgctggattgccagcgatctatctcttcgcgggttaccaccgtcattggtgctaaaactgaagaaacaggctgtttaaagcggttcgcggtcaccaccagtggctcttgattatcagcaactgcaaaatggctccagctagaaaacactgccacagaagcagcagataaaaggatacgtttgttatttgtcatgagagaatggcatctaactatattgaatctagcgaataaagtgtcatgctacgatgaaggcgagaagcagtccagaatgaccccctatcaaaaagaggctcatgtgccagaaaactggacatccttttcactttccctacaatgccgctcggaaatttttcttaacgcgaccatacgagaaccagataatgcagaatgtcttgccaacggaagattatgaaaatcaattgatggaaaaggtccatcgtctgaaaggaatgatgatgccatttagtgcacctgagcctgaggttttccgttcccctgcatcacattacagaatgcgcgctgaattccgcatctggcatgagcaagatgatctttaccacattatgtttgaccagcagaccaaacaacgtattcgtattgatcaatttccggttgccaatgagctgattaaccagatgatgcagtcaatcattgcgggcgtgaaagataattcactcttgcgtcataaactgtttcaagtggattatctgtcaaccctcagtaataagattattgtctctctgctttatcataaaaagttgaatgatgaatggcgcgagcatgccatcacactacgtgatcaattaaaagcaaatggatttgatgttcagctgatcgggcgagcgtcaaaaaccaagatcatactcgaccatgactatattgatgaagaactgccgattgcgggtaaaacgatgatttaccgtcaagttgaaaacagtttcacgcaaccgaatgccagcatcaatactcatatgttggaatgggcagtgggtattacaaaaggcgccaagggagatctactagagctatattgtggtaatggcaatttttctctagcattagcacagaactttgatcgcgtactggcgacagaaattgccaaaccttcggttgctgccgcgcaatttaatattgaagcgaaccaaattgataatgtgcaaattatccgtatgtcagcagaagagtttactcaagcaatgaatggagagcgggaatttaaccgactgcatggcattgatctaaaaagctatcaatgtgaaaccatttttgttgatcctccacgcagtggattagatgatgcaacagttaaaatggtacagggatactcacagattctttatatttcctgtaatccagaaacactcagccagaatctggaaacactgacacaaacccataaaataagccgactggcactctttgatcaattcccttatacgcaccatatggagtgtggtgtattactggaaaaacgtatttaatcaccatctactatagctgaaaaattagttgggagaccaaaacgccacagcgatcaatttgtggcgttattccttcagccgttatcaggaaaataatcagccatggctttctgaagtgagtatagcttgttgtttacgccctttgatctttctgtaaatccaaaatactaaagcagcatcaatcacgacaggcaggaaattagaaccaatttctggatattccacccgaatgatggcgctgtaaatgaagattcctaagaaaaagcagccagccaccaactttggtaatccatctgccattggataattcaaataacgatgatggaggcaatacagagataataccagtgcaataatcgggaaaattgaaaaaggcacaagcgagttgaaaaatgctgagaaagttccgtgtgttgccaatccaacgataagagccagcaacatagtgcttttatcttggcggtattgttccatcgtattattctcctttcattattattcaagaggttttagggacagtctttttttcttgttcccgccgataccaataataagcacctttggaaatcaggcggagttgcaaaactaaacgttcttcgagacgacgccttttttcctcatcaatatccagcgcttctgcacctgcgctgaatacgattgtcaccatcgcctcagcttgaatttcagtaaaatgacgcggcatgtggcttgcctgttcgaggtagtctgccagctctgcaataaaatgttggatttcccgtgcgacagctgcacgaaactcagccgatgtaccggaacgttcgcgcagtaataaccggaaagcattgggattgttaccgatgaattccatgaacgttgaaacagaggttcggatgacgctgccgccttttgcgatacgctgacgcgcctgacgcattaactgacgcaacatcaagccgctttcatccaccattgtcagccccagttcatccacatcccgaaaatgccgataaaatgaagtaggcgcgatacccgcttctcgagctacttcccgtaagctcagacttgtgaaactccgctcagcactgagttggctgaatgcggcttcaatcagggaacgacgggttttttctttctgtttcgctctgacaccagttacgttactcaccacaatcctgatatatccattcgactatataataaagcaaatatatcagattctgctgtgtttgctgtgattgttctcttaaagctattatcccatattctccggtttcatttctaagtaataggataaaaaccgtatggtcattaggttattacatcaagtaatgttaagatagagttgttattttgtgtaaaaacaggtctttcctctatgcaatatactcattttgatgccattgtgattggctctggtcccggaggggaaggagcagcaatggggctggtgaaacaggaaaaaaacgttgcagttatagaacgttacaatagtgtcggtggtggctgtacccattggggtaccaattccatcgaaagctctccgccatgctgtcagtcgtattatcgaatttaatcaaaaccccctctatagtgataactcccgcattcttcgttcctcattttctgaaatcctgcgccatgctgacgttgtcattagccagcaaaccaaaatgcgtcagggtttttatgaacgtaatcggtgccaaatgtttgcgggcgaggcagcattcattgatgaacatcgtgtgagtgtccgttatgctgatggtagtgttgatatattaagtgcagataagataatcattgccactggttcccgtccttactgccctcctgatgttgatttcactcactcccgtatttataacagcgacaccatcctgcaactggatcatgaaccacgccacgttatcatttacggcgcgggggtgattggctgtgaatatgcttctatcttccgagggctgggcgttaaggtggatttgatcaatacccgtgatcatctgctgtcttttcttgatcaagagatgtctgatgccctgtcctatcatttctggaatagtggcacggtcatccgccataacgaagaatatgaaaaaattgaaggtcttgatgatggcgtgattgttcatctgaaatccggcaaaaaggtcaaggcagactgtctactgtatgccaatggccgcaccggcaatacagataagctagggttggaaaatgtcggtctggaaacagacagccgtggtttactgaaagtgaatcgcgtctatcagagcagcaatgagaacatttacgccgttggcgatgtcatcggctatccgagtctggcttctgctgcgtatgatcaggggcgcattgccgcaaaagctatcatgaccggaagcgccaacctgcatctggtggaagatattccaacagggatttataccattcctgaaatcagttcaatcggtaaaaccgagcagcagctcactgcgatgaaaatcccgtatgaggtagggcgcgcccaattcaaacatctggcaagggcgcaaattgccggcatgaatgttggcagtataaagatcctgttccatcgtgaaacaaaacagattctgggcatccactgttttggtgaacgtgccgcagagatcatccatatcggccaagccattatggaacaaaaaggagaaggcaatactatcgaatatttcgttaatacaaccttcaactatccaacaatggcagaagcctaccgtgttgctgcactcaatgggttaaatcggttattttaatgttttgccaaaaacttcgaaatagtcacccattttagctcgaatcgcctctgccaattgctcatagcgactgcgcagaggtgagccggggcgataaaccaagataatcgtacgtttaggctctggttcgatacattccagatagcagacaccatcgcgttttttctcttttggcacagccaaatcaggcagcaatgtaatcccactgcctgctgataccatattacgcagggtttccagactggttgccctaaaatgagtatcttctttggctccagcctgaaaacagaaacccatcgcctgatcacgcaaacaatgtccatcttccagcattaataatttttcgccagcaagctcttccattttgatatgcgtcctattcgcccatcggtgcccttcataaattgctagtttcatcggttcttcaaagagtggcacttcaatgaacgcttcggtttcttttaccaaagccagaatgacacaatcgagttttccgctatcgagttgcgccaacaggttctgagtctgagcctcatgtaaatacatttccagcttggggaacagcttgtgcaactcaggaatgataagaggcaggatatagggaccaacggtggggataaggccgatatgcagaggaccagacatgctttcaccttgaagatacgccatttcctgcaagactttcacttctcgcaataccgttttggcctgttccaccagcaacattccctgttgcgtgaacagcactttacgactggtgcgctctagcagcatcacgcccaactcatcttcaagtttacggatttgcccactcagtgtcggttggctaacatgacaagaatcagcggctcggcggaaatgccgatattcggcaagcgctacaaggtattccagatcgcggatattcattcccaacctcagtatttgatatcaatgatagaattgatcaataaatcattatatgcacgagggaataaaactatcaaattcatcaaaaaaattactattacatcatcatttcgtttatgggcagtaaactcacagtattcctcttcagaaaccagcactgctttactaaaagatttgttacaatttaatatagaaaaacctgccggattgggcaggcttatattatgttctcaggctaatctatcgttaaccgctgtttaaccgctgcaatcgcctgtgccacctgttgctgtgatacaccgccttttgccagccgtttatccaaacaggattgcagcgataaaacgtcatacacatctagcgaaatagcttcgctgaatttttgcagttcaaacaaagacagttcttccagcgccttaccttccgctatggccgcaattaccacttcaccaacaatatgatgcgcttcacggaatggaactccttttaccactaaataatccgccagttcagtcgcgttggcataaccctgttttgcagcttcctcacagcgcccgcgtttcacctgaatgccatccagcaccagcaccgccatatgcaggcaatcccgccatgtatccagtgcatcaaacaaaccttctttatcttcctgcatatctttgttataagcgaggggaagccctttcagcgttatcatcatgcccgtcaatgcgccctgaacccggccacatttgccacgaataagctccagcgcatcagggtttttcttttgcggcatcagggaagagccggaagttacccgatctgataactcaataaaacccgcttctccactgttaaagaaaatcaggtcttcagcaaagcgtgaaaggtggatcatgctgatactggcatctgacaatagctccagaacatgatcccgatcggaaacgctatccagactattacgtgttgccgaggcaaaaccgagccatgatgctaattgttcacgatcgatatcataggctgttcccgccagtgcgccacagcccagtgggctgacatccagccgtttcagtgcatcttgcaggcggctctcatcacgatccagcatttcggcataggcgaggcaccaatgagcgaaagtgactggctgcgccctctgcaaatgggtataaccgggcatcaccgcatcttgattattctccgccgtaatcaccagcgcctgttgcaattccacaagtgcctgctgaatatcggctatctgatccttacaccacagtttcaggtcagttgcgacttgatcattacggctacgacctgtgtgaagttttttccccaaatcgcccactttcgcgataagttgaccttccacccagctatgaatatcttccacatcgcttttcaaaatggccttggggttggcccgcacttcacccagtaactcattcagcgccagttccagtttttgctgttcttcggaaaccaatactcccaccgtaaccagcgcctttgaccatgcaacagaaccaataatatcctgctccgccaagcgataatcaaaacgcagagaatcgttaaattgtttgaatcgctgatcggcttcctgactgaaacgtccgccccaaagtgccatatgtcgttcctgttttctctatttaataaaggttaattgctcagaaattattttttgctgttcagtgtacgaatacgtgaagaaagcgaatagaggcgaatgaacccttctgcatggcggtgatcgtagacttcatcttctccaaaagtagcgaactcttcagaatagagactgtatgtcgattttttctgttcagcggtcacctggcctttatacagttttaagaccactgccccactgacactgtcagccaacgtttccgcagcagcctgaatcgactggcgcaatggtgcaaaccaacgaccatcgtagacgacataggacatttccaaccccaattgctgacgccatttgaagctgtcgcgatccaacaccaactgttcaattccccgcaatgcggccatcatgatggttccacccggtgtttcataacaaccacgggatttcatgcctaccaaacggttttccacaatgtcgatacggccgataccatgtttggctcccagttcattcaatgcattaagacattgatagggtgacaaccccttaccattcacgccaaccacctcacctttttcaaccgtgacggtgacatattctggctcattctgcgcatcttctggctctgctgtccacacccagcaatctttattggcagcattccatgtactttccaataccccgccttcggttgagatatgccatgcgttttcgtcacggctgtaaattttttccagcgtggcggtggtgggaatatcgcggactttcagataatcaagcagagcctcacgggaacgcagatcccattcacgccacggagcaaccactttcagatgcggcgctaacgcagtataagtactttcaaaccgaacctgatcgttacctttgcccgttgccccgtgagctacagaatcagcgcccactttcagcgccagttcgacctgtgccttggcaataattgggcgtgccattgatgtaccaagcaaatagctgccttcatacaatgcgcccgttttcagtacgggataaacatactctttgatgaactcttcacgcaggtcgataacgtgacattccgacgcaccagatcgcaacgctttctgctccacaccttctaaatcttcgcggctttgaccaacgtcagcaacaaatgcgacaacttcacaattgtcataatgttctttcaaccaaggaataatcgcagatgtatctaaaccaccagaatatgctagaacgatttttttaatgcttttagtcatagggataaccttttatttttgttcatatcagtcaaatactgtgccactaatcggtaaaaccaagccaattacgccgaaattcgcgtacctgtgggtatgccattaaataatgcaattaattgttcggtatgtcgccagcttgcaatatcaaccggatgcttcagcgtttttgccgcttctaaggccgcattaactttcacaatcatgccgtcagttatgatgccatgctcaatgagctgttctattttttccgctgttagctctgggattttctggccttttccatccaaaataccgctgacatcagacagaaagaccagatccgcatttaacacctgcgcaatggcggttgccgcctgatctgcattcacattcatcagctcaccattttcggtgataccaatagaactgataattggcatataaccgacatccagcaaaattttcaggagatcgggtttacccggatgagcttttccagtgtggccgaattcctcatcaaactgggaaacttgcaccacaccaccatctcccagacacaatccaatcgcaggcaatcggtattttatcgcgcaagccagcagtgccttattagcagttcctgccaatgtccccgtcacgatattaatctgatctgctggcgttaccctcaggccctgtatcttcacaatcggtaactgcaatctctgcatcagttcatcaactaaacagccaccgccatgtacaatgactaacgggcgcttatgcgtcttccgatatgactgcaatgtggaaaataaccgcgccagcgcttcttcgctgtctaacaacacaccacccaatttgataactaacggttccatcggatttatcctctgtcggtattaaaatctgccggaattaaagcaatgcctgagtttctgcaaacccaaaacgaatattcatgcactgtactgcttgtgctgccgcgcctttcaacaaattatcctcagcaccgacaataatcaggtgctgtccttgcacagcaaaaccaatatcgcagaatggcaaacccacgacggctttcaatgccggcataccttccgtgtatagacgcaccaacggtttatcatgatacgccagctggtaggcttccctaatttgcttttctgttacacctgatttcaacttgcaggtgatcgtagcgagaataccccgcgagaaattacccagatgagggataaaaatgacctcagtacctaaatgtgtcgcgatctcgggttgatgacgatgattaaaaatcccgtaaggctgcaaactaacttcacagaagctgttgttaatggttgctttccggcctgctccactgacaccactcacagcattgataacgggccattgttcagtatccagcagatttttttccagcaaaggcttcaatgaaagctgagaaacagtgggataacagccgggaaccgcgatcaactgggcagttttgattttttccgcctgccactccgccagcccgtaaactgccttatcaagccaagccgtatttttatgctcgaacccatagtattttgaataaaattgtgtattttgtacgcgataggctccggataaatcgaagactgtgcaacctgcttgtagaaatatcggcacaatatcatggctgatttcatgggcagtggcgaggaagacgacatcaataccattcactgcttcagccacatcagtcagcggctgtaaaggtaaatcaacaatgcccttgtactgcgggtagagatctgaaaaacatttccccgcatctgaactttgagacgaaaccattaagccagaaaggtggacatggagatgacgttgtagatatgctgctaactctgctccggtatagccactggcaccaactatcagcgtattcaacatgggacttattcaccttgtagtagtaacccaatcacattattgcatttatattcaattataatgcatgaatattgatactatcatgagtaagggctgtcaacagtgaatattaaattaccatcatttattagattatatcatcagctcattgctacaccttccatcagcgcaaccgatgctgaactggatcaaagtaatgaaatattaatcaacctgctggctggctggttgaaagaccttggttttaacattgagattcagcccgttcctgaaacccgtggcaagttcaatatgctggcaacattgggtagtggttctggaggtttattgttatgtggtcatacagatactgtgccattcgatgagggacgctggacacaagatccattcacactgagcgaacgcgatggcaagctttacggactcggtactgctgatatgaaaggcttctttgctttcatcattgatgctctgcgggatgttgatcccagtaaactaactcatccgctttacattctggccaccgcagatgaagaaacatcgatggcaggcgcgcgttattttgctgccaataccgccattcggcctgatttcgccattattggcgaaccaacatcgttacagcctatccatgcgcataagggacacttagctcatgttatccgcattgagggaaaatccggccattccagcgatcccgcacgtggtgtcaacgcacttgaactcatgcacgaatccatcacgcaattgatggaattacgcactaccttgcaggaacgctatcacaatccagcatttgttattcctcatccaactatgaatttcggccatattcacggtggtgatgcggcaaaccgcatctgtgcctgctgtgaactgcatatggatattcgcccgctgcccggattgaccgtgcaggatatggacgaattactgcataaagcactagagccggtgaaacagcgctggccgggacgtttaagcgttactcctctccacccccccattccgggttatcaatgcctgaccgatcacaaattggttggcgtgatcgaaaatttgttgggagcgaaagcagaaaccgtcaattattgtactgaagcgccttttattcaggaattgtgtccgacattagtcttgggaccaggatcaattgaacaggcacaccagcccgacgaatttttaggtatggaatttattgagccgaccagaaaattgatttctcagctgattgagcatttttgcctgcaaacccattaattttactacaattgagagaatatccagtaaaagttttaaccccgataagtgcgtcggggtttatcgctattttctgaccaaaacaacgcacaaaacttcataaattcctctcagtatcactcataatccgcatagctccgttcacaagccaattaaatcaggcgtttctcttgctctgcccaacatgaatttctttcctgatcattttgaatattcctcatttcggataagtcactttgctgttgactaaacataatgcttagcccattctatttagacatctaaacgtatagacatgtaaacacttaagcatctaaacgtaagcgggtcaaaatattccgctgatttacaaggatacagggtatgagtttttttcacgctaatcagcgagaagcgctgaatcagaatttggctgagcttgaagggcagattcgtgtttcttttgagttctttccacccagcacgactgcgatggagcaaaccctgtggaattccattgagcgcttaagcaaactgaagcctaaatttgtctccgtaacctatggtgccaattccggtgaacgcaaccgcactcatagcatcatcaagggcattaaagacaaaaccggccttgatgctgcccctcacttgacttgcattgatgccaaccgtgaggaactgcgtaatattgctcacgattattgggagagtggtattcgtcacattgtggcattgcgcggtgatttacccgagagcaacggtaaaccggaaatgtatggtgccgacttagttgagctcttaaaaaaagaagcggattttgatatctccgttgctgcttacccagaagtgcatcctgaagcgaaaagtgctcagtcggatctgattaacctgaaacgcaaaattgatgcgggagcaaatcgcgccattacccaattcttttttgatgtagaaagttacctgcgttttcgcgatcgctgtgttgcaacgggaattgatgtggaaattgtaccgggaattctgcccgtctcgaacttccgtcagttacagcggtttgccacaatgactaacgtccgcatcccaagctggatgaccagaatgtttgaaggactggatgatgatccggaaagccgcaatttagttggtgcatccattgcgatggacatggtgaaaattctcagtcgcgaaggggtgaaagattttcatttttatactctgaatcgggcggaattaagttacgccatctgccacacgctgggagttcgtccttgttgattgttgatagaattaacagacgctgggccaagataagatttctttgctgatcacaatcaaacggtggcgatgtaaatcggaatcgcctccttaacagagggcatcccacttctcaagaaagaaaattgtacgttctacgttcttttctgaaatacacagttatccacattctcagtcagatatagctactctgaaccgagcggaataggggttcagcgttgttgtggatggcactcactatatgcttaccgacaatgttctcatttcacaggaggccagagctgagaagtatgcaccaacgctaatatccaaacactttcccctgaaacctcataaaccagccgatagttctcattcaggaaaacttacaatgtccctgaaatttcaccggcatgtcccatataaggaaattcaatcaaccgttccgcagcagtttcgaataactcatccatttttacggcggccactggatttttagtaacaagatattcccatattgcttcactatcctgcaaagcttgaggtgtctatatgaccttcatttaacggcctttttctgtgctctacgagctgcaaaaatcgctttggcatccgtatattcaacaccctctccagcatttatggattaaccttaatatattgaatattatatataattgtgacacatagaaaaaaacaatagaatctgcgaataaagctattaaattaacctgaactctggataaaataattcttaatcaaaaataaaaaagccgaacagttccccattcggcatttttcattcagaaaatcaaaagctagccggtattgcgcatccctgccgcaacccccgcaatcgtcaccattaatgcttgttcaaggtgcggatctggctgttcctgctgacgggaacgctgtaatagttctgcctgtagcacattcagcgggtcggtatagacgttacgcaacgcaatggattccgcaatccacggcaagtccgccattaattgctcatcctgcgaaatcgtcagcacagttttaatatcctctgccaactgattacgcagcgttattcccaacggccacagttttttatccaccaagcgttgatcataatattccgccagccataaatcggccttggcaaataccatctctaacatggcaatgcgggtattaaagaaaggccagtcgcgacacatatctgctaacaccgacagtttacccgcatcaatcacatgttgcagcgctgctcccgcacccaaccatgctggcaacatcaggcggttttgcgtccaagcgaatatccaagggatcgcacgcaggctttctacaccgccggtcggacgacgcttggctggccgtgaccctaaaggcaatttcgccaattcctgttctggcgtcgccgctcggaagtaaggtacgaattcgggctgctcacggacataatcacgatacatgtcacaggaaacatcagagagcgtatccatgacttgcttccactccggttttggctctggcggcggcagtaaatttgcttccaaaattgcactggcatacaacgccagactgctaatcgtcacctgtggtaaaccaaacttaaagcggatcatttcgccctgctccgtcacacgtaacccacctttcagactgcccggcggctgagaaagcaaagcggaatgcgctggagcaccaccacggccaatcgtaccaccacgtccgtggaacagcgtcagcgttacgctttcctgctcacacactttgatcaacgcatcctgtgcccgatattgcgcccatgatgccgccatcactcccgcatctttggcagagtcggaatagccaatcatcaccatctgcttatcctgaatcagctcgcgataccagccaattcccagtaattgctggatcacactttccgcattattcaggtcatcaagggtttcaaacaacggtgcaacaggcaatttcagtgagcaacccgcttctttcagtagcaacttcacggccagtacatccgagggaactttcgccatagaaatgacataggctgcaatcgcatcttgtggcgattcggcaatgaccttacaggtttcgaagacttctagggtttcttcactcggctgccaacaatgcggaataagcggacgttttgaattcaattcacgcagcagaaaagtttgtttctccgtttctgaccagctcgcataatctccgagctccagatattgggtcagctctgcaatggcatcggtgtggcgggtgctttcctgacggatatcaatacgcaccaacgacaaaccaaagcagcgaatgcggcgcaaggtatccaacaattggccattagcgataatttccataccgcaggttttcagtgattgatagcaggcatacagcggttgccacaattgttcgttatgcagcagcaaacccacaggtggcaggactcgctctcctttaaggtgtttctccagatacgtcagtgtgctatttaattgcgtccgcaattgtttggcgatttcacggtaaggttccagcaccccatcaccacccgcaagctggcgcagttcaggtgtacactccgacatagagagttcagaaactaacacctgaatatctttcaaaaatagatccgctgctttccagcgactgagcaacaatacatggcgagtaatttctgcggtaacgttggggttcccatcacgatcgccacccatccaagaagtgaaacgaatcggtacggcttccacaggtaagctatagccaatggattcttccaattgctcattgaattcacgcagaaatgcaggaacaccttcccacaaactattttccaccaccgcaaatccccatttggcttcatcaatcggggtggggcgaattttgcggatttcatcggtatgccatgattgggcaatcaactggcgtaaacggcgcatgatattaatgcgttcataatccgccagatcatcatggtcaagctgtgacagacaggcattcacttcgaccagtttatgaatcagagtacgacgggcaatttcggtagggtgtgccgtcaagaccaattcaatggcaagttcattgactgcattgatcaagtcatcattactgaattttttatctttcagccgattgaacaaagcctctagcgctacaggattgctagccgcttcaccatgcggtgaaatgctgtgatattgttcggcaacgttggccagattaagaaactggttaaaggcccgagcaaccggcaataactcatcattggataaattttgcagtgtagataaaagttgctgccggtcagcttcatttcctgcacgggatgatttggataatttccttatcgtttcaactttatcaagaatgctttctcccagtgcttctttgatagtgttacccaataacttaccaagcatactgacattactgcgcattgcagaatattgttgattcatgtggtttctgaccttgtgttgctgtatttaacctatttcaccagatcgttgatcgattcaatcggcatccaccctgtttgcagagcatgttttttgtttatttctgaggctctattcatatcagaaaacgagcaatttgggcgaattttatgaaatttaatagcggattcttttttataagcggctctgattgcctgactcgcgtatgctcaacaaacagaagaataagacgttttttattaattggatggtgattgaatcggcttgttccggttatctatcaaacaaaggtgcagaaaataactttccgtaactagcagggataaaaatgagcaatatccctgccgcaaaattgactgcctaaacttaaagaagctgtgacaaacggttcaaatctgattgaatcgctcctgccgtcacatcccgtccagcgcctggaccacggatcaccagtggattgtcacgataccagcggctttctatcgcaaagacattatcccccggtaataacgaagctaaggggtgatctgcacgcacggcttcgacaccaacttttgctttaccactggtggcatcaaagcgagcgacataacgcagtaccatgcccatttcctgtgatgcttccaaccgctggagcatttgctcattaataacggcactattttcaaagaagtcttcgatggaaccggttctggcctctactggcacgagggattcaacacgcacctgatcaggctctatctcataacccgcctcgcgagccagaataatcagcttgcgcattacatcctgaccggacaaatcgatacggggatcaggctccgtcaatccttgctgccacgcctgctccaccaaatcactgaaaggtacggagccatcaaattgcaggaacagccatgataacgtccctgaaaaaataccgctgatagacagaatggtatcgccactttcccgcaaatctctgacggagtggttaatcggcaaccctgcaccaacggtcgcattgtataaccaatgacggccggtttttgcaaaagcatcgcgaaccatgcgataagtgttactgtttgaagaacctgcaattttattggcgctgatgacatgaaagccatagctggcgaaatcaatatagtctttagccaactcctcgcttgcagtgacatccaacaccaccaaatcgtcataagggtgcgctctcatccacaaaaacagcgcatcgtcttcatgttgagtggcttcatcaccaaagaatgccaatgctcgactcgcatcaagcccctgataattcagcaagctccgacgactgtccacaatccccgccaaaataaattcaaaaccactgcgggcagaaatattcttctgttcacgagcgaacaattctagccaacgtgagccaatgtttcccttgccaaacagcaccagaccaatgcgtttttctgcccggaacagactttggtgcaatccctgaatcaaatgtgaagtctggctcaggcgcagaacagcaacaaggctgataccctcttccgcatgccagataaattcaatgggctggtctttaagctgctgataaaaacggtggctatgcaacggattcttgcacactcccgccccgaccaaagccaccagcgccaatccttctcgcaaagacaattttcctggcaaagacgcatcctgcaacacatcgagagcactgttcacgacttcagaggtataacaaagctgaatcaaattacagtcagcgtgcagacctgtcgccaacggccgaatttgtgcgcgtttcagcaatgaatcaatgtccttgtaaatctgcttgaaatcatgggcagaagaaatatgcagttcaatcagacagacatcatcatgactggtcacgattttcgccccagtacctgttgccagcacccgctcaatgcgggtagatccttgttcaggctggtagctgcaacgcaattgcaagtcgatatcactgacggaaacaggctgcaaagtgcgggtatgaaggacgggtgccgccagacgcgccagttcactggcttcatccaaacgcagtaaaggcaacaggcacgcatcctttactttacgcggatcagcactgtaaacacccgctacgtcgctccaaatcgtcacttttttggcgcctgccagtgcaccaacctgtgtggcagaataatcactgccattacgtcccagcagtacggtttctcctttctgatttctggagataaaccccgtgaccaccaaacgcttactgggattttggatcaacagttggctcagtaaaggctgggacaagttcacatcaacctgcggctgggcagcgcgttctgcccgcagaaattggcgtgcatccagccatgcactggaaatacccttatgctcaagcacagccgccatcaaacgggctgaccagatttcaccatgcccgaccacctcggcgtacgtaatgtcagtaatcggtttgtccagcaatacacttaatttttccaggtccgagataaaatgtgctacgagttcttccgcaatcacttcaggcaataaacctctgatcagctcctgctgataacgcctcaatgattgctgtacttgatgtgctgagatgcggtcactctggctcagtttcaaccaatcaataagctgattggttgtactccctgctgccgataccaccatcaaatcacccggctggctataattcgccataatttctgcaacccgctgatagcatttcacatcggcaaggctgctgccgccaaatttatgtaactggcggccaaattccgcccccgctgttgccagtgcactcatgattaatgattacctcgttgctgctgcctgaaacgctttgtccagatccgcaattaaatcctgactatcttcaattcctacagagacacgaagaagtgaatccgtgatccctgcctgcgcccttgcttctgccgccattcccgcatgtgtcatcgtcgcagtatgagaaatcaacgactctacaccaccgagagattcagccagagtaaataattttaacgcagataaaaaatggcgtagggtttgttcatcaccatcaagttcaaaactcagcatcgccccaaagcctgtttgttgtttaagggcaatttcatgcccgggatgatttttcaaagcagggtagtagagttttttcacttgtggctgttgttgcaggtactcagcaatagccgctgcgttattctgctgtagcattacccgtgcagacagggtacgaataccccgcaacagcaggtagctgtcaaaggcggcacctgtgataccaatattgtttgcccaccacgccagattttctgcgatcacgggatctttggcgataatcgcccccgcaatcagatcggaatgcccattcaggtacttcgtacaggagtgaacaactaaatcagcgcccaaatccaatggcttttgcaatacaggactcaagaaagtgttatcaacaaccgccagtgctccaactttatgcgccaacccacagatatattgaatatcaacaatgcgcagcagaggattactcggcgtttctatcagcaccagttttggcttttgcgccagagcctgtttcagggcttgattatccgactgatcaacaaaaataacgttgtacgccccacgtttactcagactgtcaaacaggcggtaactaccgccataacaatcatggggagccaccaataaatcccccggttgcaagaaaacggtacacagcaggtgaatcgccgacatgccgctgctggtcatgactgcccccgctccaccttccagctcagccagaacctgctgaacgacatcccggctgggatttccacgtcgggaatagtcatgtgcccttggctcattgaaaccagtgaaattatatgtgctggaaagatagataggcggaactacacaaccatattgttcatcaatatttgcaccactttgaaccgcgactgttgcttgtttgcatcccataacctttgcccgtcactttattattggagtcaccaaagaataacgactggaaagatagacgtcaatacatctagacatctaaaatcatttaaggtttaattgcacaattggctcattgtccccattttttatgttagctccgggcatattttacgaattagtgctgccatagcgatatagccaataggggaattatgctaaaataatgaattaccgacatgaaaacagatcagaaacttcccgtttttctggtttcaattgtttgatttcaagactatttaaggtatctcatggctgagtggaatggtgagtatgtcagcccttatgctgaacatggcaaaaaaagtgaacaagtcaaaaaaattacggtttcaattccattaaaggtcttgaaaatactgactgatgagcgcactcgtcgtcaagtgaataatctgcgtcatgcaacaaatagcgaattgctgtgtgaagcgtttcttcatgctttcactggacagcccttgcctaatgatgatgatttacgtaaagagcgtcatgatgaaatcccagaggcagcgaaagacataatgcgtgagctcggtattgatcctgaaacatgggaatactgatgcaaacaaaaacgcccgatgcaaacatcgggcgtttttgtttcaaccgtactgcctgtaaagtttacaggcagaaaatggtcattacttactagagcctggaacgctgaaacgtttgttgaagcgatcaacacgaccaccggtcgcaacgtcacgctgcttgcctgtgtagaacgggtggcattcaccacaaacgtccagattcaggttgtgattaacggtagagttgatagtgataacgttaccgcaagagcaagatgcagtaattgcttcgtatttaggatgaataccttttctcataggaaacctctgttaaggccgtgtcgctatccagccttgttgccgccagacaccacacgtcgtgttgattgaaataagctcggtaatttctgtaccaaaggcggcggatcatacagaatatcggtttattgcgcaatgaaatctgctgatttgctatgatacccttatcactgtatttttctttagctgttcctatgtctggtcattaattatccggaaatcgccttatgacagttgttcaggttgcgctgcctgtacccttaacccgctcttttgattatctattacccgaaggattaccgttgcccatgacaggtgtgcgggtgcttgtgccgtttggcaagcgcaatgcaataggcattgtcactggaaccgcaggcaacagccaaattccccttgaacagctcaagccacttgccgcgatccttgatgcacaaccgcttttccctgacgacctttggcaattgctccagtggtcagcctgctattatcactatccactgggagaagtattattccatgccatgcccgtcttactgcgacagggaaaacccgccgaatttactccactttggcaatggcaggttacagaagcaggccatgaattccctctggagcagcttaagcgttccgttaaacagcaacaagcgctggcttcgctacgcctgaaacccatttaccgtcatcaaatttctgaactggaattcagcgaaagcgcactgcaatcattgaaaaagaaagcgctgattgatctgcatccgatacagccggaggcagaaaactggcatgagcagtttcagattattggtgaacgactacaactcaatacagagcaggccaccgcagtcggcactgtccgagcagaagatcagattttttctccatggttgcttgcgggtattacgggttcaggcaaaactgaagtgtatcttagtgtgctggaaaatattctcgcacagggaaaacaagcgctgattttagtcccggaaattggtctgactccgcaaactatccgccgattcagagaacgtttcaatgcacctgtcgatgtcctgcactccgccttaaatgacagtgaacgcctgtcggtatggctacgagccaaacggggagataacgcgattgtcattggtacgcgttccgcattgttcaccccctttgcccatctgggcgtcatcattatcgatgaagaacatgacagctcctataaacagcaagagggctggcgctatcacgcccgtgatttggccgtgttccgagccaagaaagaaaacattcccatcatgatgggtacagcaacgccggctctagaaacgctgttcaatgtgcagcaggggaaatatcgacaattgacactgacccaacgagcaggtgaagccaagcctgcagttcagcatttgctggatttgaaaggcttgccattgacagtcggtttatcccagccgctcatcaatcgcattggtgagcatctgaaagcggataatcaagtcatcctgtttctgaaccgccgtggttattcccccgctttgctttgccatgaatgtggctggatagcggaatgccaacgctgcgatcactactacactctgcaccagagccatcgccatctgcgttgccatcactgtgacagccagcgtccgatcccgcgccaatgcccccagtgtggcactactcatttaattcccgtcggattaggaaccgagcagcttgaagatggcatcacaaaattgtttcctgatattcccgttacccgtatcgatcgggacaccaccagccgcaagggagcattggaacaacaactggcggcagtgcaccaaggtggtgcccgtattttaattggtactcagatgttggcgaaaggccaccatttcccagatgtcactttagtcgtcttgcttgatgttgatggcgctctgttttctgccgatttccgggcggctgaacgtttcgctcaactgtatacccaagtctccggccgcgcgggacgggcgggtaaacgaggggaagttgtccttcagacccaccatcccgaacatccactcttgcaggtgttgctggaaaaaggttatgacgcatttgcccgtcaagcgatggaagaacgtcaacaagtgtttctgccgccgtttgccagccacattctgctccgttcagaagaccacgacaatcagcaagcccctgcttttttgcagcaaatgcgtcaattatttgaacatcacgctctgcgtgatgagcatttatggatcatggggccagttcccgcattacaggccaaacgtggtggccactttcgctggcaattactgattcaacacccttcacgtatttttctacagaaaatgatggcggcaatttatccgcaaatcaccgcgctcccacaggcacgcaaggtgaaatggaacattgatgttgatcccacagaaggctgatagcagaaattgaaaatggcgcgttgtcgcaaaggccccaaatcaaacagaacattctgaaaaaacagagacaattatttccttaatttgcgaagtaactctgataaatgattcctatcacattttttatgcaaacaaagtaacagattgatctgttactttgtttaaaatgcacttattaatatgactgtagaaaatgaaccgccagcgtttccctctccggaatgactggcgtttttttagcagccaggaagcaaccgtttcgctgcctgtagaaagtaaggagtgaactatggaaaaaaagaatggcacattagcaaccatgaaagatgtcgccaatgtggctggtgtttctaccgcaactgtatcaagaacccttatgaatcctgacaaggtttctgcccgtacccgtcagaaagtagaaagtgccgtactggaagtaggctactatcctcataaccttgccaaaaatttaagacgcaatgaatccagagcaatcttggttattgttcccaatatcagcgaccctttctttaccgaagtcattcgcggtattgaagaaacagcagcagagcatggctatctggttctgattggcgactgtaagcatcagcagcaacaagaacatgcctttatcaatcttctgattaccaaacggattgacggcatggtgctgcttggctcaaacattcctttcgatgtttccaaagaagaacaaaaaaacctgccaccaatggttatggccaacgaattcgcacctgatctggaactaccgactgtccacattgacaatctgacttcagctttcaacgctacctatcacttacaaaaactgggacacaagcgcatcgcttgtattacagggccagaaacgatgccactgtgccattaccggcttcagggctacattcaggcattgcaccgtacgggggaagcgatccgcgaagattatattgtcaggggcgattttacccatgaaagcggagcggaattggcagagatcctacttaacctgccagagccacccagcgcgattttctgccatagtgatatcatggctattggcgcaatgtggcaagccaagaaaatgggattaaaattaccagaagatctgtcagttattggctttgataatttaaatctggcgcaatacagcgagccaccgctaacaaccgtggcacagccatgttatgagattgggtattattcaatactgttgttgctggagcagcttcaaggccgcatggtttccaaaggttcacgattattggatgcagaattgctcattcgtgcgagcacttgttcgcctaaaagctaggcaaataaccgcagattcagtaacattagttatctatcccttaatttttttaaacaacttcagcgaattaaatagtggcacaacgagattatgtaagtcgcgggcgttctaatccccgtcagaaaggcactggtaagaaaaaaaatcaggctcaaggattacccaaaactacattagccgttgccgtggccttggtggtcatgtttattggtggcctttatttcatcgcacacactaagaacgatagtgcacaaaatacaccaccacccgctcatcatgccaaaaaccagggactaccgccaaaaccggaagaacgctggacttacattaaagagttggaaaaccgtcctgttggacttccttcgacacaggaaccgacttctgctaatcaaccaaccaaccaaccagcaaaactaacgcaagaacaactccaattacttgcacagatggaggcagatattcgccagcccccaacgccattaaaagaagtgccttacaacagtgaacctgttcctcgctcacaggtcattatcaccttgcctgaacaaaagccgtttgttgcacaagaaaagaccccgccagcacaatctctggcccccaatgaaaccaataaatcaccgaagcctgcgataaatgaatccaagctgatgctacagtgtggctcatttcgaacaacagagcaggcagaatccgttcgtgccagcctcgcattcgcaggcattgagagccagattacaacaaaagacaattggaaccgggttgtagtagggccttataaaaacaaggaatccgcggaaaaaatgcgcagccatgttacagatgcgggtgtacctggctgtattctccgcccttccgggggttgaaaaaccagaaaaataccccatcttaatcgctaataacagacacacggtgcttttccagcaatacagcttgcaattgtggcataacaagccaaagtaccgtgtgtaacgtcttctattttgtaaccaggggctaactcgtgactacaatcgtaagtgttcgccgtaatggccaggtcgtcatcggtggtgatggacaagcaacaatgggtcataccgtcatgaaaggcaatgtccgcaaagtacgccgcctatacaatgacaaagtcatcgcgggttttgccggcggcaccgcagatgcatttactctgttcgagctgtttgaacgcaaactcgaaatgcatcaggggcatctgaccaaagcagccgttgaacttgccaaagactggcgaacagatcgcatgcttcgcaagctggaagctcttcttgcggtagcagatgaaaatgcttctctgatcattacaggtaacggtgatgtgattcaaccagaaaatgacctgattgccattggttccggtggttcatacgcacaggcagccgcccgggcaatgctggaaacgaccgaactcagcgccagggaaatcgcagaacgcgccctgactattgcaggcgatatctgtatctacaccaaccataatcacaacttcgaagaactgccttcaaaagcgtaaggatagatagcatgtctgaaatgactcctcgcgaaattgtcagcgaacttgacaaccacattatcggtcaggataaagcaaaacgcgctgtcgccattgctctgcgtaaccgctggcgtcgtatgcagttggatgaaacactgcgtcatgaagttaccccgaaaaatattttgatgataggcccaaccggtgtcggtaaaaccgaaattgcccgtcgtctggcaaaactggccaacgcgccttttatcaaagttgaagcgaccaaattcacagaagtcggttatgttggtaaagaagtcgattcaattatccgtgatttgactgatgcggccgtaaaaatggtgcgtctgcaatctattgagaaaaaccgctatcgtgccgaagagttagccgaagaacgcattctggatgttttgctcccaccagcgaaaaacaactgggggcaaacagaaacccaatccgaaccttctactgcccgtcaagcattccgcaagaagctgcgcgaagggcagttagacgacaaagaaatcgaaattgacgtcgcatctgcacctgttggcgtggaaatcatggctcctccaggcatggaagagatgaccaaccaactgcaatctatgttccagaaccttgctggtcagaagcaaaaaacacgcaaaatgaaaatcaaggatgcgttcaagctgctggtggaagaagaagccgcaaaactggttaatcctgaagagctgaaacagcaggccattgatgccgttgagcagcacggcatcgtctttatcgatgagatcgataaaatctgtaaacgtggccagacttccggcccagatgtttcccgtgaaggcgtccaacgcgatctgctgccactggttgaaggctgcaccgtttctaccaaacacggcatggtaaaaaccgatcacatcctgttcatcgcctccggcgcgtttcaggtttccagcccttccgacctgatccctgagcttcagggtcgtctgccaattcgtgttgagctgcaagcgctgacaacagaagactttgaacggatcctgacagaacctaacgcttcactgactgaacagtataaggcgttaatggcgacagaaggcatgaatatcgatttcacaactgacggcatccgcaaactcgccgaagccgcatggcgagtaaatgaaacgaccgaaaatattggtgcccgccgtctgtatactgtgcttgaacgcatgatggaagatatttctttcgacgccagtgaacgtcaaggacattcggttgaaatcaatgccgattacgttaaagagcatttggatgagctcgttgcagatgaagatctgagccgatttattttataatcggcaacctgagccttattcactcgcaatgaagaaatgggaggcttgcctcccatttcttcattttcattgcaataaaatttatcataccaacaatacgtaataacaatatgaattcaacaacgtctatcagtcagatgcaggcatggttggaaagcttgcgccccaaaacgctcccacttgccgtggcagctgtcgtgagcggttctgcccttgcagcatggacaggccatttcaagtggcctgtggcgttgctggctttattgactgctgccctgctgcaaatcctttccaacctcgccaatgattatggtgatgtcgctaaaggcagcgatacagaaaagcgtattggcccgatgcgtggtatgcaaaaaggtgtgattacggccgaacagatgaaaaccgccttgaagatcactgtgctgacctcctgtttatcggggattgctctcatcaccgtcgcctgtaacagcccaagcgatatcatcggctttctggcgctgggagtactggctatcgttgcggccatcacttacaccgtgggaaccaaaccctatggctatatggggctgggcgatctttccgtcctgattttttttggctggctgagtgtcattggcacctattacctgcaagccaatacttttgatctgagtaccgtgctgccagcaaccgcctgtggcttactctccgtggcagtcttgaatattaataacttgcgcgatatagaaagtgatcgccaaaatggtaaaaatacgctggccgtcaggctgggagcaaaaaaagcccgctattaccacgcagctctgctgatctgtgccatcctctgtcttgccgcctttacactcctgcacctgaagagctggtctggctggttattcctgctcgccgttcccctgctgttgaagcatatgtggaaggtactgcacgatcagacatcagaaggcatgcgcccaatgctggtacaaatggtcaaagccgcattattgactaatgttctgttttccatcggattggtatttaattaagcgagtaagtatcagttttacacataagttttaagattgatgattttgccaacactagcttgaaaaggatatactgtctgtcctttgcataaaccagacgtaaatcccatgaaatatgatacttccgaactttgtgatatctatcaagaagatgtgaacgtggtagaacctttattctccaactttggtggacgtacttcatttggtggtcaaatcatcacggtgaaatgctttgaagacaatggcctgctttatgatgtgctggaagaaaatggcagtggccgtattttactcgttgatggtggcgggtctgtccgcaaagcgctggttgatgccgggctggctcagcttgccgtcagcaatgagtgggaaggcattgttgtctatggtgcagtacgtcaggtcgattcccttgcagagcttgatatcggcattcaggcgatggctgcgatcccagcaggctctaacagtgaaggcatcggagaaagtgatatcagggtgaattttggcggagtgactttcttttccggcgattatctctacgctgataatactggcatgattttatcagatgtcccgttggaaattgacgaagaagatgatgaagtatgatcacttcatcatctattatgtcaaaatgttaaagagggcgtattcatcgcccttctcaacaaaacggcaatactgatttactgcacatcttccattttacccagcaaagtccgcaaacgttcttgccacgccagttgttcctgtttgaactgttcattctcacgcaccaacgagtcgtggctacttgccgcactttggatatcctgagacaacgctgcgttcctttctttcagttcttcaatttccatttgcaggagagttatggtatcaatcgcctgctgaactttagattctagcttttcaaaaacttcaaatgacattctcgagccctcttttaagcaattccttgattgtatttagccagttaaggcctgtctagtttcatcctttcaatgttcgttataacgagaaatatagtgactaatccgaaatgcaagcgagatcacatttccatgatgaacaaaaccccagtcaaatgcgaattcgctcattttgttgacgcaacacgcagatttcaatttcgctatttctcgtttacgctcattaacgataaattcacagtcatctttcttttaagaaaagaaagcactaataattaatttcctctgttcttttttataggatctagaaatgagccagaccaccacaccaacattatcaggtcaatgcatttcagaatttttgggtactgcattgctcgttttcttcggcttaggctgcgttgccgctgcccgactggcaggtgcacaactggggctatgggaaatcagcattatctggggcttcggtgttgccctcgctgtttatctgactgccggaatttcaggtgcacacctcaatcccgcagtcaccatcgccttatgcctttttgccagttttgacagaaaaaaagtgctcccttacatcattgcccaaatgctcggcggatttgccgctgccgccattgtctatatgatgtattacaaccttttccttgattatgagcaagttcacaacattgttcgtggttcacaggaaagccttttcacggctggtgtattctccacttatcctgcgtcacagctatctgtattacacgcgtttattgtcgagattatcattgcagctgtcttactttgcctgattctggcactgacagacgatggcaatggcattccgcgcggcccaatggctccgctgttaatcggcattttgattgccgttatcggtggttcatttggttctttgaccggatttgctctgaacccagcccgtgattttggccctaaactagtcgcttatttagctggctggggagatattgccctgacaggaggcagagacattccttattgtcttgtgccgttggtagcccccttcattggtgcaattctaggcgcactcggttatcgaaaactgattgcccgccatttaccgcgtgcggtgtaaagttgccatattgaaaaatggcagcaaataaaaataaaaaatgaataaattaaataccaggttatcattatgacaatagaaaatatcactgaaaaaaaatatatcgtcgccctcgatcaagggacaaccagttcacgagctgtcgtactcgatcacgatgccaatattgtctgtatttcacagcgtgaattcccgcaaatctaccccaaaccaggctgggtagagcacgacccaatggaaatctgggccagccaaagctcaacattggtcgaagtgctggcaaaatctgatatcagttcagatcaaattgccagcatagggatcactaaccagcgagaaacaacgattgtctgggaaaaagaaacaggtaggccagtttataacgcgattgtatggcaatgtcgccgaacagcagatatttgtaccaaattaaaacaaaaagaaggattagaagaatatatccgccacaatactggcttggttgtcgatccttacttctccggaacaaaaataaaatggattctggataatgtagaaggcatccgccatcgtgctgaaaatggcgaactgttattcggtacagtcgatacctggctcgtctggaaaatgactcagggtcgtgtgcatgtgaccgattacaccaatgcttcccgcaccatgctattcaatatccacaatctcgattgggatcagaaaatccttgatgagctggatattccccgcattatgctgccaaaagtgtcatcttcgtcagagatttatggtcagaccaatattggtggtaaaggtggcacacgcattcctatcgcgggtattgcaggcgaccagcaggcagccctgtacggccaattgtgtgttcatcccggcatggcaaaaaatacttacgggacaggctgcttcctgctgatgaatacaggaacagatgcagtacgttccagtcacggcctgctgaccactattgcctgcgggccacggggtgaagtgaactatgcactggaaggcgctgtcttcgttggcggcgcgtctatccaatggctacgtgatgaattgaaactcatcgccgatgcggcggattccgaatatttcgccactaaagtgaaggacagcaatggtgtgtacgttgtaccagcctttactggcctaggcgcaccttactgggacccttacgcccgtggcgctattttcggcctgactcgtggtgcgaacagcaaccatattattcgcgccacgctagaatctatcgcttaccagacccgtgatgtattggatgcaatgcaggctgactccggcacacgcctgaaatccctgcgtgtagatggtggggctgtcgctaacaatttcctgatgcaattccaggccgatattctgggtactcgtgtagaacgccctgacgtacgtgaaagtacagcgttgggtgccgccttcctcgctggcctggccgtcggtttctggaaagaccttgatgaagtgaagagcaaagcgacaatcgaaaaagagttccgtccgggcatcgaaaccactgagcgaaaccataaatataatggctggaaaaaagcggttgcccgcgctcaggaatgggaagaccgcgcttaagaaaatacggaaatcaaagctctgacaagcataccgctctgtcagagccttttagcgggaatgcgcgttcccgccagatgctattacggttttatgaggccgtatgctcctggcgctgaacgcgctgggaaataggtaaccaacagaacaaaataagcagtgccatggaaaacatcagcataccgacgctgaactggctattttgcggcaacatcgccgacaaccatgtcgtcacgccagaaccaacattctgcaatccacccaccagcgcccccgcagctccagccaaataaggaaatggctccatagcaccagtggtagccaatggaaacagcataccggcaccgaaaaagaataaagttgcagggatcagcagtgtccagacattcataataccgaaccagccgggcagccacatcaatacgcctgccagcaaacagcacatgacagaatgccacatcagccgataaaacgttttgccatcacgccccgcataccacgcacccaaaaatgcggcagggatcggcaaaataaacaggatactgaccgttaagctatccaatcccaatacagcgcccatcaacacaccgctactggcttcaaaaaccgcgacgccagccagaccaccaaccagcataatcaggtaggcaacaaaagcactattggagagtaattgctggaaagaaaccagcatggtgctctgttttgtctgcacagggcgggtttccggcaagtgttggaacaaaaagaaggctactgttgcccccaatgatagcaggaaccaatagcaggcacgccaaccaaaataataaccaaccatgccacctatcatcggtgccagcaaagggctgaccagcacggccatatttagcagactattagcataacgcaacgacgtcccggtatataaatccctcggcatggtgcgcaccataacccccgccacccccgttcccagcccctgaaatacactggcaatcaccagcaccagcaaactggaggcaaacaatgcgcaggttgttgccaccagaaaaagggtcattccggccaaaatcactgggcggcgaccaatcttatcggataacggcccataaaaaatctgtgaaatcccgtaagaaaacaagtatgccgccatgactctttgtacttcgccagcaggctgaccaaaatcactcgccatatctgcaataacaggcacataaattgtttgtgtcatctgacccaccgcagccagagcaatcaacatcactaataaattaaagtgttctatttttctcatcgcatttacatacaatttatttaagtacagttgattaaactaaaatttatttaagttcagtttaatcaatggataacgcgcaacaacaaagccctcaggttttcaattaagtgcctgaagtaccgacttcgttagatgtgattgacttaacaaatttatattctttccagacaggatacaatttcacatgaagaaaaaataacagtgatattatccatatatgtcaataaaagtgtacatatataaccaaggcattggcataaataaagacaatcaaactgtaacacgtaatcgataagtctattcccgacaatcacgtagaattgtcataaaaatcatcaattcatgcagtgtttttttgtagagaggctaattgtaatggcaaactgggttacaggaaaagttaccgacataaccaattggacagattcactattcagcatcaaagttcatgcaccgattgaaagatttaccgccggccaattcgcaaaattggctctcgaaattgaaggcgaacgtatccaacgcgcttattcttacgttaattcccccgacgacaatagcctggaattttatttagttaccgttcctgaagggaaactcagcccccggctcgcagaattaaagaatggggaggaactcctcgttacagaacaggcagcgggtttttttgtccttgatgaaatccccgattgccaaaccctatggatgctttcaaccggtacagccattggcccttacctttccattctccaacaaggggagaatctggaacggtttgaaaatattgttttggttcatgccgtgagactggaacaagatttgagttatttgccgatgatgcaacaactagaaaaaaagtttcaaggcaaattaagaatccagaccattgtcagccgtgaaaaatgcccagattcactcatgggcagaattccggcattaattgaaagtggcgagctggaagctgccgttggtttaccgatgcaggcagaaaacagtcacattatgctgtgtgggaatccccaaatggccaaggacacccaacagcttctgaaagaacaacgcaatatggcaaaacacctgcgccgtaaaccagggcatatcaccagcgaacaatattggtaatcacagcatcgctaacccgctaatcagcgttttggggctggttcactggcagaaatatactcaaccgtttctgccatctcaccaaaacggtttgatccttccataccacgaaatacaccgcaatccagcacaatcataacgaaaatcagcgttggaatgaaacgaccaatcccccattgccagataggtgtcattgcgctccaatcaagggaaagcaatacccaggccaaaaccagcagtaacatccatccaccacgtttatttcggtcatgcagacgtttcgctataatcgctgctgtcgggtacaggatcaaagcgatacccgctgtagcataatgcatggggagggtgttcaggccatgcaaggtcaaaagcataaatatcagggcgaaacagatgccgataccgatccagaattcccgtcgcccaattcggcctttgaatgagaatccccattgttgtaatgtcatgtattcttttccaattgtggatgctgtttttccggtatttacactcaacgagtacaacatgaaaacaggcatgaataaacttctgatgacaatattaatcgcttttggtatcagtttgccattatccgctttagcaggcgagccttctgtcacaccggacacgcgctcacagttgatgtatttactgcctgattcccccactttcgaggaaaccattcctgtatttcgggaaaaatacaacaaaaaataccctgaaatccccctgcatgaatataaagtgattgtaagtaaagatatctccctgcctttcattcgtgccgccagcaagattaacgaaaaaatttattcttcggcagtactggaacgaggcagcgaaaaaattaaaagcctgcaaattaccctgctgccaccacaaagcgaacctgagaaagaacacaatctcgcactgataaaacagtatattactgcgctgatcagccaattcgagcccacgctttccccagaacaagccaacaaacaattagaaagacttttacaggctgcgcaaagccaccgatttttcagccaaaaaatcggtgcgatacgttatgtcatcgtaaacagcagcgaaaatataatgaccttcgcaattgaaccgattaagctatcgttatctgacgcacccgcgagcaaaaattagtgacgcagcgcagagctattcgcaccgatgatctttatactgtcgggattccacttatagggaatggcacaaatgctattccctataagcgtgttaattcagatcgcaatttgattattttctggttggagggaaaaacatgcgacatccattagttatgggaaactggaaattaaatggcagtacccacatggttaacgacctgattgcaggcctgcgtaaagaactgagcaatgttgacggctgtggcgtcgctatcgcaccaccaacagtttatgtttctctggcaaaaaatgcactggctggcagccgtatcgctctgggtgcacaagatgttgacgttaacctttctggtgcattcaccggcgaaacatccgctgaaatgctgaaagatgtgggcgcgaaatatatcattatcggtcattctgagcgccggacttaccataaagaaagcgatgagctgattgcgaaaaaattcaccatcctgaaagaacaaggactgattcccgttctgtgcattggtgaaaccgaacaggaaaatgaagcaggccaaaccgaagccgtatgcgcacgccaaatcgatgctgttctgaatacactgggtgccgaagccttcaaagataccgttatcgcatacgagcccgtctgggcaattggtacgggtaaatcagcgactcctgcacaagcacaggctgttcataaatttatccgtgatcatatcgcgaagcaagatgcagctatcgctggacaggtcatcattcaatacggcggttccgtcaatgccggcaacgcggcagaactgttcacccagccagatatcgatggtgctctggttggtggtgcatccctgaaagccgatgctttcgccgttattgtgaaagccgctgccgaagcgaaaaaggcataacacgatttaattgtcgctcaaacaattaacaataaagaaaatgcctataaaatctatggtccccaccttttttgcaacactgatttttgattgatgttggcttgcttaaatctatccggcgtcactatgggcagggatgcccgcgcctcgatgagttccgcacctgataagcctaaaaaaccgcacggcttcagagagccattttttatgtcaggattccatcaggtcgataagccgttcatgtcatcaataatcagtcttcgcaaaaccagattgggaactgctttaattaacgattaacctgccagtcagactggcgtcgtcgttacctttcgaacacagtttgccgtgttgtgattgcccaggctatccgggctaatttgttggccagcgcacaggccacaacatttgagtgttttcgctcaagctgagcctttacccattcagccagccttcctgactgataatcgattctctggataaagactctggcgcactggacaagtaaccgtcgcagatttttgtctccgcgtttacttatccctaaaagcgtatttttgccacccgtgctgtactggcgtggtaccagacggttgaagcagcaaaatcccggctacagccatactgcttaccatcgcccagctgcgatgataagacgctggcagttatcgga

SEQ ID NO: 14958 - DNA, 49405 bp, Xenorhabdus bovienii
  Genomic contig Name=Xb4151_4152.C417
caaaatgggcattctggcagaaatcggatagctggatgcgtaatgcctggcatcggctggcgtttgcgtgtgaagctaaggcgtttctgtgtttacgtgattttgccaaattgatccatgatgttgctcctttcttttgtcaaagaatagactccgtttgaggtaatggcagagtctatttggcaggtggaatatgcaatgtcattggtttggtctttctatagcaacaggccaaaccagaagataaatattcttctgacgctttatcacatgagtttctcatcctgaatatggatcatattcataaaaacttcgcataaactcacatttttaggcacaatggtgctgatatcatatttttttgggctaaaaagaaagggaaaaagatcccggccattctcaagttttctagttttatcgagcgattcaaagtagttgtagatctccgataccactgttttatgtatttcacttttaactaaatcatctctctgatatgggctttcatagtgtccgtagtacagtttacgaagataaagaatattttcctcttcgttttcatccatgggagacctgattaaagccataatttcatctgtgcgatcttgcttgactccggtaaaaaaatcattaatgcactgttgtaactgaggtgtgcattttccctgtggtttcggtcgttttacttcttcaaacgtgaactgttccgccgacatgttcagcatatccgtcatgatatttttaaattcttccggacactgggtttgtttcacttccgcataaacaccagggcgcgggcatacttttttaacatctcttgtatgaaggcaaacgacatgatctaatgagacttattttccttcttacttgcttacctatgactctgattgaacatttatccgttgtgaaagaaacccgctctgacattaatcgtcaatacgatctggttgatattattttcctcgttgtcagtgccattatggcgggagccgaaggttggtaagacattgaaacttacgggcaagccaaaattaagtggttacaggaataccgggctttttcccatggaataccccgtcgacataccattgcgagaatactgcgggctatcgagctggaagctttactgaactgggttaatgaacagcgtgagttaggcgataaacccgtcatcgcctttgatggaaaagccctgagacgggcctaccggaatgaaaagaaaaatgctgtccaattggtcacagcgtatgacaccgaacggggattagtgttgagccagaaagccacaaccacgaaaaacggtgaaattcgagttgttcgccaaatgttggatattcttaatctaaaaggcagtattgtgacgcttgatgccctacattgtcagcgtgaaacagtggaaaaaatcagtgaaaagaaagcgcatatggttgttcaggtaaagaaaaatcagcctaagttatgggctgctgtccaattacaatttcaggcggtgtttgatgtaggtaaagaacaaattgtcactgaagttaagcaagaagcgcatggacgtagggaagagcgctatgttttccagctcaaacctcaattttcccctgaaatggcagaaaaatggccaacaattcgcagtatcatcgcggtcgaacgacatcggtcagaaaacggcaaagacacggtagatacgtcttactatatcagctcactttctccccgacacaagtccttagggcactacatccgacagcattggcggattgaaaatagtcaacattatatccttgatgtggtttttaaagaggatgattcacgtattgttctggacggagccattgaaattttggcgttattccggcgtatcgtattgaatatggtaaaacaatgtaactgtggtgctcccagccaaagaaataaacttaaaaaagcaggctggagtgatgattaccgtgcacaagtgttctttggatagatatcaatcaaaatatgctcgcgccctgatatccatcctgctttgcgctactgaaataatactgaaagaaggtggtgacttctttcatcacttcgaatattaaaagtgttttgtaaatttttttagtgatatctcaaagaaataaccacgatattattatcgcagttatttactttcaattcattacttaaatgatatttattatcatcctcattgagatgtattatttattttccaataatcaatagaatctctgtttaaatccacttttccatctgggtattcaacccttgcacttcctctaggatatacaccaggcggattttctgagataataatttttggcattttgctctcatctaaaataggcgtgtaattgattttccaatcatttccttctataagccttaatccaaaatatgacaaccctccactttttccatataatcctattttatcaccatcatcataatctcttcttaaaaaaggataaatagttggtctatagtcaataatatttaaaaattctttcatctctttaggtttttctgcgccattaataaaagcttttataccagtaccatcataaggaacggctccttttattaactgattaacttcattgtagacaagggatactgtgacggtattgattttccattgacaccacccccctccgtggaaaggtactttttccttaaaagaacccgtttcagggtctgttgagatattaaacttgttccagtgatatcttgggaggtgatagagttttccacttgcagtattatgagtagcaagacatctatttgaagcataagtagtaactaaattaggtttagtgtttgggggagcaatgccttcaacagtgatccattgattattttcaggcggtgagaatggttcagacttatcgttataagtttgccaataacttgaaatagcattggatataaattcacatcctgttaagaacaaggtaatcggtaatattgttagtaattttaatgtagttttcatattaatcctttatcgtttttcaaaatatcgtttcaaggctcttggacctctttcatctttttgggttacttctaatgttattgccaattgattatcaatttcccttaagaaaaaatattcttccgtttttgccctttggaatatagctcgaatagaattaggctggctttcaagaaatgaaagatcttccggcttcctttgcaattttttatccggtgaaagagaacatagctctcgcaatctcttgtcaatatattcagcatataaggtgctgctatggtcaaaaagacctgttccacgtttacctgtagggttttcattaccttgaaagaatgaatgtatatcttgcattatatatctatctacgtttttttgtttttttataaatttttgggttgtttttatggtttcctcatttagctctgggagtaaataaaattttgattccgaatcagggagagcataaaaataaactaatttaccgtggtgtaaaaagggatcgttatcactattgttcgatttaataatttttgcttcgagagaaccagctgcatcaaatacttcgattgcgtatcctagaaatttacgacctgcttgaaaagcaacattatccatatccttgttaaaaggcacagagggaacaaaatcattttcattaacatgacgataatgaataatttcagtgagttcttgcactgcactttgagtgaacaaacgtggcataccgtaggtatagaggcaaggattataagatttgagctgtgcactatgtaacagagcgagggcaccacccaagctgtggccgcagacaaatagttttttactttctgttaatttaatgatttcttcaaatactgtttttttatcattcccttcagaaactttgatttctgtaattagatgaaaggcatcccaaaaacccttatgaactttccctttttcgctaaagccacttgatacaccattagctgtgcttcctaattctatcggttggaaggttccatccgtcatcaaatcttgtgtttccgtcatttcagtaccacgccaaccaacaataatctcctgcttgtttgcggcgtagaagagttgagtatgccctgtatttccttgtacttttgaatcaatatagacaaccttagtatagcgctcactgaatggaacatcataaacaacaggcataaaacgctcatcattaacctgataaggtgatcgtgataaatcgagcaactgtttattaaaaaagtgtgtaactgaaccccaatgcccactgttgtcattggaataagtcaatatactcatcagtgaaaggttataggcattaaccagagaatagtctttttgatgatgcagtactaaagaccatgccctaaatgggcagacttcaattacataacgatagcgttcgaatgcagtgggcatgacttcgatgcccatcggttcactatctggaaaatggtagcttggaagaggatcttcttctttccatccctcaatgaccggaattttatcaaccagttctccaatttttgcataacgatactgacggcctgatttttggctttctgcaaaaacggctgaaattttggccatagactcagtagagcgtgtgtactcatggtatcgcttaagtctcaatggccgttgttccatttcatcagccaatttctgtccatcgagaaataatctaagaggactcgaagtcaagtgttcttcatggatcataccattgccatcggtgattccttcacgagccattttatggtttttcaatgtgtaaggcatattggtgatgggtttattatgttcatcaacaagctgaatttctattttgttctttaacattcccgaacaatcatgacaataaatcgaattagcattactcataaataggcgctcctattatttttcttgttccattgccagcaggtaatcctgactggatattttttcaatccgttgtccggcttccagtttttgcctcaaccactgctcaatccggggttctaaactgccttctggttgatcccattgcttcgccattgcaccatggttttcccataaatcgttataaagggagctggttaagactttcagaccatagggagaacgtaaccagacggccagcaggtgctcgcccagcgtaaatgggatgtcgctgttaccctctccgcagccttcgggacgggaaaatcgtgccggttgcggtgtgtcaaccatcaattctgtgactggagtcagcatcagtgaccaatcgctgggcgtgaaggcgggcattagtgtgcccaatatccgagcatccatcatgcgaaatagcaccggttcgccattcatcatcacccattgtcgctgttgccagtgtttaagctgttcttgccacggtgtatggctgcgataagcccaaccccaactgttgtcactaagttcatagcgatccagcgctgcccctatctgagtgaggtgattcaccttcggttgcaccaaccacggactctgcttcaacatattgcgcatcggggttccgctatacagcggaaatgcctgctcaacccagtcatgatggtaaaatgactctattggattcggttttgccagcgagttgagaataaaaaatacaggcgctttactgggttcattcagccagacttgccaacttattgcagatcctgtgctctccatagtgatagctctttccattgagtttactctttaacaggtttaatgactaaactggcatcctgctgcgccagttctgcacaagccggttgcaccggaaattcagttaccgggagtgcttccgccatcgggagtttccctacttgtgggagtggctctaccccttccggcaattgcagtgccagcccacgcccgttaccggccgaaccctgcccgacattaatcggtgaacagagaatgccagccggggtgactttcagaaaactgccgcccactttcagcgtgatttcagatgccgcttccagcacgactttaccgccgcttttcaggtggatttcctgcccgctgtcaatcacggtggcatcaccggtctgggtatgctggctgcccgcaatccggtgggaaacatcgccttcggtggtgattttgcgggaaccggcaacctgatgatggtcatcggcacggatgtcgtgataacggttgttatcgatacgttgtttctggtcgtgtttgatatgccagagggcatcgttttcgatatgagctgtaaaatctttctggccgtggaaatagatttcttcactgcctttcgcatcctcaaagcgcagttcgttaaagcctttgcctttatgggttttggtcttgaaggtggtgcgggttttctgggccggcaaatccagcggcgggcggttcagcccgttgtagacacagccggtgacaatcgggcggtcgatatcgccgttgaggtaagaaatgatgacttcctgcccgatgcgcgggatcgccataaaaccaaagccgttgccgttccagccctgtgcgacgcgaacccagcaggatgcgccgtcatccgccttgtcgtaacggttccagtggaaatgcactttgatggcaccgtctttattgacgaagatttcttccccctcagggccgacaaccgtggcggtttcatcgccatcggccagtggcttgtaatggaacggcggacggtagtcggcgaggccgtcgataaaactgaaatggttgctgagtgtggtaccttcaccgctgttatcgcccagcgcctgcgggcagcgcccgtgatggctgataccgacaatttgccaacgagcattgagcggtagatgtgggtgactgataatttcgaagattttgcccggcatcagtttgatgcagttgctgttgccgctgccggtctttttctggttatccagcgcttcgtggcggtatttgagaaacggtttggcggcagcgtctttctggaaacgcccgtagctttcaaacacggtatacggggtttggctgccgaaatcgcggaaaccttcactgctggccatatgggagaggtgataacgcggattgtcgtagttaaaatccttgtggagactgcgctgcgggctcatcccgacgcctaaccgcacctgataaatggtatccagcccgtgggcggtttccggttgtgggttgtaggccagcggcaggccggcggtcatgcccagatggctgtcgctgaaaaacagcgtttcatcctcaaaccagaaactgatcccctcttccgcagctaatcggctgaaaaacccataatcggattcgcgtttctgggtcacgtattcccggtcctgatgggggtcatagagcttcgaatccgcccgcactttgtgctttttcagcagaccattcaggatagcgggcacattttgctgatggaatatccggctctcctgattgagcttcaggcgccagagtgccgggcgaacggtcagggtataaagggttttattgccgtcggtgccggcccagtcagcgtgagagatgataccggtgattttacgctgcacctgtacgccgtgaaagatttgcaactccgcttcctgcatcagtaaagcggtcaaatccacctcgtctaacggcttgaacggattcaggctatgggttttgaccagtgtcaggttcagggtaaacaactcagataacccttccagcagggaaaactcccccacgctgaacgtatcttcgggaagccccgcgacctgaaaagtaaaccgcaatccacttttggcggcgggcagcctgtcaatgatattcttcatcatgttttgcttgactccttgttgtgagggtttgatggcttacatctctctgcgcgttccatagacttccttaaatgcccacaagacgccgctgttgtttgaggtataaaccgccagcctgacgaaggtggactggctgataaaacacgccatggcttcattgattaaccggcagaagcggtacatttctcccggattgtggtaacagtcagggttgagtgtgagccccacccggtgcccgcggacaggacgtccccgtttcatgcggtcggtgaggtgctcttccacccggacaatgccgtcgatatgccggcggatatggcggctcagcgggcgattgagttcggggtaagggtcaaacaggcggagcaactgtttcaggctgtcggtggcaaataacaacaccggcgggctggagaggcaggaaagcaacggccagccggaattgtcctgcaacagggacgggtaatcggcggagacggggagaatattgtgtacgttgagatgggccggggaaccttcctgcgtgagggtgatttcaccgggttttaaggtgatggcctgcgtgtgatagcccagaatatcacccacgacggacaggacaggcaggtgttgagccggtttgccggtcaggtcaaaaaaatgcagctggtgcgtgagcctgcccagtaaatcacgctcgttctggagcaaataataaagcgtctccggctccccgtcttccgccagactgggcgatgacggcgtaaactggccgatgggcagataacggtagggcgaaccccgttgctgtgtttcatcaggttgctgaaccacctgaatatcgcgcagccggaacaactgcacggactcgccaagaagcaggggataacgatgattgccttcattcagcggcaggggaaggctggtcagggtttccagatgaatggccggaacacagcccagcataaaagcatcgtcgacattatccagcggcaactcaccttcaaaacgaaaaaccagctcaaagctgccgtcggcatttaacggaacgtcccggcaactgtcactgatatccaccgtcataaagtgatacaggtggggcagtgcataatattccagcagtaattgcagtccggcataagtgcgatttcccatcggcaggaggagagcatcgaacaggttatgccagccataagggaaactattcagtttgcgttgttctccctgcgttctgaggtgcatatcacagatatgctgatccagccacaaagttaattgtgctgcccgttcattatccgtaccgaggaaaaaagacagtgatccgctttgccagacaggggaaggcgtgcctgtctggcaaagcgtcagcactatctcactgtgtgtgccggttttcttcactgtcctgtcccgcacgataaggggttcgatatgcagggaacggcaggttttaaaggtgagtaactgcccgttgacatcggcggaaactggtgtgcctgccgggatgtcaacggtgccctgatgttcgccgtcggtgggatgaaactgcatgactgttgtgggcggaatgggactcagggctgacggccagatacgggacagaatgccgtgggtaatttcggggagatcatcctcaattttatcccgtaagcgggcaatcaacagggcaaacgcttcgaaaacacgttcagtatcgggatcatgggatagggtcagaaaatcggacaaatgcggcgagtctttcgccacgcgttgagccagttcccgcaggtaggctctttcccgcaggtacatagactccttgttgtttttcattgggtttctctttttatcctaatgtacagatgaataattaatcggcatgctatgcataaagtttatataaaatcagtatcctgtcagtaatggcggcttattgtacgggattattaattagcatgtttaatgaaatttaattttctgatgatttgggaaaaatcttagccacgctatccgtcatggtggaaagggcactgagactggggtgtttttttacattctgcaaaaatgaattgtttgctgacttttgtgtcggctttcttcacgctgctctgacgttttatgacatgggaagggcgcgatgaaaaagccgggtttactgctcctgatgggatggatggtatcactgtccgccggagccaaaactgtgatctataccgacagtcagcacccgccggttaatttgccccctgaggcacaggtcatttggctggatgcaccggagcaacagcaaaggcagatctttgcacgccttcccgcagacccacaacaggcggcaacccaagcccggaccatacttcagtctcctcagtggcgcgggcaggaacagcaacttatcaacgcttaccgtgctgttgtccatgcccggcaagccggtgtgcgcaaatacccggcggtggtatttgatgatcgtgacgtggtgtatggcacggccgatgttgccaaagcgacggcgctcagggagcagtatcagccatgaatacgtcacgcctggcttttccggtggttatcacgctggccgcggcatgtgcgcctgtcacacaagccgccattaataccgcccaaatcgtggccggcagtctctcgcccgcctgtattcagtggcaggtcagtggcatttgttactggctgttttgttcctggcacggctgtacggtgaaaacctcggtcaaagtgacccatttcctgccgcaggcggtggtctccacctatcatgcgcccggcggcaacccgtggtctgaaatggctcacatcagcccgttatccggcggactggaaaatgcggtaacgggggcgttatccggcctgaccaccggcggcggtaatcacacggttcaggttgccgggaagcgcagtccccgtctgcgtttcaaatacgccgatgctatcgggcatcccgctactacgctgattggcggacaaatcccggggtattcctgtcgcagtgcggccacaccgctgatgccctattttctcagcacactggatactgtcgcgtggcgcagcggactgccggagtcgctttatcctgaagcgcttgttcccggtctgcgtgaactgggcagccagccggtgggcaatatgtggggcaatctctacccccgttccggttttgtcacgcaggctgatgaggataaagccgctgccgtggtggcacagcgggtggcggacattatcacccgtaccgggcagccccatgtttatcagccactggccgggcaacgccgtgacggctactggccaccagagccgatgcaagaaaataccggcacgaaaaatcaccaatggcaacggttgtcaccacagttaagtcagtcctgtgcagtattcccggatggccgccacacagcggcggcagacagcaatcaggcgtatgccctgtggcagccctacagctgttgccagcggcgcgggcaacgttttctcggcagtacggcaatataaggaaaaaacaggatgagaagaaaatcggtgctgctgatagcgggtgggctggtcgttgcctcggtacaggggcagacatcggggctgtcggtggccttaccggccgtcagtcacagtgcactgggctatggtgcacagagcagcggggcagtctccgatacgctgttttataccctggggggcggctcggtgatttctgagccggccagtcgcgcggggtcaacccggctggccgggctggaactcggctggagttcggatttgatgtgcggaaattttgacctgaaaaccacggtcagtaatcagctcaacggtatcacggcgggcatgaaaaacctgatgagcgaagtcattcagggggccaccggagcggttgccagtctccctgccatgataattcagcgagccaacccagggttgtatgacatgctgaccaacggggtattgcaggccaatgtggcgtttgataaagcccagttcaattgtcagaacatggcgaagagaatgatggattttgcgcagaacaacaaatggagccaatcagcggcgttgcaggagtacaaaaatcaggttaacggcggggatggtgatgctgtgcgtgtcaataatgccggaaccaaagcgaccggcgctggcgggcactcgtggattggcgggcaacgacaaggcgggaaggggcagaatgccattcgtccgacccgtgatttagccagtgccggctttaatatgatgaatcagttgccggtactgagccagtcatcggtcagcaccttcaattgcgagggcagcgcctgccgtaaattcagcacggcgcgggaagcggccgaggcggtggtcagtgtactgggcgatcgggccatccgcacctgcgctcacgcggcagaatgcagcagcgggggtgaacaacaccagccggggacaacggtcgcgggaacggggtttgccccgatgctggaagcccataccaaaacgaacgccgaacacctggtgaaactgatcagcggcacggagaaacccacgcgggtgaatctcaccaaactgaaaaccggcagtctggccgtgacgcagggggtcattcaggcgttgcagcgtgaccccgataaggccgccctgactgcgcgtctggcgggggagctggcgatgagcgagaccattgaaaccgcgttactgatgcgccgaatgctgatcaccggcatgtccgaacccaatgcggcagcacaatcggaagcgctggcagaaggcgaccgccggattgccgcactggacagggaaattaatgccctgaaaaatgaaatggagctgaagcaggcgctttcccgtaattccattctgaccattattgagcgtgatacgcagcgtattcacgctcatccgcaaaaacaggtcgcggacagtcaggatgcccgtttttatcagttggaagcccccaaccgtgaggtcaggtaagttcgacgatggcaaaaaaacgtgcaaggttaaaacgaggaatcggattatcactgattatcgctttggcgatggctgtgacgttagctaccggctgggcagggatgaattatcccgacaccctgtctgccttaaatcgcgggatggcaaggcatcaatcgctttggctgttgtggcggttaagcctttacggcgggctgctctggggcggttggaaaatctggcaaagagtgaaacatcaggcggaatatcgcacaacgctgaggcggatgatggtggtcagcctgttgtttatcctgctgggtgaatacgccctgtcagccagtcagggaagtgtgtcatgaccacgaacagttatctggaatatttcctgaccctgctcggttgggtggtgaataatggcctgtggcatattctgattgccacggggttgtttaccctgccgttagtggtcaaagtgattgccatttggctgaaagtgcgggagtgcggggaggaagaaggccccaatggattgcagtcactggcccggattgaaaatacgctctacagtgcgtttttcgtcatggttttctgctgcgtgccgttggtgaatgtcagcttcagcaccctccagtatgataccgcccgggccaaaagctgtggcacctggacacccggtgcaccggagaacagtggttatgcgccggtgatatccagcctgaataatcaaacggcggcagtgccgatttggtgggctgtggtgcatcggttatccaaagggctgacgcaggcggcggtggccgccattccctgtcggccggatttacggcaactgcgttttgacgtgcaacatacccgtatcaagagcccggcattggcggccgagttgcaggattttacccacgattgttatgcgttggcattgtaccagtggcaacaacgcgatccggaacacaccagcgacccgattatcctgaatgatatcggctggctgggcagccgtacatttttagccggcgattaccggacgctgcaatcgcgcacgccccgggctgatttcccatggcaggagagtcgagacaacggccggccgtataccgggcagggcggctatccgagctgtcaggtctggtggtcagccgccaacatcggcctgaaagatcgggtactggcgcaggccgacccggggttgtggctgcgtctgtctgcgacactgaaaatgttgggtaaaaacacgcccgcttatcaggaagcggtgatccgccgtctggtcagcccggtgaacctgacggtatctcaagccggccaggtgtatgccggttatgggggtaatgccgatcccacgttgtgggatggatcgacccggataggggcctctgctggcgcactgttggggggcttactggcatatccaatgttcgatgcggtacgccaggccctgccgatgatgcaggcggtgattttgatggcgttgtatatcttaatcccgttgctgctgttggtggccgcgtatgagtttaagaccgtgtttaccctgacctgtgtgatttttgcgttgaatttcctgaccttctggtgggaactggcgcgctggctggacagccatttgctggacgccctgtacggctcagacacccacagcctgtttaatctggcgggcatgcagaacacctcggatgatttaatcatggggctggtgatggggacgttgtttattgtgctgccgatgatctggctgggggcgctggcctgggccggcgtgcggatgggcgacgtcggcggcctgatgagtcagggcgtgggacaggtcagacaatccgctgggatgtttgggcagatggtgatgcagaagatgatgtcgaaaggaaagtagacaaacccgtgtttacaacgtcagggatacgcagttatccctgaattgtcgtttgggttttaggtcaattttctatttttttgcctgcttgatttatttattattgcctcgttcatgaaaaataaaataaagatgtttaacaagatagataaatgaatcatttaacgccaatgcgttattgatttaatttattctattttatgatgcaggtcggttttatattggtttttgtgtcgttatatttcatattgggattttaatacgcaatattcatgaggtgactcacaaaaaagagaataaacccatgccattttatttcatgtgacttacactgtaaacgctgtaatgcttaacatgttctatatcaataatgtcgttttaatgataatagacgatttatagaagcctcagtggttgaagccattgaggcttcgccgtttagtgtcattaaataaatgcgggggaaattcgacttaccgatttaatttaattttttcgctattgaattcaatataaaaaggattaaattggaacgccttaaatatcgtctgaaaatgttcagggaaagtcatgcgtgatattgataaaaatcataaaaataagaaagttaaaaaacaatccgatcattttattccttacaaaacgacgtatgatttgcggttaacaaaaagagaacccaatttaatcaacatactgatgcaagttcaggggtatgaatatggtttttttacggtgttaggtgtccgccctttatcacaacgcggtaacccgaaaagcacatccatttatgtcgtgcggtgccgatgtggtaaatacgccgtcagatcactcagggccatcagaaacccggcgaatatgaatgatatgtgtgagcattgtcgtcacctgtacaacctgagacgcagaaaccactttcttactgaagggaaggatgttgatttgtcagaattaaccggcattaccgataaaaagcccctggacattaaagaataaaggaagggtattacacttgagtataagtctctgggcgcgtgaaaatcgtagggcagagataatcgcactgacattgacccggtttgatgcacacgctaccatcgaaatgtaattatcagtgatctgttcgcctgtgaggatcacccatgcgatggcgaaacaaagctcccgtagcctgcaagggagcgcattaccctgtggtacatctgcgcacttttggaagcagatatcgtcagacaataacccgtcgtccgacgatgaaagttatccggtgtgattcacgaccggcttatcatgcaatacgaacagcgcaggctttgcgttgtcccgaataccgacgataaacgtcctgaatgttgtgcggcgtcacttgcgtaaaagcagcgcgattaccaagtgacgccgccgggcggccaacgtccagagcacgtccggactggctttacaacccatttgatccactcattactcaaagtaacccgctatctcgggcatttttctgtctgaatcggcctgtttcgtttgtttttttaacccactgcctggcaacaggctgataccgaaaaaaggagaaattatccacgtcacgataatgaggcgttcatcctgattgaatcaggcactgaacggggagcatgtcatcgctgtgctgagcacgtcgcgagctcctgcaaaaactcaacacaacctcgccctgctacacattgtctgacgcaccacggaacggtgaacctgaaccgacacgcagggatttgtttaaaaataaataaaacagcagcaaagcagcaggagatgcgaggatggcgcagaaatcgacacgttcaaaagttgagttgttcaggaaagaatttattgcctgtgcccgaaacgggcacggaagttttgcgacggtggcggatcgtgagcggattgcccggcagtttcttcactttctgaaagaaaggggcattaagctccggcagatggacagccttaaaacaaaatatattgagcactacattgcacagagaaaggctgaccatatcagccaccgaaccctgcaaaatgagatggctgcgttgcgaaccattttagcgcaggccggaaaacacaagctggcggcagccgataatccgcgtctgagcaaccgggtactgggtattgctaatacggatcgcaggggaacaaaaatggcgttaacaccgacgggatttcaggcggcttttcagcaggtcgagcgaaaagatcggggtgtggcagcggtaatgcagctggcgtatgtgttggggctgcgtaccaaagaagcggtggaagccggtaaatccttagccacctggaaaaaagcgctggagaacggtcatacctccgtgcggatagtattcggcaccaaaggcgggcgcccgagacagacggtcatactcgatcgcgtagcgttgcaccacgccattgattatgctgagcgcgaacaggcaggccgcagcggcagattaattgataagcccacgatctatcaggcgatagaccgttaccgttacgtggtcagacgtgccggactggtaggtaagcaagcgccacacagcatgcgatatcattttgcccaacaatctggcgcacattataaagcacagggtttcagtgagcgggaagcgctggcactggtgtcaatggatttggggcacggagatgggcgcgggcgttatatccggcaggtgtattgccagaatattgaggatgaataagctgtattggctcatacacggtcagaagatttgctcattagaacacgagcaaaccaacgttgacacttagctgattactcacatgttatctctaacttgcttctggacatggatgagttaaagcatttgtttaatttagcattttccgaattaattaaggtatgataaatcagctactgagtggtacctagcccagatggaccgcttttttctatcagttttgacagtaaattacgcaattccaatacactcaggactgtcagttccaccgacgtttttttctcctgtatccgcaaaaccgccagcaccacatgggccaataacgtcagcgtagtatgccggtaccagctttgccatcgccgcacttagtaataatccagaccacattatcagatgtgtgcatcaatagattcattgagttttgagtctaaattattcggtctatctatcagaatttttacattatttatataatactctatgccagcagacaaatctgcaataaggttatttatctcgtcgttaagtgcaatgagtttattagaattttagacaggatagttgctttagaggaaagtcctttgattgagaagccacgtgtactaatttgctggataggcaataaagatatagagtccgccgaaaatgatgagattggaccgattctggcgacgctacaagattctgaatttgaccgctgttatcttatctattcttatcctgagcggcgtgttacgccttatcttgcatggcttcgcaaacagactaaccttcctgtcaccgcgcatttcgaagcgctcagttcaccagttcactttggcgaaatttatgaggcggcaaataaacatctacagcatattgttgcctccggctcggagttatgcgttcaactgactcccggtacacctgccatgcaggctgtatgggtactgcttggtaaaacacgttactcagcgactttctaccagtcatcgcctgagaaaggcgtagagaaggtggacattccgttcgaaattgcggccgaatatattccggcggcaaataccattagcgatgaaaagatagtccagctttctgcttatggcgtagcggtgaatactgccttcgacagtattattacccaaagtaaacggatgttaagactgaagtcgcaagctcaaattttagccaccaaacatgtgcctgtacttatttatggcgaaacgggcacaggtaaagagatgttcgcgagggccatttgtaatgcaagtccgcgcactagcgccccatttattgccatcaactgcggtgcgattccccctgagttggtagattctacgctctttggtcactgcaagggagcatttaccggcgcggtatcaaacagcaaaggtgtttttgaacaggccgatggcggcaccctttttcttgatgagtttggcgagttaaaacccgatgtgcaggttcgcttgttacgcgtgttacaggaaggagtcattaccccggttggtgcgagtgaaccagttaaagtgaatgtgcgtcttatcactgcaactcacagcgatttgatgcaagaggttggtaaagggcgtttcagggcagatcttgtttaccgtattgcagtaggtgtactgcatcttccgcctttacgtgaacgggaaggggacatcttactacttgcagataccctcctacagggcatttcggaacaagatcaatcgctacaaaataaacaactttctgttgaagctaaaaactttatcctcaggtgtccatggcgcggcaacgtacgtgaattgcattcaacgctgttgcgcgcagcgatctggagtccggatgcggttatcactgccgatgatattaaggaggctttgtttatgatccctgaggaacaacaaggtacatcgctggttgatattttggaggggatagatttgcaaaaagtcatctcaaaaattgccaacgattatttatatcgtgcacttgaagtcaccggaaataataagactcatgcagcgcagttactggggttaaaaagccaacaaacctttacgaactggctaaaaaaacatcagatagaataagtccatgaccctattattttctcgcttagggtaaatttaattctctataccctgtagcgatcgcgtttcagagcgttgattttaatccatcgtagggatgttatttagaataatatcggtaaaaaattttactttgcggtaattttatttatttttattttcatgatttgataatttaattcatttaaattattgatattattgttttttaaaagttggcacgaagtgtgctttactgtattcgtcaatcaacaaaaagggaatatacacatggcagagcttaaaaaatttcagattcaaactgcacgtccgctcccagttattgtgctggcggataccagtggcagtatggcttccgatggaaaaattgaagcccttaatcaggggctgaaagatatgctgctcagtttcaaagacgaaagcagattgcgcgctgaaattcaggttagcgtgattacctttggcaataacaaggctgaagtaaatttaccgctggcgcctgcacatcttctgcaagactttattcctctgagcgcagaaggttcaacgcctcttggcggcgctctgtcgctggccagccagatgatagaggataaaagcgtcattccttcccgagcatacaaaccagttgtggtgctggtttctgatggttatccaaatgatgactgggaaggcccgttctcgtcatttgccagtggtgagcgttcttccaaagctacgcgttttgccatgagcatcggtggggacgcggatgaagatatgctcagtgagtttgcaaatgatcccgaagctcctctgttcagagctgagaatgcgagcgacattcgccggttcttcagggcggtgaccatgagcgtaagcgtgcagagccggtcagcgaatcccacgcaatcaacaccactccagatttctgccgctgacgatcaggattgggaattctgatgcgcctgtccgcaggtggtgcttctgtgacaggtccagcgcatcttcagaatggtcttcctaaccaggatgctttgtccattagcggcttacgcggtggctggagtattgctgttgctgacggcttgggtagtcgacctttaagtcatatcggttcacgtaaggccgttcatctaatcaggcatttggcccagcgggggcaaaacttacaacacagcaacattgctcagtggttatgtcgcgactggcttgcgcattttggcgatgagtaccaagcctatgaaacaacctgtctctgggcatgggtagacgcgaaaggtcatggcgtggcggggcaaattggtgatggtttggttttgataaaaagccagggaatttttaacgtgctgtctggtgtccgagctggattcggcaaccagacggcaactcttgctcaggctgccccttccgagtgcagaagccaacggattgagttaacccaatccggcgatggcgtactgatgatgactgacggtatcgccgatgatctggttcctgaatcgctggaatcctttttcgatgtgatttatcaacgccaactccgcagcaataaacgccagatgcgtacatggctgacaaaggaattgcagaactggtcgacgccccagcatggcgatgacaaaagcattgctggtttttttagaatggactgaaaaaaatgacttcgacaacgaaaacaagcaagaaacccgaagtgcaggatacaaaaggttcgttttatgagcttaaaagggaaatgagccgcgggggacagggcattatctaccgcactcagtttccgcaaacactcattaaagggtttaccaataaagatgagctggctcgccagcactggcgaaatcagatcgcatggctaatcaggcaagatttgagtgatttgaaattagcgcgtcccgttgcgctgctggcggagcctcgctgcggttatgtaatggagctaatggatggtctggtgcctttgcagagtcttcttgacagctttctcaacgccggggaagagtcgctggccgactatcttcaggcgggtgggttgcgtcgacgcgtgagaattttgagccagctggcgagaacgcttaatcagcttcattcgcgtggcatgctgtacggcgatctttctcccggtaatatttttgtctcggatgacccgaaacacgctgaaacctggcttatcgattgtgacaatattagcctgttcacgcacagtgggctgacgtttcatacgcctgattatggcgcgcctgaagtcatccggggggaggcgcttttgtccagcctgacggacatctggagctttgcggttatcgcttatcagttgctgacgcataatcatccctttaaaggagaggtgattagcgacggcgagccggaactggaagaggaagcgctgcgcggcgagcatccatggatcaatgacggacaggatgagtcaaatcgctgttatacctgcctgcccatgcagctgattgaacacagtcggctgccagaactgtttagccgttgctttgaacagggaagaattcgcgctagcgacaggccgactatggctgaatggctggcggcattaacagaaatcgatgagcatttgtacacctgcaaacactgcggtggcgatactattctccctgctgatctccccgctgaagatgtcgcgtctcatgacacgctctgcttcttttgtgatgaaccggtggaaagcgagctggtgctgttcgaggagttcctctccgtcgtagaaggcagtgaggatcagctcagcgagcaggttaactggatcccgactgggcgtaaagtatggttgcaagtgggggatcgcaaagaattaaaacgtctgttacctacctttagctacgatcgctggccggaagatcatgttcgtcttgaatataccgaaaagggtctgggcatccatgctttgccgcaggggcagttgcacctgcaacagggcaaaaccattaagcagttagcccgctatcaggggctgaaagcgagtctgcgcggacaaaatgctacggcgtttcagcttcatatcggtgagttgaacgcatcgcacgtgctttggcaattcaagtggtgaggcctcatgaatattaacgatttcccgatgatgtccgaagatattctggtgctgtctacggatgagagtacggatggctttgaggcggaacaggcgatttttatccggcctgatgagcagaaatggttggccgttcagggcaataagtacattagcattacctgcggtcctgccgatcatgagttattcagtcgccttgtgctgtgcgatcaggttcgctggcggctcaccctccttcagcaaaagggaaaactatgggtgcagtattgtacgccggttgaagtatccgctatgcagcttgaattgggtgttgatgaattcattgctgatgatctgtacggaaaacaggagattgccgataagcgtattgaccttgcctgcgaatggtttgctgaaaattttgtggttagtgggctgaaagagggggactggctcacgattgctcggttcagtaataacagcatagcaggcagctttcagattattggcaaaggctggcgtgctgatgtagagcgcaagagcgacggtgggcttttgataaaacgtgttacgcgccacctgcgtagtgacagcgctttttcgttgctggttggccagttttctttctgtgatacctctgttgcggtagtactcaaaaaaagtgccagccagcaagcattactggatgcggctctcagggacaataccagttacctagagttgtggaatctgtataacgaaaaagagtggcaaaacgagttgagacgtgctgaatccctgcgttcgctgcgctttatcgattgtgtgggggtggatgaggggcaagacaatgcctggcgtttgacgccgaaatcgctcgatgactaccgggagttccaaaaacggttgcgtgaactcgaactgcctgcggatacgcaatatgacctaggcacggttgctccagattgggcagaggaactttcgatggatgagagcagagcggcggccaatattccgcgtggcatgctacgttttgaagctgattatgtcttcttcaaacccgcgtctaaccgccgtgatattcgtccgaaacaacctgacgggtggctgtatctctctttggcgggctaccgtactgcgggtaaacgccgtctagccgcgaaacaaaagatcgattcgggcaaacggatgccgcaattaaaatggctgttagaaggtattcctgtgcctgccgcccggtacagaaccatcccgggattgacgccctacgcaaaagaaattttcaaaggcggcaagccgacagaaatgcaggaacaagcgctggatgcggctctgaatacgcctgatttggcaatcattattgggccgccgggaaccggtaaaacacaggttatcgcggcattacagcgtcgtctggccgaagaagcgcaaaaccagaatatcgcagggcaggtattgatcagtagctttcaacatgatgctgtcgataacgcgctcgagcgcagcgatgtgtttggtctgcctggcgcacgtgtgggcggcaaacacagagcggatgacgatgagtcgttgatcgattcctggctcgaacagcagaccatgcatttgcacggcaaagttcgggatgaacatgccagatacccggagcttgagttcttcaacaggttatccatcaagctggcctttgcccgcttggctggcggcccgaatagccgccgtgctgaggagttcagcgctattttgcaggatctggaagaactggaaaaaatcggctcaattccgttatccatgcttaaaagccagcttgaagattacattgagcaattgcgcaaacaagcgtcggatacaaccgacagtgcaatcgataatcaactgatacagcgaattcgtgcgttacgtgttgacgctgtttcattcaacgacgatggttccgatcgcgcttgggatcttttgcgctggatacagcgttatgacttggattgcgctccagaacgggtgtcgctgttacaggcggcggcagataacctttcattatcgacgtcagacttccatgaactttctatgtggcgggagcacttactggagcaatttttaccggattaccggcctgtggcgctaaaaaatcaggctgatccggcagggttggcgctacttgatgacatcgagcggcatctcgacggtaagttgcgccagcgcaagcaaggtgtggcctgggttctcgagcaattggctgatagcctgacggttgacagacgtgctgcgcaaaacgtggtgaatgagtactcaatggtggtcggtgcgacctgtcagcaggccgccggacaacaaatggcgaatttgaaatccgtcgctgggctggatagtagcggaattgagtttgagaccgtcgtcgttgatgaggcggcgcgcgccaatccgctggatttgtttgtccccatgtcgatggcccggcggcgcatagtgctggtcggtgacgacaagcagctgccgcatatgctggagcccgatatcgaaggacaattgcaggaagaacatcagcttaccgaggtgcaacgggcggcatttcactccagcctgttcgaacgtatgcggttaaaactgctggagctggaaaagagagatcagtggccgcgggtcgttatgctggatactcagtttcgtatgcatcctgtgctgggcaattttatcagtaagcaattttatgaatcagcgggcatgcgagaggtgaaatccggtcgggatgtggcagattttgcctttgatgagaaaatgttaaatgcgcttggggagttggaaccttacttccgagatcgcgtttgtcagtggattgatctgccgcggtctgagggaaaagataggactcacggatccagccgtgtgcgcgagatagaagccacgcgtattgcacaggaagttgaacggctggtaagagcgggaggggaaagcttctctataggcgtcatcacattttacgcggcgcagcgggatttgattatggagaaactcgcccaggtgcgtattgacggggttcccttaatggaaccccgtgatggcagtttcgagcctcatgaagattttcggttagcgcgaaaagtgcggggcgatggctccatcagctatgaagagcggctgcgcgtcggctctgtcgatgcgttccaagggaaggagtttgatgtggtgttactgtcatgcgttcgtacctttgatccatctaagccagccttaggggctcaggatgatgcagccgcgcgggaagcccagttaaatcgccggtttggttttcttcgtttacccaatcgtatgaacgtggccatgagccgccaacgtcaaatgttgatctgtgtgggtgatgctgtgctggtaactaatccggatgcaaaagaagcggttcctgcgctggcggcactctaccaactttgcggaggcgtgtatggcagtgttcgctgagaccggtacgtatatggcgttcagttctcatccgtatgggaagaaggagccgcttctgtggccggtgatggtgcatcgcgttttatacccggacgcaaaacgcccacagctcaatattttccagcgagcggtgctggggcttattcgggcccgcgtaacccgtcctgaaaccatggcggagttgactggactccattccagtttaattaacttgatattggtgcaaagcgccagccacgggtggcttgttgataacgcagacgctctcaccgcttcaggagaacgtctgctggatgatgaggacgatgatgcagcttcttttaaatccggttacctgttgcaggatgctgtcactgggcaattttggccgcgtctgattactgagctcaaacagattgaacccgtgaacgcgttagccaagtatcctgaattcatcactgagagaaagaccggaaaaccgctgcgtccctatgtggtggcctccaacaaaggtcgtttagcgcaattggatcctgacgtgcttatgaaggcgtataaaaactatagcaatgattttcgtgccagccgacagctcgatcagttacggttagagccggaaattcgactacagggcgtacagcgtttggatgataatcctcaatccgctcgggtacttatctgggttacgcccgacaagcgtggcgcggatctctggtcggtaaaagacccttttgctttgcgagaaaatgcgccatggctgcaagaggcattgcggcaggtcattgagcgtgacgcgtttttgcttagaaggcttgaaccgctggttgagatccctcaagccgaaaaccaaagtgttaccgagtggcttgcggctgttcagcgaaatattgaatttacattgctcacggaatacccgtgggccgagaagcagcctgatatcaagcgttacatgacggcgctgttgatctaccgagaaaaaattcagcatgctggcgccaacgaacacgaactggaagctgcaataacggagtgccagaaattactggaagtcgtcatgcaatggttgattcgtaccttcccggcaaatgtggggctgttgccaaagtataaacagggaaataccagaaatgcgatcaatcaggttatccttgagaaactgaacattccgtccttcactcaggacgtcattcgcatactctccggacaacatttcgacaaagttgagcgagcctgtcgccagccgacggattcacttaaggcgctcctttttgccgctgcaattggagcctacaacacaccacagcatccgctcaacgtacttgaagatcgggaattgcaactaacaaaaatgctggaactcgccaggttgcgtaatcaaagcggccatggacagagcagctacaccggcaaaaccgcagttaaactcacttcccagagtgtactggagagtattcagtatgccctgagtgttacggaacgatttgaggaatggatgtaatggctaagaagaatcaccaaaataggaaatacaatgcgcctaaaataccgccgcaaaaaatgacgccgccgcttgccgcggcagaaaaagctaacaccgatgtcgccctgagcgcgtcttttgtttctgcatcagacctcttcgcatcctttggtatgacactggatatcgatatgagcggggaatgcttggaaagtatcaaggcgcgtacccaaaaagaaggtgaagagtcgtttgcccggtggcttatgcaatttttccaggcgtgcgaagcgatgaaaacgctcaaagaaaagctggaagaagaacaaaaggaggttagccaacggttactcagccacgatgaaaagtcgcagagacttgctagccaacagcaacaacttgaagacgaaaagcatgcgttaaaacttgccagagatggggttgagcaggaaaaagtcagtattgtaagcaaacgcgctgaactgacagagaaagagcgcgtaatgaatgaacgggagattaacgcgcagtttggttttgccgaacagaacgcgctgaccatgcgccagcttgaaaaacatcaggctcaacaacttagccagcatcaagagcaacttcagactctgctgagcgaaaagcgccagctggaagaggagcgtcatcgcgcatccagtgaactggacgcgatcaaatatcgttgcactgaagctgaagctgagcgcgtacgtgcgctggacttgcgcgagcaggatattgaacaacgtatcaaagcagtagattgcgagaaggtacgactgaaacggtgggaaaaggagctggatgcggaaaaaaacgatattcagaaacgcgttagcgatgaaattgaacgggaattgggccggcacagcagcgaagtaagccgaatgcagcggaagttgcagaaagcctacgatgattatgacctgctgaaaaatgaacatgcagactttcaggatttgaagcatgccatggggaacacgcctgtcgccgcagtgctggagcggcttgagcgctttcaggcggagaacaacgagctgattcgtaaacagcaaagctcggacatggacgaattattacgtgagaaagacgcactcagcaaaagcaaatataacctcgagaggcaatgctatgcattaagagtggaattagatgaaacgaagcgtgagctgagtggcaaacgtgttgccgccaccgaactgcaaggcatcgcgcttgagaaacgaacccttgagtatcataaaaatgcgctggaattacaaatcaatgaactggcaaacagtatcgagcacctctctaatgcgcaaaaaacacaaactccgttcccggcgatgtctctgatggatagtgacacacagtatcgagcaagaacggagcttgagactgttgacgatctcaaccagttcgccacggagttgcagcaccgtattgcccaagctgaagagcatgtcgaactgttttatccgctggaagagatccaagtattactcggcggcctggcgatgagccagttacatattttccaagggattagcggaacgggtaaaaccagtctcgcgaaggcgtttgcaaaggcgatgggcggttaatgagatggtccccaccaccctgtgagcggtatgctggcagggtgtttctttcaggagaagaccatcatgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtgataaaaagactttcaaccgtcttggcagagaacgaacttcctccctatctggcacagttgctgatgcgcttacatgcccattatctttatcttgtcgaacagctcaccgagcttgagacggcactggagcaggagctgagacgtgatgaaacaggacagcgtcttcagacaatactgggcgtgggtccgataactgccagcgtcttatcatcgcagctgggcgatggtaagcagtatggctgtagccgggattttgctgcttcaaccggtctggtaccacgccagtacagcacgggtggcaaaaatacgcttttagggataagtaaacgcggagacaaaaatctgcgacggttacttgtccagtgcgccagagtctttatccagagaatcgattatcagtcaggaaggctggctgaatgggtaaaggctcagcttgagcgaaaacactcaaatgttgtggcctgtgcgctggccaacaaattagcccggatagcctgggcaatcacaacacggcaaactgtgttcgaaaggtaacgacgacgccagtctgactggcaggttaatcgttaattaaagcagttcccaatctggttttgcgaagactgattattgatgacatgaacggcttatcgacctgatggaatcctgacataaaaaatggctctctgaagccgtgcggttttttaggcttatcaggtgcggaactcatcgaggcgcgggcatccctgcccatagtgacgccggatagatttaagcaagccaacatcaatcaaaaatcagtgttgcaaaaaaggtggggaccatagattttgatgcttctggctcaatgtctatcagtgtggatgtcactccacaagaattacagtatttgttgcaaagaaaagccttcgaatacatcgagcgagaacccagccgtattactctggccaagaagtcggcgaagaagattatcgataaattgccttcagatatgaatatcagtctggtggctgcgttcgattgcaggcatgtttccgcgtcattacctttttcgcctacgcagcggccagtattgaaacgggcgattgatcgtattactccggatggaaaaactccgctggcactggctttggaaaaggctggggctctagtggatggtgtgaatcgcgatgcgataatcttattaatttcagatggtgatgaaacttgtggcggtgatccctgtgctgtcgcccgtgcgttgaaagagaacaaaccccggctacaggttaatgttgtcgatatcatgaatagcggtgcgggaaactgcattgccagtcaaactggtggcaaagtattcacagcgaataatgccaatcaattcaatcaggtaataaatcaagcaatgcaggattatattccggaaaattgcaatgagtaaaaaaattatgttaagcaaagtattttccagataaatacatatgcattggtgagcattatcgcgcaataaaaacagaggggttttactgagctttctgttgtcgttacaatggcatttttaggcaaaatgaatatatcaacgtcgtattttctgatagcaaggaacggcttcttgtgaaaaaaacttttttacgtggtgataaactcgaaagttatctgccgctgggagaaaatggtcaggctgtgcatctctccgcattacagttgcgagaaaccttgcgcctgcggcagctctctgatgttgctaattcactggcaatcccacaaggcaatgagcagggtgatcggatagattggtatgccggcttttcaggtaacgtcgttccctggtcggccgcaacgtatgatgaacgtcagtcagcattgcggcaactggaagctcatcaggctgctatcgaacagctcagtgcacaaatgatccagcaaaaggcgcatgaaatgcgtctttttggcgctttgctgagtaaaactatccagttccccgatcaggagcacatctatttggtcgatggcaaacccgtggtgactttttggggatttgtcaatgcgaagcagcaggctcgccccaatcctcttgaatgcttaaggacagtacgttctgtgacgccatcggttgcaccaaccgaatctacggttgaaaccgtggttgcaacgccgccgcctgtatccaaacgttctcggcgttggctattgcctcattggttgtggtggcttctgcctctgttattgattttactcgctctgttgttactgcgtggttgcctaccggatgtccatatttgggggatgacaccttccacccattctacaccgccacttcaaggtgaaataatctcgaaagaggggaaacccgtaccagaacgatcagttccagctctatcagtgagtgaatctcatgctttacctcttgtgcaaggaatgagttccgtcaatggcacggcttctgttaatagtactgagtctgttaatggaacttcccctgtttcaccagaactgaatccgattgaaccgatgctcccaactcagccgataccgccagttgcggatggagtatccaatggcacgccgaaaccttccctgcccgagattaatgttcctccagtaaaggtttctccgcctgctgaggcgctcacaatcccagatatcgcagtgcagcagggcaccactgattttttcaatggtagctggcacgcaggtgccggaattcaggatagtcgtactggcaaaccacttagtctgaagtatcagattgcagatggtaaagggcaggttgaaatggcgcgcggtgacggtgttcattgtcaggctcccgttaaggcagtgatgaattcaggtgcgctgcaactggataatattggtgaagcgaagtgtagcgatggttcggtttacacgatgcctgaagtggtctgtcaatcaggcagcgaaggcacagcagagtgtcaaggacgttatgacgaaaaaactttatttcccatgtcgatgaagcgagaggcaaattaacagcatgctggcaacgattaccgatttcaaagaaaaagtgacattgattcgtgacagtggcattcagtttctggattttgctttcgcgttacccaaaaaaaaagaatacggtgaatttttactgactgaggaagataacccggtcattcgtctggtatataacgaaagagatgagaattttcttgtaccttcagcgtcaggttcgtctgcattcgctgcggactccgattactcgctggtactggagaaatcccttgaaatatacaatgacatatggttaccgctgcccttcttccgttttaactcgtcacggagttttgcacaggggccgactaactggtcgcgagtgaaatttcacgcactggatacaccggatgagcagggaaatacctggcgggtgactttggcttttgataccaaagtgtctccagataggcgaaatacccagtatctggagcctgtcgatgatgatgtgcgttccggtgtgagctttgcactggcagagactcatcatgagatgggcgattttctgttgctgaaatgggtggatgactggctgcgggaaacctataccgaacgtgccaccacattgtggcgtcaatatcatgaagatactgaaaactgtttgaaccggaaggaacatcaagcgcattatctcaatttgattaatgcacttaatgtgttgttgcaggttcctgaaattcagctcaacgatgttaaacttcaggataaccccattaatgtcgatttagtgctcgatattggtaactcacgcagttgtgggatcttaattgaagaacaccgagatggtgatcaaggtctgtcaaatctctatcagcttcaattacgtgacctgagtgaaccgcagtatatttataccgatccttttgacagccgtctggagttcgctcaagccgaattcgggaagcaggatttttctgtcaaaagcggacgcagcgatgcgtttacttggccgacgattggtcgtgtgggtgaagaagcgtttcgtatggcctcacagcgtttgggtacagagggctcaacggggctttccagtccaaaacgctatttgtgggatgacgcaccttactcccctggctggcgtttcagccgcgcctttgtgaaatcggatcgtgaacctcaggcgacggcgccgccgatgacctacatgatcaatgacaaaggcgaggcgctttatgcacttaaaccttctgagcgtatgccggtgtttacgccggaatatagccgcagtaccttgatgaccatgatgttgtctgaagtattggcacaggcattgatgcaaattaacagtccggctcaacgtttgaaaatgcgtcatgccagtacccctcgtcagttaaaaaatatcattctcaccgtgccgccggcgatgccaaaacctgagcgcgcaattttccagaaagcaatgacacaggccatcaggctggtgtggaaagcgctggattgggaagatatggatcagggtgttgatgaaaacggtcgggaagataaaaacgtctcccgcaaacgtaccttgcctgacgtgcatgtgaaatgggatgaagcgacctgtggtcagttagtttatctgtacaatgagacacaaaactattttggcggccggagtgaagagttttttgcagccacagtgcggcctgataataaacgggaagcgggtaatgatcgcacgttgaaaattgcctctattgatattggtggtggcacaaccgatttggtgatcacccgttataccctggatgaagggaacggcagcaatgtgcgtatcgttccgacacagctattccgtgagggatttaaagttgcgggtgatgatattctgttggatgtgatccaactctatttgcagcctgcattcgaagccgcgttgctcaatattggctatcaagatttagatgctgaagcattaatgtcgcgcttattcggcagtgaagcgttggaggcaggcaaacaggtgctacgccagcaattgacactgcaaatattcgcgcctgtggcacttgctattttgcatcgttatgaaaaatttacgccagaggcgggtgagcaagttattagtgcaacgttcaatgatctgctttctcatcaaccgacggataaagtttgtgaatatgttgatgaagaagttaagcgtagtttaccggcgggaatagaaaacccattttccattcttaatgtgccgttaaacatcaatttgatgaaactgcataacgaatttatcgatgcccgtcataaccgcatcaatatttgcggtagtttacgcgggttgtgcgaagttctctggcactacaactgcgacattttgttgttaaccgggcgtccttcccgtctgccgggtattcaggcactgatccgccacttacagcctgtaccgcctgcacgggttctccccttgcatggttacgaaacgggcggttggtatccgttcaataaaaaaggattaattgacgatcctaaatccacggcggcggtgggtgcgatgctttgcctgctggccgagaaatcacgactgagtaacttctatttccgtacggccaattttaagccttattcgactatccgttatttcggcatgctcgacagtaataatctgctgaaagacagcaacgtattttatcgagatattgatctggacacccctggattccagttggataaccagcaatattttgagtctcgtggcgaaatgcggcttggcttccgtcagcttgacaatgaacgctggtctgccacgccactatacactttgaaaattccgggaacgcgcttagcaacagctttatctggtgatgcggtattgcgactgaaactggaggtggaagaagggcgtgggcaagaagctgaaactaacggaagtcctgaaaagttccgtatcagcgagatggatatcgtcgaatctacgcagaacccgcgtccacaggacgtcagtttcaaattgaatactctggtcgggagcggcttgggtgaaactcattattggctcgacagtgggagcattaaaatctgatgaaacattttactcccgaacaattaaaacaagcgtggcttgacgtggcgcaaggggcaggtcaggcgattgaatgggttgaagaggttcgtgggaatgccccgcgtctcaacacagaagcggatcggttgaaactgaagctgcgccgtagccggaataccgcgcagagattggccaaagcggctactcatcccatgaccattggtttttttggtttatctcaagcagggaaatcttatctgatctcctcattggcagccggggagaacggccgtctggaaacccagatggggtcgtatcagcttgattttctcgaacatatcaatcccccgggtggcggaaaagaagccaccggtctggttacacgctttagccgtcacgtgcggccatctaaccctgattggccgattgagctacaactgttcaacgaagcggagattgccaaaatcttcgctaatacgtttattcatgatttcaatcaggagaaaatcgactggaattatgatgaaaaacgcatcaatacgctgcttacttcactgaacgagcgacgtcaggcgtataaagtaccgggggtggcggaagatgatgtggtcgcgctatgggactatctgatccgtcatgcagaaaagagccagagcaaaatggctttgcaatactggccagcggcggtagagctggcaccttggttatcgattgatgatcgtgctcagttatttggtgaattatggggcaatatccatgaattcaccgaggcttatcgccgatttgcacatacgctacaacgtctgggaggtgccagcgttgtcagagcaccacttaatgtgttggtcactgagcagaatggcaggttggtacaaactaacagcattatgaacgtcgatatgctggagcgcctgaataagagcaacgatttgcagattacggtgtgtccggaacgagagaatgggctggccgcaccggtatcagtttctctggcagaactcactgcactgactgtggaattgcatgttccgttactttcctccacgcgagaacggttatttgaggaagtcgatttgctggacttccccggttatcgtggtcgtctgggggtggaatctctgaattatctccagaacacggctgaaagcgacgacagcaatccactggcacagttaatcctgcgtggcaaagtggcctacttatttgagcgttacaccctcaatcaggagatgaatgttctggtggtttgtacgccttcgaatgaacaatccaacgtgaaagatgtgggaggtgtactggatgaatggatacgttatagccagggcgctgatgctgacagccgcgcacgtcgcccggcaggattggtctgggcaatcaccaaactcgatttacgtattactcaggagctgaccaaatcagaagatatgctgcgtgaagtctgggggcagggcgggatgatcaaaatcgccatgaccgaacgtttcggccattttccctggatgcaggaatggcagcccggtcgtgcctttaacaatgcatttctggtgcgtaaaccgtgtcaggccacgccattcatcacaatgaaagagggctgcgaggcggagttcagtcaggaaactgcttccaagctgaccttgatgaaaaaaactttcctcgaagatgctgcaatccaacgccatattgcctcacctgagcaagcctgggatgccatgctgcaattagatgatggtggtatgcgccggttagcggattatttaggcatcgtcgcccagcgtgaaatgaagttagagcgcattactgaacagttaaatgaaacgcgccatgaactggtgaaaggaaatttacacgcttggtatcagcctgatggcgcagaagaagtggagaaaaaaaggcttatctccgaagatatcctgaaggcattacagaaccgtgccggaaggcatggcgaactgctggcgggtttagttcctcaacggaaagcactgcaagagctttatatgcaggaagctgaacttgatttatccatagaaggtaaagatgaaaacgaatccatcgctgccttcgggattggcagtgattttgatctcttcagtgatacgccggatgaaaccgtctcggctcacagccatgaacaggaatttgctcatagagtgatcaaactgtggatcaattacttgcgcactgtacctgaacaaaccagtatgacggattttatcgggctttcccgttctattgtcgaaatgttggtggatgaattaatcaccgcgatccagcggatggacgtcgaaggtgagctgatggcggtgctggcgaatactgagcaggcgggtgtacggcgggaaaaaatgatggagcgtcaggtatcccgcgtgatgcacatcatgaatgatttcattacgtggttgggctatcagaatatactgagtgagaaacgcccggcgagccgcattaacaaagggcaacctatttttgcccgtccggacaaaaaagatcctgccttgtggaaaggtgacgagcgcctttatcggctgacaaacgaacaactgaactacagtgccctatttatctatgactggttgttcggcttcggagaaataatcaaagaaaacgcggggcattctgcgggacgcgaaattaccgccgttcagaatgaacggttgggcaccattattcatcgtattcaactgtcgtcggagtaacgagttgtgattaaaccagagctgaggccttatgaaccggttgaacccggatatgctgtgttgcgcattgaggattggcagggagctactgaaggcgtcagggtatccatccagcgtaatcaggatcgctgttttctgaatggtcaggggcagtgggttaacaatgaagagtggctgatcttgcctgagttgcaggaagtcgatggtgcggtagaagcccgtgttggccctgaattggttgatgcgctgctggcggaacgtcaggtggcgtatcgcgttacggtaatagacgatatacagcgtgaggttggcgggctgaaaattgccaatggggttttaagttccttagccaaaggggagcataccccttctgacaacgtgagtgaacatgtgcctccggctcaggaaccgccagtctcaatgccgacggaaaccgcctctgttgaatcagtcgttgaacttactgtatcaaaatcccatgagctgccggagcctcagccaatacctgtcaatgaacggattgacgcagcagcatctgcatcagccaaaaaatcgaacaaaggaatgctgattgttctgactttgctggttgttgccggtgtactttggtggttgctgaaaccgcaggaaaagccggagcctgtcatatccagtgcctcagcaactgctccttgtgcgatggaaaatatgaccaaaggcaacgggctggagtttgttaaaagttgtctgcgcagccagccttccagcctgcaagtacaggaaattatcagtcaggcgaaaaatgcgggacagtgtgatatcgcacagcggctttatgcttataagtcgcagtcgggtgataagcaaatcgcgctgcgttatgcccaagaatacgatccgaaaacggcgacaaagaagggttgttttgttgcagatgcgcaaacggctatttattggtacgaaatcctgattaatcaggatccgcagaacagtgaagccaaagcccgtttagcggcactgaaaaaataggaaagtataatgaaacaccttaactggctgaaggcggttttttccgccttggtgttgatggcatcggcaggagcattggcagcacagaaaccgcttttacaggaaggaaagcaaacactctatcagcgcgtactcacctatccaggctgtgagctgtcggcgaaggtcggtgaaaaagggaagatacaacctgctttcagccgtttttacgtctaccagcgcgaaaaacagggtagcgaagaatggctatgggttggtcctgatagctatggaaattcccgtggctggatgaaagccaactgtagcgtagattggaaaatgcagctcactttggcttttaccaacccttcaggtcgtaacccgatgttgttcttccgtgataaaacggatgtggaaaagatcctgaacacggcgaaaccggcaacacaattacagccgttactgaatgatctgaaagcgggcaaatccgttccttctgtgctggcgcgtgaaccggattatatgattgatcagcagaaaaacttttatctgctgccgatgctgggttccgatgatatttttactgacacgggctatcaggttcgggtacttaatgtcgcttcggtgagcgaagccggcaaaacagccagtgtattatcaggtaaaaacgccagtacctctcccgataaagaaaaaaacatgatgaaaggcttctcggcatcggttgtttttgtgattgattccactatctcaatggggccttacattgatcgcactaagcaggcgattgaaaaaatctatcagcgcattgaacaagaaaacttacttggtcaggtgaagtttggtctggtcgcttatcgttcaaacgttactgctgtccctgatctggaatatgacagcaaaatgtatgttgatcccaatacggtcaaagatggtaaagattttctggctaaagtgcgcgaccttaaacaagccaccgtttccagcagtaaagtgaatgaagatgcttatgccggagtcatgacagcgctggataaagtggactggacaaaattcggtgcccgttacgtgattctggtgacggatgcgggagcgctggaaggggatgataaattatcttcgactcagttggacgccactcaggtgcgtttggaagcaacctatcgcggcgtggcactgtatgcgctccatttgaaaacaccttcaggacataaaaaccacgcttctgcggagaatcagtaccgtgatttgacgctcaatgctttcttgcacaagccgctttattatccgattaactccggtgacgtgaacagttttggcacgatagttgataaccttgccaatgccattaccagccagattaaaacagcatggcggggtgaagagaccgtaggcagcgcgctgggtgccaacgaatcctatatgggtaaaaaaacggagttatccaaagagcctctattacatgatgctgcgttgttgggacacgccatgcgattagcgtatctgggagacaaacagggaactcaagcgccgcctgtatttaaatcttggatcagtgatcgcgatcttgtgcatcaaaatattccggcgacagaggttaaggtgctgctcaccaagagtgagttaagcgatctgagcgaagtcatgaagaaggttgttaatgcagcgaatgaaggtttgatttcgccggatgatatgtttgccagcctgcgttcattagccgccacgatgggaaatgatcctaaacaggcaaaaaataaacaggcaaccaaactgggtgaaatgggattactgggtgaatacatcgaaggtttaccttatctcagtgaagtgctgagtctggatgaagatacgtggaaaagttgggatggtctggaacaagagcgctttatccgccgtttgaatactaagctgaattattaccagcgctataacgaagatgtagatcgttggatttccttggcgccagacagtgatccgcgggataacgtctaccccgttccgttagaaaatcttccgtaatgttgtacatccaatcgatgcagatacaacgcgggcaggcagatcaaggttttaccgtcagcctgccccggttgtcgctgaatgcaggagaaatcgctgcgttaacagggccgagtggctgcggcaaaagcactttgctggagatgatcggcggaatactccggcctgacagtttggaatgttaccagttgggaataccgccgcgtgatattactgcctctctgctggagggtgaggaaaatcagcttgcccaagtgcgtgccaaggatctcggttttgtgttgcagcatggcgggctgcttccttggctctcagtcgaacaaaatatccagttgccccgccaaatagccgggctggtggcgcgttctgagtggctggatacggcgattacccgtttaagtattgccggactgatgaagaaaatgccttctcaactttcgattggggagcgtcagcgcgtggcctttgcccgtgcgattgctcatcagccgcaactgttactggcggatgaaccgactgcggcactcgatcctcacaacgccgaaacgcttttcagcctgatagtggaaatggtgaaagcactcaatttagttgccattattgtgagtcacgactggcagcgggttacggattttggccttaaacgctacgccgctacagtggatggaaaacaaagtgtctttacaacctgttaatgctaatacacgaccctctcgcttgcttttgccccgtatggcgctggctgatttaattcacgatcgcaaagttgcgctttgtattattttttcgctgattgccgtgatcacgcctctgttactactgttcgggctgaaaaatggcatagtgagccagcttcgtcacaccttgctggatgatccacgcacacgggaagttcgtatgctgggtaatggtaactataaccacacatggttgatgcagcttgcggctcgtcctgatgtggattttgtcattccgctgactcgttccctgaatacgcaggccgatctggtcagagatacccagcgttttgtcagcaatgctgaaattattccgactgctttacatgatccgctgttggtgaatgccaaagagccacaaaatgaacagcaggttgtgctcagtgccagtgccgcagagcgtttacagataaaaacaggggatagcctgcggttagtaattgcccgtaaacgggatggtataaacgaacacgtacaacatacgctgacggtcattgatgtgattgatggagcaaaattcggccggccagctgctttcgtcacgctgctccttctggtggctatggaagattaccgtgatggttatcaagttaccttattcaaggtacatgatggtacgccaacccgtgaacgcaccacttttgccaaagcgcggctatacgcaaatagcattgatagcgtggcggaattggcagagtggttacaacagcaacacatcgaaacgataacacagcaggcggaaattgaatctgtacgtgctattgatcatgttctcggtctgatttttactgttatcgcctggatatcggccactggctgtattgcttcattggtaggggcttttatggcaaatatcgatcgcaaaagaaaagatatggcggtactcaggttattgggtttccgtcgtcaggctgtggtgctgtttgttttaattcaggcgttgcttcttactggcagtgcctggggagtgggtttactgctctattttgtcgccagtcagttatttaataacgtgctgggcgcttcattacctgaaacggcgtttgtgtgtcatttggaaccctggcacctgctgatggccttattaagtgttctggtagtcgcactgggtgttgctgcggtgggagccttacgcgcgttgaaaattgaacctgcggagagtttacgtgagatttaatcatggtttgaatatagcattggcagggctttttctggcaatactgccgttttctgccagtgccgtctgggaagaaaaatactacaatcccaagccactacccgatgatgtaatattgccgatgccctgtgagggcgcgatggcgtttcgtaaagtttcgattccccttagtcagccgttgcaggattacagtattacccttggcggtggggcaaatgacgaatggggttatttagaacaggcacgtgcggaacatattgcgggtagttttgccgaaggtaaatccggcaaggggcgttatttcctgatggcgaagtacgagctgacagatttgcaatatcaggcactgacaggccagtgtcctacaccgaatatgaaactgcgtttgtccaaagtgaacataggttgggttgatgcgatgaattttgctaatcaatacaacctttggttgctgaaaaaccagcctaaagcgctgccggttgaagatggcaaaccgggtttcctgcgcctgccaaccgaaacagaatgggaatttgctgcccgtggtggtttggctgtttccacggcggaatttcgcgatcaacgtttcccgatgccggaagggataaccagctatgcgtggttttctggcactcaatcctccaatggtaaacttcagcttgcgggattgcttaaacccaatccgctgggtttgcatgatatgttgggtaatgcttctgaaatgatgtttgagccttttcacttaaataaattggatcgccggcatggtaaagcggggggatatatcgtcagaggcggaaatttcctgacgccgcaaagtgatatacgtagctcactgcgcggagaagaaccctattacaccgggcagagtgataataagaataaaaccctcggatttcgtctggtgctggtttcgccgacattaacttcgcgcgatcgtatcaaagaaatcgccgaggagtggaaagcattaggcacagacaatccgcaagttaaagagaaaaaatcacctgattccattgataacttaggcagcatttcagctcaagtaaaggatacggcgttaaagaaacagttggaacagttgcgtgccgatctacgggcgaatgcacaattgcgtgacgaacaacgcgatcaggcgattcgcacttccctgcaacttggggcatttttgtgtacaaaattaaaggatgatggtgaattttacgatcggttgaacgggttgtatgaaaaaacctgtaaggcgggcagtgagctggatgcgaattgttcccgtcgacaatcacagttagatcagcataaaaaagtgctcaattttattgtcaattattatgctgacaccttggtggatatgggcgttacctataacgcggagcttatttccccacaaattcgtgttgttcagcaacagatgtccgcccgaggaaaaacgaatctgaatggttatctcaatacttactggaagaatcttcaggagtactggaagaacggaagagttgcacgggatagttggctggagtcatgtaagaagaataattaacagtaatcactttatttaagaaaggatatataaaaaatggtactgcaatccatgcgttctatgatttctctctgcatgatttttctactggtcgcctgccaaacgccgcaaggcccttccgcgcagacgggaaaagtcgattcccgtctgactcagagtcaggacgttgagttttttaataaatcaggctggcaggcttgtgcggcgggcgcggcggcaggggcacttgcctgtctgctcatcaatggcgaccatcaagcgatatgtattgcggccgccgctattgtgggctgtggcgtaggggtaggtgccaacgcctatctggataaccagcgcacaaaatatgccagcaaagaacaactactggccgcctcaattaatgatgttaaagcagaaaatcaacgtattaaaaacgtgactgctacagtcaaagaggtgattaagacagataaactcacactggcacagattaataaggacatagcggcgaaggtcgtgaaaaaagatcaggtgcaaaaacaactgaagggtcttgatgccaatattgtttatttgcgcaacaccattaaagaaatgaaggaacatgaaaatcagtggcagaatgtttctactcagatcgcgaaagacggaactaaaaccaaggatctgaataaccaaattgtccaaatgcgcaaaaatatcggctcgctgcaacaagagctggatagtctgtatgaacaacgtaccgcgattaaagtgagctgataaggagttctcatgcgtatattgatgatgttagtaattagcatggcactgaccgggtgtgtcactaatgcacaagagtgtgatcccacggcaggggatatgagtattattacgaaatttaattgtaattactctgggacttgggatcagagagtcgttgataaagaaaaagtgctacagcatgaacagacactgaataaagaattcaaagcggtttatgacgctatcgagcgcgagaaaaaagcaggtcagacgaatctggaaagtagaaaacgctctcaggtcgcattgcaaaagtcgttgaatcgcctgtttagtcaattgaaaactaaagccgcaggcaaagtgaaaatggaaaaacagatcgctgaactggaaaaacgtatgcgtgaagcgcagcagaagccatcgcaatctgaaatgcaaaaacaactggaattacaacagttgcagaaccagcttaatgaacttcaggacagcctgatgataccataatcgaatgtagagcctatgcaagtaggcctcttggttgaaatatcacggtatatatcctataactcctcagctcgtcttgatgatgactataaccattaagacgggctgagttatttttcattaaaacacttgttccggcgttacattatccttttatccatattaataacctgcctattatcaatcagaagcacagcaaagactgtcagaagatgtggctaataatttcattatactaaagataaatttacattttttaataaaataaaagtgtttacttctttttatatatttaaatcgatatatatgtataatttatgttcgtattatgagttctaagggattggataaaacaaactaataagggttaatttatgaaaaaaattatattaccactactattatctatgtttttggttgggtgtggtggcgaaccaacatttgatgcttcgaatgatgaagcgatgaaagcctcggctgaaaaaatggcgaaaaatatgtcacctgaagaaatggaaaaatttgaaaaagcgtttttgaaactctccatgcagtctgttttggttgccaaagatggagatgatgcgttaacgcttatgaaggaaaaacttaacggcaaaacggcaaagcaaattattgaaatggcagagaagtaattttcacattacaggtaatatagttgaaaaacaggctattaatgctgaataaagcaagcaggaattaattttaagatctggcagataagtcacctctcggtgactttctcatatatcgaccaaaatgcgtgcccccggttcttgttctcccggaacatcattgggattacgtaaagggcagtttgtcagtgaaagactgccacagcagatgcagctatcgctggtgtttgagtgcagttgtggcgtgccattcatctattttttcattctgaaatgaaaggtttgaatataatcaaatggtgtctgcggtaaaaatttgtacgacatcagtgaagtttaatgaaaaataatacttagtatgttcatattcatagtgtttttttaatgcatcacggtcaatgaatttctcccacataacaaatatggctggattttcattggattgctgtatggaaaatatttcacatccgggttccaataatgttttttcttgtagtgatttaagtgctttgacaacgatattgagattaacattatctctggctttaatttctgctgtgacaaaatatccgctttgatacatagaattttccatataattgtttaatgtgtgatataaaggttttttgtttagttgtaaaaatcaatatacacttaaaatactgtgtaggctaaatgataatttatttttttaaaaaaacttctgatgaaaaacagtgaagtcttctgatttattgacttaataataacgataagaaaatagtttatggaattgttcgaaagctgttatttggttatccagattgataaaatatgaagattgccatttttgcgtttgaatcgcttgttttgaaataggggatacccaagatgggtaaattcgtatggctcttttccctgctttatcctgagtggaaaaaatgccttttttaatcagaatatgagtgttgaacaaaaaaatacctttttggttaccagagtgtgttgcaatcatgcagaaatcgatattatccctttgctcaaagggcataatttctgagtcaggagtaggtcgtttccatagtgtgacaaattgccccattttattcggtgttgtttttgcttggcggaaaactatcgttttaccattaattccaaagcgtatagcactgtattcatggctctctttttcttggtagggaatggcactgaattgaaacccagcggggcgtaagaaggatttttctatttcaataaaggaattaggaagatgatctgtatttgatggtaatgaccaactaaaattttctaatggtaacaaactatactcctttgttgactttaattaattgtgtgattttatattataacgtaaattatatgtttctttattttattgtgattattttaacttgaaaattaaattaattccaataagaataaatattctattttttgaattaattaataattgatattatatcttgattatcacttttacagagcgataatcgcctgactgatcatcagggatgctgtggtgagtgtgttattattaacctgaacctgaaatgagtcattcaatggagttcgtcattccgagtaaaccacaactgttgtgctttaataaattcggacactttggtaaaggaatagaataactttaattaaggtgtctttatgaaacgaaaatcaccccaaaaatttaccgataactttaaaagagaagcggtcaatctggttgttgaacagagctatacagtcccacaggcagctgaaaccttaggtattccaacaaaactcctgtatacgtggcggaaacattatgttgagcaatctaaacccagtgctttaaccccccgatgagcgacaggagttgttgcggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttacccttttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccgcttaaatccccatctctccccattattttatgatgtgggctttaaatatttaactatgggaatagtttattttcagtattactttcaatgaagaaaacttacacactttcaatctaacgttattttatataaatcatatatccttactaaaaagtgagattgggatttactaatctactatgtaattatagtatcatatactatagaagcctacattttaacgtaaaacaacaaaattgtaactttgtgttaatccagcaagagtcttctattaagtagccgattaattactttatgtactattatgtgttctaaaattttatagtgtatttaactaaattacaggaggttccatgagtagtagaagtgatgtaataaaaggaaggttagtttataccgaaaaat

SEQ ID NO: 14959 - DNA, 69409 bp, Xenorhabdus bovienii
  Genomic contig Name=Xb4151_4152.C418
agagtttgaagaaaagtcttctgagtaagttttcagacggtaaagtgttctgaaaaaattcacgaagtgaaaattcaaggtcgcaagttttaaagcgaatggtgaaggtggccgagaggctgaaaggcgcccccctgctaagggaagtattgtggttaagagcttgcatcgagggttcgaaatccctccctcaccgccattttaagaatgcatccaaagctcagctggatagagtactcggctacgaaccgagcggtcggaggttcgaatccttcctggatgcaccattttaatcaccgtaatttttaggtgtcccaattctggaaaatcaggcaatcagcagcgcctgaacagaaatagaaaactgacaacgcatccatagctcagctggatagagtactcggctacgaaccgagcggtcggaggttcgaatcctcctggatgcaccatattcaataccatgatttcattatggtatttagaatctgggaataaggtagttaatagcgcctgaccagaaatagaaaactgataacgcatccatagctcagctggatagagtactcggctacgaaccgagcggtcggaggttcgaatcctcctggatgcaccatattagcccctaccttgataaggtgggggctttttcgcttatcacctttcatatattacatttctcttatcatccgaactcatattttattcaatcgtatatcatcaggattatgtaatcagcgacaatctggcttgtttgatataaagtaaatgcttagtaataatctttttaaaactccacgggaggtcaaattgatcccggacgtatcaaaagcattgtcatggctagaggcaaatcctactgtattgaacggtatttgtcgcggtattgagcgtgaaacattgcgtgttactccagacggccatttagctatgacagggcatccagaaccacttggtgcttctttaacgcataaatggattacaactgattttgctgaatctctattggagtttattacccccgttgatagtgacatagaaagaacggtcgctttccttaaagatttacatcgttacactgcccagaacttgggcaatgaaaaaatgtggcctttgagtatgccatgctttattgacaaagaggaaaacatcactctggcacaatatggcacgtccaatgtggggcggtttaagaccttataccgtgagggattgaaaagccgttacggtgcattgatgcagaccatttctggcgtacattataacttctcgttgccaataagtttctggcaggcatggttaggcatcaaagatgcagaaagtgggaaagaacagatttcagacggatattttcgtctgatccgtaattattatcgttttggatgggtgatcccttatttatttggtgcatcacccgcgatttgttcttcgttcttacgtgggcgagagacaacactcccttttgaggaaactgaaaaagggacttgttacctgccttatgcaacctcgttgagaatgagtgacttggggtataccaacaaatcacaaagtgatctgaatattacctttaataatctccattcgtatgtagaaggtcttaaaaaagccattcataaaccatctatagagtttgcggctttgggaagcaaaaaagatggtaaacacctgcagcttaacactaatgttcttcaaattgagaatgaactgtatgcaccgattcgtcccaaacgagtcactcaagagagcgaatcgccctctgatgctttgctgcgtggcggtgtagagtatatcgaagttcgttctctggatattaatcctttcacggcgattggcgtcaatgaaattcagatccgctttcttgatctatttttgatatggtgtgctttggctgatgctcctgaaatgagtagcaaggaacttgactgttgtcgtcaaaactggaataaggtcattttggaagggcgtaaaccagggttgaatattggcattggttatggtatagagcagcagccacttaaaacagttggtcaagaattattcaaggatttagagcgtgtagctgaagtcttggatacctgttctggaacacaatatcaatcagcttgcaaagagttggttggtatgtttgaaaatccatcattgacattttcagcccgtgtactgggcaatatgaaagctcaagggattgttggttttggattggaattggcaaccaagtatcatcgtgaattgcttgaagaaccgtattcaatcctgagtgaagaatgtttttctgttgagcgtcatgcttcgatagaacggcaaaagagcttagagcagcaagacagcatggattttgaagattacctaaaactacatgctgggtattaaaaaagaaaatggccaccagtggtggccgaaataaaatctcttagaaaatagggatgataacaattttgcgcgtcttcatatcttatgaccagccgcaaatgaaaaggtttcatctatctgaaaaaaatttcgtaaaaaatctgatacctcaggaggtagtattatgcctttattagatagttttacagttgaccatactcgtatggaggcacctgctgttagagttgccaaaacgatgaaaacacctcatggtgataccatcacagtatttgatttacgtttttgtgttccgaacaaagaagtgatgccagaaaaagggattcataccctggaacatttgtttgcgggctttatgcgtaaccatttgaatggtgatggtgttgaaattatcgatatctctccaatgggatgccgcactggtttttatatgagcttgattggtgaaccagctgaactgagggtagccgagtcttggaaagcagctatggctgatgtactgaaggttaaagatcagaatcagatcccagaattgaacatttatcaatgtggtacttatgagatgcattctttgcaagaagcgcaggacatagctcgccatattcttgatgcagatgttcgagtcaacctcaatgatgagctagcgctacctgaagataaattagttgaacttcaagtgtagtatggttagagggtgtgtaatttgttgaaaagatatgtctgatgtctacacacgttctttttagccgtaaaagtcttgttaaaaacggctaaacctatcttatattgacggggttggcttattttttgctaaccctgtattaaattcattttttattcatgaataaataattggaagaatgatatttcattattgaaataataacatatgtatagatatatgtccgaaaatttagatttttaatataggcggattcatataataattgagagtatggagctaattttgaatgcagaggtagaaaatgaatcttatattatggagtgaggggatggttagctagataacgatgtgacagatgctgttagcacatattcggtaggtagtgacgtttgttgcttaacacaagcgattagtgcaaatgataacaaaattcaatgaataactcttattaggaaaaaataagaaaactgaattcttgtttaggatacgtttattattttttttaaaaaacatgtcaaattatctatgaaaatataattgatctcgtgtcatgttagttttcaagtaaggtaaatacattaaatttaattgtatttgagagggagttatgaaattaaagtaccttagttcaggaataattataactgctttaatattaactccagcaatatcagcggcaaacgaagttgaatctagatataaacaacctataaaaacattatcaatacagcaagaaaatacaacattaccttatatactcaccactggtgacgctaatggaagtaactgtggtaatggcaataactcttctgggaaaggagggaatggtggcaaaaatggaaatggaggtggtaaaggtggtggtaagggtaaagcataaataaacaacaacgtaacttattagtcaatttgatacgttacgttaatttggtttttataaataaattttatattacggagataaataaaaatgaaactaagcacaattatcataatgacatctatattaagttttcctttttcatcattacatgctgaatccgaaaacaaactcagtgtaaaaacatccgactgcaataaattaaatggagaacccggccaaaatggtaaaaacggaatacctaacagtaattgcaaggatggaggcaaaggtggagacgggaaaaattcgggacaatcaggtggtaatggcggtaacggtggtaacggtgcacctgatggcggtaacggtggcgatggaggtgatggtgcgtcaggtggcagtgatagcaatggtgatgctaatggaggcaatggaggcgatggaggcgatgctgggaaaggtagaaaatcgggttcaaacggcgggtatgatggacaaaggggtaagaatggataactattgaaattgaaaaacgctatccctgataggaacatatttccttcaggggagtatgttcctatcagggatagtagactagaaatatacaatttagacttagagtgtatcccaataggagatatttgatattatagtcagcctgtttttttacatttaggggattttttcatgaataagaaatcaatagcccaatggttcatttctgatgaactctggcagaaaattgaacccttactccctccacataaaacccatcaccctttgggctgccatcgccgccgtgtcgataatcgggccgctatgaatgctatcttttttgtgttacgaaccggatgccagtggaatgccctcaatgccacagggatttgttcttcaagcagtgctcaccgccgttttcaggaatgggtggcgggaggcgtctttgagcgactctggcaaaatggcttactcgccagtgaaaaaataggggctatcgactggggcaaattggcactggatggctgtttgactaaagcgcccctggccggctcaaaaaaacaggccgcaacccaacagaccggggaaaacaaggcgtaaagcgaagtttgctcacggatggacagggcttgccattagcgattgccgttgcgcccgctaatattcatgatatcagacttgttatagccaccctggacggtttacagacaggacgccggggttatggaaccaaactccatctggataaagcttatgaggcggaatggctggaaaaagaattaaaaacccgtggatacgtcccctgcatacaatcaagaaaagaagaacaagatgcgctggccgaacaatatgattttaaagtgaaccgttgggttgttgaaaggacacacagttggcttaatcgttttcgtcgtattctggttcgttgggaaaaacgggttgaaaattatgaagccatgcttcatttggcttgtagtttaattgtctggaatataatcctattgggataggctctaagtgtcatattaagcgctcttttagtttgtacatattagtgtgcatactttatttcacttggattattatataatcatatgttttttataggtaaattaataatatgatgcgatttgaaaataaagttgtcgtgattaccggtgcgggaagtggtatcggtgaagccaccgcgaagcgtttttctcaggaaggcgctattgttgttttggtgggacgcaatgttgataaacttaatcgtgtgtacagtgagctgtcatccagttatgcacgggtcattcaggcggacgtgtcggatcaggattccgtcaagatgatgattgatgagaccatcgaacatttcggcaagatagatattctcgtcaataatgccggattgtatattcccagtacgatattggatacttcgctggatgatggcaaaaaagtgttggcggccaaccttgatggtgttatttattgcagccattttgccttgcctcacttactcaaaagcaaaggatgtattgtcaataatgcctctgtatcggggataagggctgattggggcaatgcttattactgtacggcaaaaggggcggtggtcaatctgacccgtgccatggcattggatcatggctcacagggaattagggttaacgcggtgtgcccaagcctgatcatcacaccaatgaccgagtatatgtccgatgacgttctgcaaaaattcgattctcgcatctcaatgaaaagagcgggaactccggctgaagttgcatcagccattgcatttttagccagcgaagatgccagctttattaatggtgttaacctgccaatcgatggtggtgttacagcatcaaatggtcagcccaattttagttaaatataaagggtaccggggagtggtgatttataacaccagttccccgataatcactgccagccgatcgaatatttcggccattagccgttcagtaaagggcgccagcatcgggaacaacagagaaagtgtaaagatccccacagtgagcgtcagcggaaagccgatgacgaacacggaaagttgtggcgtcatgcggttgagcatccccaaagcgaagttcagaaccaacagcagggtaatcagcggcattgccagcatcatgccattgataaagattaaatgggcgctttgggctaacagcagaaaacctttgggattcagttgcattggttgaatgggaatcgaatcaaacgtaccggcaagaatgctcagtaaccataaatgcccatccaaagccagaaacatcaacatcatcagcaaattcagaatacgcgccaaaatcggcatattcgggccaccggtaggatcaaaaaatgtggcgaatgaaagtcccatctgtaagccgagtatttctccggcatgacgtattgctgcaaaagcaatctgcatggttaatcccaaggcaacaccaattaacacctgttgtatcatgacccaaacccccgcaacggaaaataccggaatttgcggagagggtatgttaggaaccaacaagaaggtgatcgccagcgccaaactcattctgacttttatcggcgtttgtttttcactgaaaatgggcgctgtgctgaatagcgccaaaaggcgtaccagtggccagaaaaaatcactgacaagacgagagagcatttcgctatcaaacgggatcatgattaaccaataatggttggaatgctgctaaataacacgcgcatgtaatctagcagtaagttcagcatccacggaccagcgataacaatagtgacaaaaacagccagaattttaggaataaacgataaggtcatttcgtttatctgagttgctgcctgcaacaggctgatcaccaaaccacatatcagggcagacagaagcagcggggcggccagcgccagcgccactttcattgcttcgatgccgagagccattaccgattctggagtcataatttttttaaaccgctttttcgatcttgttccaataggatttcacgcaagtttcgcgctagacataaaaactgttcgctagacataaaagctttgtgccaatgagccaagcagcaattgccagccatccaccaagacaaacaacatgagtttgaagggcagcgatatggtggcaggtggaaccatcatcatccccaaggccatcaaaacactggcaacgaccagatcgatgatcaggaaaggaatgaagagcgtaaaaccaatctggaaggcggttttcaattcactggtaataaatgccggaaccagaacccggatggggacggaatccgctgtttcaaaagcatcctgatccgcaagacgggcaaacagtgccagatcggtttggcgtgtctggcgcaacatgaactgacgcagaggctgggcacctttatccagtgcagcttccagacttattttgtcctcactgaaaggcaggtaagcatcttgataaaccttatcgaatacgggtgacataatgaaaaaagtcatgaacagcgccaagccaatcatgatttgattgggtggggcagaaggtgtccccagtgcgttacgcagtaaaccaagcacgataatgatgcgggtaaagctggtcatcatcagcaaagcggctggaataaaacccagtgccgtgatgaaaaccagagtttgcaccggcagtgaccagctttgtccaccatttgccatcggctggctgatgatgccaggcaatgcggccgcggcattcatggggaatagcggcaacaaaagcgccatcagcagggttgctaaatgcacaggccggaggagagaaacaaatttcttgccagtcattggagtgccggtcataaagaaaacgctatttttcatcgtcatccttgtcgtttttgctttttcgctggagcgtattttttaacatttggctgaagggtaatgttttgagtgcagtttccttttccgcgttatcagacggtacaggcatctgatgcaagacattaatctgttgggatgtcacgcctaatacgagccaactgtcttcgatctccagcacaacgacccgttcttttggcccaagagagcaactcgctttcacattgagcaaccggtgatttttgttcttggcaggagcaagccccagacggcgaatcagccatgtcatgacaaaaatcagcagcaggataccccctagcgcactgctgacctgcatcagtgtctgactggcggggaggggttctggactggctgcgggtttcaccgtgtttgcagatagggtattagcttttgcgttaaccggtgcagcatcagatgctgcaccatgttgaaaagaagcataaagggaaggctggttcgccatcatggtcaacgactcaaacgacgcatgcgttcagaaggcgtgatgatatccgtgatacggataccgtatttatcggatacgacaaccacttccccttgtgcaatcaaatagccattgatcagaatatccagtggctcaccggcaagaccatcaagaggaaccactgagccttgggatagtctcaggagttgtttgatagtcattttagtacgtcccagctcaacagaaagcttaacgggaatatccatgatcaggtcaatatcagaaagctgagcgagtgcatcctgcggctcaaggttctcaaatattgacgcgccgctgtcagaggtttgctgtgcggcctgttgttccagtgcttctgcccacatatcttcagtcagtctggcttctgcgggttgtttagcatcactcattgggcttttcctcatccagagcatttaaaacagggttaatcagatgttcaacacgcagggcatactgcccgttcagtgttccatattggctggtgagcacgggcacaccatcaacgtgagcgataaggcgttccggtctctcaatcggcaaaacatcgccgcgtctcagttggagaatttttgacagtcgcaggggaatatcaacaaagttagcaacgagttccaattctgaatgctgaacctgcttcaccagactttcacgccactggccttcttcctgacgtacattttctacaggaggattggtcagccgttcgcgcagcggttcaatcatggcgaaaggaatacaaatgttgaattctccgcacagtgcgccaatttccacctgaaacggcgtcgtaaccacgatatcgttcggtgaggtggtgatattggtgaatttcacctgcatttcggaacggacgtattccacttcaattttaaagatggaatcccatgcgtcacggtaggcatccagtgccagtttcagcatccggttgatgactctctgttcggtataggtgaattcacggccttcgactttcgtcggaaaacggccatcaccgccaaacaggttatcaacggcgatataaaccagactgggttcaaaagcgaataatgcggttccccttaagggtttcagatgaaccagattgaggttggttggcacggccagattgcgggcgaattcgtgatagggctggattttaatggcgccgaccgtaatatctggactgcgacgcagcatattaaacagccccattctgaattgacgggcaaaacgttcattgatgatttccagtgactgcaaacgttcgcgtacaacacgacgttgcgtattgggatcgtaaggtcgaatctcactctcccctgacgcagtgggttctatgtcatcagcagtggcactgtcaccattgagcagagcatcaatctctgcctgtgaaagaatattgtcactcatcgtgattatcgcagaataaacgtggtaaacaacacatcggtgaccacttgatctggctcaccgggtatcatcgttgggtgcagcgtctgcttgatatcggccatcaaacgcatcttgccgtcatttttcgccagatctattgctttctgacgggataacaatagcagcatacggctgcgaacttctggcagataatcatggaagcgctgacgggttttttcatcaggcagacgcagtgtcactccaacatataaaacacggtcaatatggtcttcgttgtcgatcaaattgacggtaaaattttccagcgtcataaataccggagtactgatgactttggctttttcggtgctgttcttggttggctgcttcattgtccaccagctatacccgccgatggcggcactaagaacggcaatcagtattaacagtattatccaaattggatttgtgcgtttacgctcgtagctataatcagacatggacagacaaattcctgttttccgttacgaataagtccccgcgcattccgtggcgggtcttcttatccatcaaaatcgataccaattatcccgcgtctttgttccgccaatagcgagaacaaacgcggaaaaaaccattaactcatacgtttgttatcggccttctttctttttcttgccgtttattgcagtacatcctgaaatcaggcgaaaatatcaacacctccgcgaattgaagcgagctgctgcggtgttattttgatggctgattcatgagtcgttggcatctgtgtcacggcggttgaattctgtccctgagccttggcagaatgatgggaatgactcggtgaattgctcgtctgttcctgctgccagtttccctgagtgtcaccacctacactgctttgtgctaattggatgccattttctgccaatgcatggcgaagcccgggtaacgctgcttccagcgctgtacggacatgctggtgtgctgagacaaaatgcagttgagcctgattgtcttcaacattcatgcggatatgcagtgcgcctaattcttgagggtgtaagcgcaattcagcttgttgcagcccgttgcgattaaagaacagaacatgttggttgagttgttgttgccactcttcactgccaatatgggcgctcagtaacggagtaggagtgctgtttaactgaaattgaccggttgtttgctgtcccgccggaagcaggggagaggcagccggtattgcaggtgattctggctggaaagtttcagccgcgaccgccaccagtgcgggtatcccctgaatcgctgtctggaactggttcaactcttttccgttattttgggaagcggagtgttgttctgctttattattgatggcgagtttcacttgcccggcagcggtagccagagttgggcgtgttttggttgattgttccgcgttgttgctcagggtagtctcttgtgtggcgaaagaccggatacttttatcttgttcgccatctttggtgtggtcagtacgatctgtagtgctcagtgcagcatcgacttttgcattcttgccagattttacatgctgacccagtaaagtctccgcaccggtattttcaccacgtagcagttcgtctgtgttttcagtaccatccgcaggaatcgactgagcgttgatcaatccggcgagttggattggcattgcagccaccagagcttcagcagataagagatcttcatccttcaacacagcgaaatcaatatcgctttccagcgtggaggtttctgtcaatagtttgcctccagccagcgttttaccgtcaacacgtattaccgtgttgtccgctacagccagcaagggtgccaattcaccttcaattggggtatcaccggagcacttctcattattcagaccatttttatcagcctcaatcgccgtcttccgcacagaggctatttctgcattgagatgctgcccaaattcagacgaattgttacgggtcaggggatcattcaatgtcggctgacttttttctgtgagttttatatcagtaggcaaaagagtgaggttcattgtttcattctccgttgtgcactacgttgtgcgtactcatccatttgtttttgctccatgcgattctggtgtaacttcaaattgtgctctgcccgctgttgcagtgtgtcgaaggcgttcagacgctgctgtttgtcctgccattgtgacatggcctgctcaagccgatttttccattgggtaagctgtaacctgtgttgttcaatcgccatttccagcgttttcatgaactgctgatagttttgccaggttgagctggacatgccgctgctgagtgtgtcatttaaacgtgtacgatattcatcctgataatttgtcaacgccgtgagttgttgctccatttgctgatgactctgccggatctgtgcaagttgctttgccgctttttctgccgcatcttgagcaagttcacgtaaagtcacgagaggggagtgctgttgcatgtatttcctcgttttaatgacaaaacagacataagcgttactgaattacattaatagcaaagttgtattagcaataaactatattggcaataattgttgaagctgaatacatgccgcatcgtactcactacgttcactcatgccctgttgcaggaactgggccatatgaggataaagctgaatcgctctgtccagtaaaggatcgctgcccgcggcgtaagcgccgacattaattaaatcccgattgcgctggtagctggcaagcaactgtttgaactgctgtacccgtcgataatggtcgttatcaatcagcgaggtcatggcgcggctgatggacgcttcaatgtcaatggcagggtagtggccagattctgccagtgaacgcgatagcacgatatgaccatccagaatagcacgggcggaatcggcaattggatcttgctgatcatcaccttctgtcagaacggtataaaacgcagtaatcgaaccgccatcactgacgccattgcctgctcgctctaccagtgccggcaacttggcaaatacggaaggtgggtagcctttggttgccggcggctcgccgatagccaaggctatttcgcgttgcgccatgctgtagcgggtgagggagtccatgatcagcaggacatgtttgccgcgatcgcggaaatcttcggcaatacgggtggcataagaagcgccttgcatccgcagcagtggcgaaacgtcggcaggtgcggccacgacaactgaacgtgccagcccttccacacctaaaatgttttcgatgaaatctttgacttcacggccacgttcaccgatcagtccaacgacaatcacgtctgcttgggtatagcgggccatcataccgaggagcacacttttaccgacgcctgatccggcaaacagccccatgcgttgcccgcgtccaacggtcagcagggaattgatggctcgcacaccaacgtccagaacatcgctgatgggtgtccgttgcagtggattgatcgggggagtagtcaacaaggcacgataacctgtatcgggggcagggaagccgtcgagggggcgaccagagccatccagcactctgccaagcaattcagtccccagtggcaaacgacgtccgccagccgaatcttcaccgtaagaacgggcatagacacgggcacccggtactatgccttccagttcttccaatggcatcaataacagtttttcaccattgaaaccaaccacttcgctttcaacttcttcaaccgtactgccattctgccgttcgatcagacaggtagcacccaaaggcatctgtatgccagtagcttccagtactaaaccggtcgcgcgggtcagacgcccgtaacggcggactctcggggttttttccagacgtttttccagtgaatctaacgttgccagccagcgcccaagtcgtgcagtcatcacaattctcctgacgccgccagacgacacatttcgtgccagcgcgttgccagactggcgtccagatcaccttcatccgcactggctttacagccgcccggatgcagcttgttatcggcaatcagacgccagccatgcaatgccagaatttcccccagttgctgttcaaccagcgggatattctgtgggtggactcgcagttgtggttttccactgaacattggctcctgctggataaattcacggatctgattcagcagggcagtgccatcacacacggcgggctgccccagaatatgctgagcggctgtgagggaaagctgcatcaggcgtgaagcgataaccgtatccagcccatccagtgaatggctaaaatcttccagcaaggctttccactgttcaacaacaatctgctgctgttgtctggcttcctgcaacccttgctccagacccgcctgacggccttcctgtatcccttgttcataaccttgcgcctggcctgccgtaaaaccttgttcatggccggtctgacgcgcttgttctttcagcgcgtccagcattctggcctgatccagcagacgctcctgctcgctaggctccgattcgtcgtccttgggcttcagttttgcccgcagtgtttcccactgagtcagttcatttggctgccacggctgccaaattcccttatttgacttatcagacataggtatcatcaccaccattcaggataatttcgccgttctctgccaaacgacgaaccacaagcaggatggatttctgttcggcttccacttgagacatgcgaaccgggccgcgggtcgccaagtcatcacgcatgatttcagcagcacgctgcgacatattgttgaggaagtgatcgcgcaatgcctgatcgcagcctttcaatgccacaagcagggaatcggtggtaatttcctgcaacaagcgctggatactgcgagcgtccacaccgatgaggttttcgaacaggaacatttcatcaatgattctctgcgccagttcaccatcataggtacgcactgcctcaatgacgctctcttcctgctggtttttcatcaggttgatgatttcagccgcagtacggacaccgcccattttactgcgtttaaggttctggccatccagcaggttattcagtacttcggtcaattcagccagcgcggacggctgtactccaccaaaggttgcaatacgcagcatgacatcattacgcaggcgatcatcgaacagggcaaggatatcggcggcctgaccccggttcaggtgaaccagaatggtggcaatgatctgcgggtgttcatcgcggatcatatcagccgccatttgtggctccataaagttgagagtctcgatgcccgttgtggtatcgcgggattcaaggatatcttcaagcaggctggaagcacgttcttcgcccaacgctttcaccaagacgctgcgcaggtagtcgttggcgttgatgctgagagccgcgtactgccctgcatcttcttcaaactctgccatcacttcagccagttgctggttggagacttgcctcattcccgccatcgcgatactcagttgctgtacttctctggaattcaggtgcttaaacacctcggccgcctgatcttctcccagggtcattaacatgacggcacttctttctgttccggtcaggctcattgttcgttactcatccattggcggatcaccagcgcgacaacgcgaggatctttttctgcaagttcacggatacgctggctttgaatctcggcattgactcgttggcgagccagcttgcggcgcattttttcatccagttccgcattggactctggcgcttgctgcttctgttgatttttctgcgcgttaagtgcggctttttccgccgcacgtttcttggcgatttgaggcacgatcattttgcgccacaatagccatgcaaccagtgccaacagtaaccaacgacctaactctaatgttttttccagcaggacagggtgttgccagaacggcaggggttctatcacttcagccgtatcgttgaacggtgtgttgacgacattcaggctatcgccacgtttagttgagaagcccattgcttcacgagtcagtgcttcgatctgggataactgttctggtgtcagtgcttttgtttcagggccattttctccctgagtagtggcatagttgatgacaacggcaacggaaaggcgttctactgcgcctacctgcaattgggtgtggctaatggttttaccgacttgatagttaatcagttcgtcatggcggttattgcggctgttgttcaccaaacgctcataattgttataggtgctattgcgattctgatcggatttttcgtcacctttgcctttcgtgtctggattgggcttctcaatcggtgcgcttggtgctgcactcggttgatttgataaagcacccggaacaccacccaccaatgacccaccactttgctcactggaactgctctgtttagagagaacagcggcctcattaggtggctgattaggtttatattcttctgccgtttgttcgcggcgagagaaatcaagctgggctgtgacctgagcatgaacattgccacggccgaccaccggcgtcagaatggtttcaatacgatgctggaaacgcttttcgacttcctggatgtatttcaactgagtggtgtttaaatcgagcccgttggcatcggcctgagtcagcaggcgtccagactgatccacaattttgacattgcttggcggcaaaccggccacaccgcttgaaacaaggtgcgcaatggcgttgacttgtccctcatccagagtacggccttgcagtaatcttaccgttacggaagctgtaggagatttttgttcacgaacgaacagagaaggcttggggatggacagaatgacacgagcactctcgacggggtcaagggactcaatagtacggcttaactcaccttcctttgcgcgattgtaatttacctgctcgctgaactggctgatgccgaatttttctttatccaataactcataacccaccgctccccctttgggtagcccttgttgtgccagtttcaaccgggcctcatgcaccttatcggcgggtatcatgagcgcagagctgttttcagcaaaacggtaggggatattcatttgggttaattgcgtgacgatttcgccgccatctttatcactcagattgctgtaaagtacccggtaatcagggctgcgcatccagaggaaaagggcgactacgatagcgatggcagcagagccagcaactaataatggaactttgggatcagcttttatcctgctgatgatagcgctgaaacctttattttggttctcaacgtcggttgttgctgcactcatagacgatccttgccttgctggtcaacatgaatactaaaagcgtggcgtaacaaaacagactccccatacgcaagcgaaaagattcttcctactattaatcccatcattattcgctgttcacacctcttttaatggcacaataagctttgaatttttacttcaattacgcgctttagtttgaaagggctatgttacggtggcagcgtggaaaattgccatgtcagcccaaggctaatatggcacttaatcacataatcaatagggtgatttaacgcgaggtttttatgtcaattcaggcaattgaaggtgtactgcaacagatgaaggcacaggcattacaggcaacgaacattgccaatcccatgccagtacagggaggttttgccagccaccttaccgctgcagtagaaaaaataaatcaaacccgtctgtcggcgactaagttgtctcaggattttacgttgggtgtgccgggtgtggaattgaatgacgtgatggtcaatatgcagaagtcgagtatttcattgcagatggggattcaggtcaggaataagctggtcagtgcgtatcatgagattatgaatatgcaggtgtaataggctgatttatatatattaatttattttcattaattatttggggcacacatggggcaatcgtgagctttttattaatagcttaatttggcccatcactattttcatgcatccatgcgccatagacgttatgaaccatttatgatgaaaaaacatgccccatctgtgttgcaataaataacggattagcgccagcagatagcatccagcaagcatacttcttcttgagacattcaatttcttaaatataattcaaaatggtatcgattccttctctctgaatagagaagttttgttagtatatcatgagaaatcctcgttattaaaaacgaggatttctagatttggctatttattattatagtaattactataataagcttgcgaataaagagatgagtaaaggtgctagtaaagttaatataaaaccactaactatttgtaacaggttctctatttttatgaaggcgttcagggggttaaatcttggttgaccgttgtcttaacagataactttcactatatggacacctgcgtatataggttgattatattcatggttattattttcttgatcataacctgatgattttccctatggcttttctttgcagggagctatattaatttattgtcaagctatggcgttattatggcattgggatatctatggattctagatgtattttcaggtgcgtaaggggcttcttctaaattttctatgtactacgacagaattaaatatttcgttattatatttaattctgactcatggaaaatagctattataccgtttttatacggctttcattcctcaagataatatatttcactaacctattgatatatcgaactaatttgttttatcgactaatttaattctatttatgacccataaaaaatgagaagaattcattgtttttaagatatatagttcattaacgatatgttcactaaactgataatgtatcatgagttaatgatttttatttaaataatattttttgttatataaaaagagatctacagtcattaatctgcattcaactaatgttaatgtcggtcacagtgacctgttctgattttgtattatcttcgggaagtcacactctcatgcggtagctataatagttccagccgtttttacaatagaaagatccacgaaattaagttcgcataaggaaattagtgatggacgtatctgcgcgtaaaaaattagtgtctgaatacctgtgcaaacttgctggcaagcaggatttagacgattcggtcaatatcttcgaaacaggcttggttaactctttggccgctatccagctaatctcctttctcgaaaaaaacttcaaaatcaaagtcgaaattgatgaccttgataatgccaatttttccagcattcaggctgtctgtaactttttggacagaaaggtggcggtaaatgcttaatcgctttttgtcacctttgcaaaacgagtggttacaggtatttgagcaattttcagcgactgaaattgcgccttatgctgacgaatgggatttggcagaagcgatccctgcaacggttgtgcaaaaacttgcacataacggttggttgggtgggttggcgaaacccgaaaatggtggtctggggtttgatgtcacgaccttcggattgctgaacatggctatcggcgcagggagtggttcgctcacggggttgctgaatgtacacgccatggtgttgaaaactattgaagattggggttctcaagatcaaaaacaacgctttctggcaccgctggtaaagggtgaaatcattggtgcattcgcgcaaacggaagtgtccgctggcggagattccaagaatctgtcgacgcagtttgcagaagacggaaattatctcagggctaatgggcaaaaatcttggatcacttttgcccagattgcggatttatttctggtattcggtaaatatcaggggctggataccgcagtgctggttcctaaagatactccggggctaaaagtgaccgccaaaaaaaatatgctgggcttcaagagtgcatatttggcagtgttggatttcaaagattgtcgggttcctaagaccaatattgtcggaaaacccggatttggacaaaacctaatctctaacaatgccttggactatggccgcatcagcgtggcctgggcggcgctcggaatacagcaggccgcattggcggcatccgctcgcagggctaattcccgcatcacctttgatacgttacttgcggatcaaggtatcattcgcggctatctggcggaaatgtccagtagcctgctggcctctcaactcatttgtttatcagcgacaaaagccaaagaaacaagggatgaagacgctcttgagcagatccttcaagccaaacttttctcatcgcatgaagctggcatcgcagcagcgaaagcggtacagattcacggtggtcacggttgcgatgaaagcaacggcatcagtcggctctatcgggatgcgaaaatattgcaagttgttgaaggcagtaatgaacttcaaaaaatgctgatcggcaaggcagtatgcaatcggtatcgccataacgccgcacagactattccgtaaatcgtctcaacattattccccctgaaaagtctggcgtgttgcgtccggctgacaggtttctatcgcctgatgttcgcctgtaacgtcaggtcacaatgagatttgaataaatccagcactcagaggatgtcggcatcatggcaactggtcgatttattactgattacttcgaaagtacggcgagagataaccagaatccggcgatacggtggggaaaaggaaacgctttatcttggggcgaattatacgaaagagcgcaacgactggctcattatctggtgagtgagcgcggtatatgtcagggcgattgtgttgctattggccttgagcgcagcccggaatttctggtggcggcatatgcggtactgcttgctggtggtgtttattttcctgtagaggcgaaaacgcctgtcgctcggttagcatccatgtttgcgacggctcaatgccgtatcgctttttgcaatgtggcacagggaagtctgtttactcaggccaaacccggactggaactgatcgggcgtgaatttctgacagaaatctccacctctcattgtctggatcaccgctgccttaattttcatcaatcagaaaacacgggcaaaaaagcgcgtcaacgacaggctaccgatccggcttacttaatcttcacttccggcacgactggcattcccaaaggtgtgttagttaatcatggcgctttcattaaccgattagagtggcatcaggctcacagtgagatgacggattcggacatcatcctgcaaagaacggcgctgacttttgatgtgtctttatgggaactctttttacctgccctgaatagtgcgagcaattatctgctgcaaccgggattggaagcattccccagaggcatagtcgctgcattggtaagcgaaaatattacggttgtccacttcgtccccagtttgctgaagcccgtactgcaagaactacaagagcttcaggatgacagtgttgaaacgccatcattatcggcgctgcgcagggtgtatgtgagtggggaatcattgccggccagtctggtgacgcaatttcagaaaatattggcttcgcgctgcctgttgaccaatttatacggccccacggaagcggccattgatgtcagtttttatgactgcgtggaaaccgtgccggacgctattcccattggacagcctcttactggatgccagttatatatcttggaaccagacagtctgacgttaaaagcggattcggaagaaggcgaaattgccatcggtggaatatgtctggcagagggctactacaaccgaaaagatctgacggataaggtattcatcttccatccagaacttcagcagcggctatatctgaccggtgatcttgggtggcatgagaaaggacggggctttttctgtcagggacggaaggatacgcaagtcaaattacgcggattgcggattgagttgggagaaatagaacaccatctgctcaattaccctgctattaccgaggccgttgcttgcgtggttgaggatgaagatcaggaacagtggctggtcgcggcgattgttgcaggcgaaagggagcttaatgagcaggatattcgccaatttctcgctgcgcaggtgccggcttacatgttacctactcgttattggcaagcccgaaatctgccgaggtctggctcaggaaaacttgacaggaaaacgatagcccaaaatatgcgggatctgtttttcaccgatcatcacagaggtgggaacttaagccatgaataaaccgacttttgagctatcgcggtcacaacaggccgttttcaaaatggaagcgtttcatctgtccggctacccattttatttgggcggtgtggcacgattgagtggaaatgtgtcgttagatcaacttgtgcgggcggccgaaactgtcaggaatacgcaggatgtgtgccatatcggcttcgtcaacgatcctttagaaacggttcatccagaagttgttggttgggaaatattatggcgtggaattcggcacaacacgcctcaggccgccgtggaacgagtggacttcagcagacatccagaccccggttcggcttttgaaagttgggtggagcgtcaactgctggtggaagaggacttatcactcacgccgatacggatttttgcggtgcgtttccgacaggaacaatcgggatggtttgtgaaagcgcatcatgctgcggtggatggtgcggcgttggcgatattactagagcgtctggccgatgcattggtgcagaggtcggggaaggtgaattcccctttgtactctattcacgccgagagagagcgggattacgagaattcccggcgtatggcaagggatgcggcgtattggcggacggtttttggtgaaccaaatacttatggtgatacggcgtcagtcagcgccaccaaaatctcctgccgctacccaataggggattatcgtagttcgaaaccgcacacgatgcgtgtacggatcgctttgagcgaagcgcaaaacgagatgctgcataaattcagccatcgcggaggttcagtttttcggctgtttttcgccgcagttgcctatacacaaatggtgattgaagatggcaatggcgcgttattacaggcacctatgctgaatcgttggcgtgaagacgaaaaacagtcagtgggcatggcggtggctcccgttctgatcccggtatttcgtgaggcaggggaaaccgtcgcggattgctatcgtagcctcagaaaacatctgcaaaaagcggtgatgcactcacggtatgctccgggcgcccgttggggagatttcgcatcgcaggaatggagacagattgtgccggctttcggcgtttcctatcaaacaggcgtgtttcagaaaaccgtctcaggtgctgaaatagagattgatcatattcaggcagtggaggcgttgtttgccactgtgcacatccatgatcgctttgagggcggtgacttcaagattgaagccgattttcgcaaagtctggtcttccgaccaatgtcacgcattcctgcaaaccgtcattgattatgcactggaagctgccgctgaagtgatggggcaacaagaaaccacaaggcaaacaaaagaagtcaacgtacagactgattgtctcgcagagccgatcggcgttcatttatgtgacgcttttcagcgttatgccgataactggctgttcaaacaggaagccggtgagggagtgggtaatctgacctaccgtcaaggatggcaatggatttgcaagtttagtgcgcaattgcgtgacaggcgggatcgacgtttcgaacaccatccggtggtgattctgggaaggcgctcgcctgaaatgacgctcgcctatttgacctgtcttattgaaaatgtgaccgtggttcctgtttgtcccaccacgccgttggcgagattatcaactatcgtccgtaattcgggcgcgtctctctgtatttatacgggaacggatcaagaccttgcggaggcgctgaatttgcctctgttacgcgcttcgctggataaagatttatgtgacgcgggcttgcatccggaaatccagccagaattcatacatcccgaacaagcccggtcacaacaaacaggcagcaatcctgcttatatcctgtatacctcagggtcaaccggagagccaaaaggtgttgtcatttcccctgttgcactggcgaactatgcactggcagccaaaggggaatacgcttctgaagcgccgtttaatgcacctttgtttacttcctttgggtttgatctgacgcagacagcgattctgatcccggttttatcgggggggtttatacaagcccacgaacaggacattcgcgataacccggaactactgcgaacccttctctccgatgaggcattgacgggagtgaaatgcacaccatcccatctctcattattgattgagcatagcgtccggagacggaatccgctgacctttatcgttggcggcgaaaatttgtccgtcgctttggtgaacagagcgcttggcttctttccttcaggcagcagagtgatcaatgaatatgggccgacagaggcgacggtagggtgctgtatttatttgatgaacgaaagttcgatgagcgaatctgatgagaatgacagagcgagcaccgtgattgcgcctatcggtaaagcgctggggcaagcggagatgtcgataagagacgcttgggggcaaaatatgccccgtggatttaaaggagaaatagggatcggcggttcagtgctggcggatggatatatcaacaacagcgcgcagacggaggcgcagtttgtatgcagcgccgacgggcagcatcgttggtatcgtactggcgatctgggcttgcaggatgaacagggaatattttattgccttgggcgcattgacgatgaattcaaagtgcgtggtcatcggattcaccctgcggaaattgagaaagctgtggcagaagctctggcggatcttggacatgacgatgaccgtcgggagttgaaagcgctgaaactggccattgatggatatgaaacggtcgctttgtgcagtagtcaatctgtgccatacgacaactctgcattccagaaaaacctgaaaaacacaatccctgacgcttggctgccgggtctctattgtactgtgcagccttggccgatgaatgccaatggcaaggttgatatggccgcgctcactgttgcggctaaagcaaagctggcggcagccgatcctgctcagtttcgtgcaactgacaggcaaggtcagcgagagccggaagcttattcactcccgacatggctggacggcgagtttttaaggccgatttggccggaaaccgtggatctgaccgcctcatttctggcgcagggaggtgactcaatcaaagcaatccgccttgtcgcattactcgccagacaaggcgttcgggtcggcgcaagtgaactgttaacgtcaaccgccttaggggctgtgcttgaaagagtttgttcggaaaaaccagacgttgctgtcaccgactcgactgttttggaagcgccggaagcaaactgggtgaactatttacccagtgtccgctggtttcaggaacatcactttaaatacggtgaacggctgcaacagggtgtggtgcttgagttaccgtcatccatttgcgccgggcgtataaatagcgcggtggcagcggtaaaagccagacataaaattttcgctttgagatcgaatcggagtttgagtgagttttatttttcgtccttggagccagagcaacatgacggcgatatgttattgcaggatcaagtgttggcgcaagacgaaagccttgagggcagactgcacagattgcaaggcgaagtgtgtctggaaaataagccgagtgtgcatgaagtggtatgtgatccggctgcgaacaaaaattatctgatctgggtttgccatcatctgatctgtgatgtccattcatggattttcttactggatgaattggatcaggtgctgaacgaatcggcggttctgctcaacgttgataaagctaatgtcgataaagccagcgctgttgttgagcagggtgcattcctctgggggaaatggctgcgggatcacgtctcttatgctgaacctgcaccacatgaccatgccttttatccgccggcagccgttcccgtcacgctggcgctatcagttaccggcgaggatttccggctgatggaacaacgctacaaagctgaacggacgcagttgattgccgctgctttgctggagattgtgcaggataacggcatgttaccggaacagcctacggtgctgtttgaaaaccacggacgcttattctctgaggcagagacgcccgctgtctggcatgcggtgatggcgaattccgtcggttggtttactggcttcaatcaactgaatctccacgttccctctggctatcaaagcggttttttgcccggtttctttttacgaacattgaaatcacaacggtatgaagacagcccagactggaaagaacaactgggattgaatggtgtgcggacgcggccgctcatctgcatcaacgatattggtttcggactgagcgaacacggaacatggcgccattttaatctggttgattccctgtcgggtggttttcggcatcccgatgaaaagagcgtggctgactttgatgtgcttatttacgacgatcgcgaatccggttctgtttttgttgagttgagactgggcattcccgaagctggcgacgtggatgccaaacgctacctgatgcaattaaacgaaagactatccgattggaacgatgcgttacatcgcgcacaagtggaacaggcgttaattccggcagattttcccctttgtcagctctcacaaccggagctcgatctcattattaatggagcctcagcatgagaacggttaccgactcagcgaagacggtatttttatttcccggcgtgggcgcacagcaacccgatatgtttgccgcattcagaacctatcccgaatatcgagcctgtctggaagaagtgtcggagctgtctcaggtcgatctatttagtgttattcatggcgaacagcgcgacaccttgaaacaagtgcgcattgcccaactggcgctcacggcgactacggtcgccattgcgggcatattacgtacgcgctgtgggcttgttcctgagtttatgatgggacacagtctggggcagtatccggctctgtgcgctgctggctatcttgatctggcgacgttgaccaaagtggttaacctgcgctcggaagtcgtggaagcctgcgcccgtcgttacgaacagggcgacatgtgttgggtattgcaccttcctgccgaggttgtggtacaggcagtggataaagccagaaaagacgatggtatagaattgtatgtatccgccattgatgcgtttgatcaggtgacggtttctggcgttatggcagacattcgacgctttgcgccgcgtatggaagcgctgggcgggttgctttatccattgaaaatcggtggcccgtttcattcgcctttaatgatggaagcgcaagagaaattggcggcattgcttgatttcctgcctgacacagacaagcaggggacgctgctctccagactggtctgcaacgtcagtggcgcagagttacctgctgaggatctcaaaccatcaattttacagcatctgacttctcccgtgcagtggctgcggagtttgcagtatgccgcgcaaaacggtgtcacccgctatctggaaatttccccgaaaacagtactgagttatctgaatcagcgcgcgggattgcccatgcaacctttatgcgaaccggatgaaattttcactttcgctgaggcactaagcaccgcagagagccgattggagcggtttttcaggcactgttatttccatctttatagctccagattgcctgacatcaaggatgcggcagcgatcgcacaactgcgtcaaatcagggatgcagtaacacaaaggataaaaggctcacatctgccctttgaagactgcggctttcttcatcagcacacacagcaatggctggaaatgattgaaggaaggggagacacctctttatctgtggaaaagatgaagttgcaaagcctctttgatgcagtggggcgcggagtatgaagcagctcaatgattccaacaaacccaattatatcgaagaattattacaggtaacgccgcaagcaaacggcctgctgtttcacgctttgaaagatggtaacagtacctatcatattggcgtggcattcagcctgaaagcggatgtcagtgaggaggagatcctcgatgtctggtatcagatacagcagtcacagcctgctctgagggcggtttttgtctggaaaggcattcgtgttccccatcaggcggtatacgcattaccacggataccgcttgaatatatccgcgttgattcaactaccccggaggcgtcgctaaaacaacgcgacctcgattggctggcacagtcgaaagcgacgccatttgagctggatgccgaggtgtttcggatcatttgtttccacgatattgacgcgggaatcttaaggatcgctttctcttttcaccatattctgatggatggttggagtagctcactactgatttcgctctggttacagggattgcgccagcaaaaaatcgttcctctggctgtacgactttattcgcagcaactctggaaagggctaagtcaagaagaactgaggctcagtcgtgaacactggcatcgtgttttccaatacctgccagacggagaaacttcggcgacgacaaaactgctggccgaaccgctgttccgttctgccgaacataccgagattaagcataaagcgggagaaaaaataacagatgaaaaagtcatcgcgaaccgcatatgggataaagaacgtaaagcggcgatagagttgatttgtcgctgtgcaggtgtcactccggcaagttttatctatctgtgctgggcgctggtactggccaagttgactttccaaaaaaccgttacgttcggttgtacattttccggcaggggagcggcgttgacacaaaacgtcgaccgccaacctctgggactgtttacgaatacggtgccgctgatcctgacgctcgacggaaaatggcgtctggaagtagcattacgcgcggtttttcaagcgctgcaacagactcatcaacatgaaaaaacgccacccctgttgataagagaagagacgggaatacgtgacgaactctatgactctattgtcgttatcgataattacccgatcgataccgagttacagaacgctgattgtggtgcatttctgacggatttgcacagtgaagagacgacgcattttggtttgactctgacggtttccggtgtggatcaatggacagttgagttaagtgcgggggaaacttttgcaagtgatcctgacgcggtaaatagggtgtttaacgcgtttgaatctttggcagcggatctgattaaggggtctgtggatgtacggattgaagatctggtgttaaaactcaacccagacggcgctgaagaagccgctttggtcatgggagaacacaatgcacagacgccggatatcaatgcgttgctgctgtgcatttatcagcggcttaaccagtcaccccaagaaatcagtctgattgaaggccagcatcggatcagtaatcgcgaactattgcggggcgtttttgccttgcaggaacggttacggggagcgggattcgttccgggcgatagagtggctgtccatctcgaaaagggactgttatccactcaagcgattctggcgatattgttcagtggcggcagttacttctgtataaacccgaaagatccacggcaacgtaaaaaaaatctgttggcgttggcgaattgcggcattgtcttatgtggtgcctccttgaacggggaacttgatgctgacatcgggcgttacttgctgctggatatcgaaacagagataacatggccggagtccactggtgaaccaacgttatggcgcaatcggcggtctgaagatgagttttacttcatcttcacgtcaggaacgaccggagcacctaaaggcatctctatccgtaatgaatcagtggcaaacttgctggattggtttgtccgggaaacccaccttacgcctgcggatcgggtacttgggctgaccgacctgaatttcgatcccagcgtcgaagatctgtttggcagtcttgttgccggagctacgctgatttatccatcatccaatgtattgttggagcgacagacgtttatcgatctgctgcgggatgagtccatcacgctgattaactttattccgggcgccattgcacagcttattcagggcgctccttttttcccggctatgcgcttgtggatattcggcggtgaagaattacctcaatggctcagggatgatttgctgcggcagggttacgccgtcagcaatcattatggtccgagtgagacgacggtggactgcctgactgccagacagtctctctctgcggacgtttctatcggctggccaattcaaaacgtcattgcctgttgcgcggacgtcttcggtaaacctttgcctgcggggatacggggcgagctttggattggggggcaggcggtcgctcacggttacgccaccaatccggttgagtccgataaatattttgtcaaatacagtaagcaggctttttatcgcacaggtgacgcggtcactttttctcatcagtcaggctttaagtatctgggacggattgacgatcaagtgaaagtgaacggcgttcgcattgaaccgcgtgaactggaacgtgccgttgagacattggaggaggttaaggcttgttgcctgttgtctgcaacggggcgggaaggaaaacggcaatggcgtcttttcatcgatagctgcgaatcgtctgccatgctggagtcccgtgtgcgagaacatattcgtcggcattttccagagtcgtggattcctgcgcttattgtggttatagacggttttgaacgcaccattaccggtaagatcgatcgtcagcgactgctggaacgcgaaatgcagcgattgccaatacaaactgccctggatcatgcgccgttgaccgatcctgtcgaagcgaaagtacaggctgtctggagcgcggttctggaaactccggtggttgatgcaaacgtgaattttttcgatgcaggtggtgactcaataaaaataatcgcgctgcaatcccaaatgcagcgggcattcaaccagaaaatcggcgttgccgtcttattcgaacaccccaccatcaccgccttcgcaaactggatcaaacagagcaacttgtctcccgaaaatgaggaagccgaggtgatgctatccgattctggcaagcaactatcccaagaaaatactctgtcgtcggctcgctcaggtaaaaacagactggcggacaggcggcgtaaagtgaaaggaagttcagtatcatgaagcgtgaatatacgggtagtgaagtcgctattattggcatttcttgccggtttccccaaagtcccgactggcaaagtttttggcgcaatctattggcgggacacgaacttgtgtcatttttttcgcgggaagaactcttagctgccggtgcgccgtctgagattatcgatcttcccaattacgtccctgccaaagcctcccttgaggatgctgagtgttttgattatgaatttttcggctactcgcagcgggaagcgcggaaaatggatccgcaactgcgggtattgcacgaagtcagtttcaacgcttttcttgatgcaggtttgcctgttggcgagtcgatgttaaaggcgggagtgtttatcggttccacgttgaatctggcacgactggagcaatttgcgggcgctagtcaggatatctcagaaatgttcgatgtcggcaactataacgatccggcttcgttcgctgcgcaaatcgcttatcgcatgaaattgaatggcccggcggtgcacgtacaatccgcctgttcgacgtcattatccgctgtccatctggcttgcaaggcgcttttggcgggtgagtgcgaaatggcgctggcggggggcgcatgtatcactgatccggtggcaggcggttatttacatcaggatgggatgatcctgtcgccggacgggcactgcaaaacgttctctgatgacgggaaagggacggtgaacggcaacggcgtggcagtcgtgttgttaaaattgctggaagacgcactcgcggacggtgaccccattcatgccgttatcgtcgaatctggcatgaacaatgacggcgatagaaaagtgagctttgaggctcccagtgtgcaggggcaggcagaagttatctcacaagtttatcggctggcggatattccgttttcgagtctgggcatgatcgaagcacacggcacggctaccgtccttggcgacccgatagaaattcaggcgctgaataatgttgcgcgggaactgctctctccggacgaactgcaacaattccgctgcgccgtggggagtgtcaaatccaatatggggcatctggatgccgccgccggtattgccgggctgataaaagccgctttaagcgtccgttttggtaaaattccgccttcgttacatttcaataaaccgaatccccatctggatctggacaatacccccttctgggtacccactcaaatcaccgactggccggcaaagcaggcgatccgacgtgccggcgtcagttcattcggcataggcggcaccaatgttcacgttttgcttgaacagccgccggaaaccgtcgataaagacgcttctcaccggaaatccgcacaaatactgccactctcggctaaatctcccagtgcgctggcgcgattggcagagtcttattccatccacctcagcctgattaatcagggattcgccgaagaggaaacatcaagccttgaagtgatcgcccggcagctacaggaaaaccgaaccgaatatccttgtcgtgctgcttttgttgccaaccatcgcgatgactggaaacagcagcttgataactggacgctgatggatggcgcttatgcgtcaatggcggagttaatttggctgtttccggggcagggttcgcaatcgccggcaatgggtctgcgtctggcggcggaatatccggagttcggtgacatttatctggggttgttagataaagccgcagcactgttatctgttcaaaaagcggtattgattgataaacagacattaattgacagcattaagcgacctgaacaactgtcaactctttatctccagcccattttatatgcagttcaggcggcattgggtgtttggctacagaggcttggctgtaagcctacggccttgttagggtttagtctgggagaattcgctgcggcagctatcgccggtgtgttcagcatcgaagaaggaatggagctggtggtcgcacgggcggaattaatggattccatgccaaaaggcgcggtttttgccgccagtcgcaaaagcaaaaatagcaaggaagactttgacggtgattttccggcgatgctttggtgcatatcagaactcagcccgggaacgtggacactggcgacagaggaaggattggtcgcagacgcagagaactggctgacgcagcacggctttgctttcaagcgggtggcggtatcccacgccttccatacaccaatgattgagccagcggcgaaagcgtttggtgagctgctgaaaagttatgatctgcaacccgcgcagtgtgctgtttattcaaccgctttgggacggaaaattgaagcggatgagatgcgtgacccgcaatattgggtcaatcaaatgctgtcccctgtgcaattgggtgctgctttaaagcagatggctcaggaacatcccgcgtcactcttcgcgcaaataggggttggcatggatttgttgcagcacacgcgtaaatggctgcatctgaatggggagagatgggttccgactttaggctcgggcggcgcggatcacgaggtgaattcaacgttgcagttcattgccagggtctggatacagggcggtggcattgagtggaacagaattcatccgcagacatccatcgaacgtaccataacgaaaacgcacctgcccggccacgcttttgaacgtcgggtttgtctgccacaagcgatcacaaaagcggctcaggcaatatcatctctgtttttcggctcgcattattacgggctggagtgggaaaaaatcaacccatccacgccggagaacgctgcccaatcaggggatacgccgacaacctggataatctgcccacaggttcaggaaagagaacgtcgtctggctgaaacgctggcactgaataaccgtcaactgacgtttattgagtgtgcgaactggcggggcagcgatgccaacctttatgccgagctggaaagttggctgttgcagcaagggctggcagtgtccgccgctatggatattattgttaccggattactggatgatctggacactcggcaggcgcagttctgggcgttctggctgccgactgttctggcgagatggagcgcaactcagcgttttgcaccgaaaatacggttgttcttccccacaaccgaaatggcggcatggagtggttcggagacgctgaatgcagaaaaaaaccagcttctggggtcgctgctgatcctgccggaagaataccccaacattaccgccctctgtgtggatttagagaattcggaagtagagaacgttgcccgtggattacagccctggataaatcaggactggcatggcggtcaattctactgtttccgtcggaacgatttttggcagcggagcgtgacgtcgcaagtgcaaaaacagccattgacgcacccactgccggacatcagccgcaacagttgggtgcttgttactggtgccaatggcggcatgggcgcggctatcgccgaacatttagcgcaggtttatcattgtaatctcttattgttggtgcggaaatctctgccgaaaaagcgggattggctgacggagattgaaagcaacggttcccacgcagaatttttgcgctgggtgctgagccttgaggctaagggaagccggatagagttgttgcaggcggatttgggcgatggtgaatctctggcgcaggcttttgctcccgtattccaaatggtcgcgcggggggaggggatcgattacgtgttccataccgccggtcgcggagagggcgcgatgttgcagatgcgttctgaggcggaatccattgcaacgctggctcctaaagtgacgggaacccgcttcctctgcgataacctgagtaggcttggcaatccggcgctgttgttgttttccagtctgggtaatttgctgcccaaggaaaagatcggccaaatcgcttatgttgccgccaatgccggtctggaagcctacgcggatcaaatccgcagcaaaggcggcaaagcgctggcgattgcctgggatgattgggctgaatcagggatggcaacccgctccgcacaacaattggatcgtgcacttaaaaatccggcacaggacacggcgcccgacgccccaatctggcgacgtcggctgtgtgccaaggacgactggtggcttgacgagcaccgtattgatacagagactgccgtgatgcccgcgatgggaatggtggttctggtacatcatgcgttgattgagtggcgaacggtggcggcagaggcattctcattacaggagatcgccattgaaaggccgttggtagtggctaacgacgcggagcttgatgtcgccgtgatctttgcggacgacttgaactcttttgagctattttccggcaatggcaagttttcccctgagatctggcttaaacatgccagcggtaaaattaaataccgtgacggccatactgcacgttctggcgaaaccgtttccttaaaaacccttccttcccagccaccgttcctgaacctgtttagcgccaaagataacatcggcgtcagcccgaaaggcgcgctgacattcggtccccgctggcgaaatgtgatcgccgttgaccagaccggagtcaatgaagtgttgaatctgttacagctcccctctgcctatcggggtgaagcagaaacatccggtcttcacgtcgcgttgttggacacggcaaccctcattgcctctccagaacacgaagatggacagtttgcgcctgtctcgataggggctttcactcaattcgcgcctatgggtgacagagtgaaaagccacgtccaaattcaggatctgggtgccaacaagttgttgcaggtgaatatttattctgaggaagacaacctgttagtgacaatcagtgatttgttactggttgatgcgtccgctgctttgcaacacaccgtcatgcgtttgaatgccagagaagccggaagcgtcgatttttcttttcgctcacaatccgaaacacgcaaagagcctggcccgctggaggtagaaattcaggttaaggcggcggggctgaattttaaggatgtgttgattgcgctcggcgtattgccggctcctgccgacccgaccatgacttttggtcaggaggcggcagggattgtcacccgtgttgggcggcaggttaacggtatccgcgttggtgatcgcgtgatgtgtgcgggacatagctgtctggctgaacacgttattatgccgcagcgtgttgtcgcacctattccacagacacttggctttcaacaggctgcggggattccggtggcttttaccactgcatggattgctttgaaacacgcggccaatttgaaaaagggtgaacgcatcttgattcattccgcagcggggggtgtcggcatggcggcgatgcagattgccctgtatttaggcgcggaagtttgggtgacagcgggcagtgaagaaaaacgtcgattgctcagagaaatgggcgcacaaggcgtagcaaactccagaacgcgggaattcggcgatagtttccgccgtgatctgggtgagcgacctttcgatgtgatcctcaatgcgctggcaggagaactgctggaagaaagcctctctttattggcgccgcaaggccggtttctggagcttggtttacgggatatcctgcaaaactggtcactggggctgtcaatttttgcggaaggcggcagcttccacgcggtgcaggcgggcgccgaacatcccgcctatcaggaggcttgggctgaggtcgcagcactgttggaggacgaaatccttaagcctttgccgacaaaagtttatcccgccaaagagatcactgaagcatttcagttcatggctcaggggcggcatatcggcaagattgtcatcgcgatggaagaacgcagcaaaacactcagcttcgtagaaaagctgaaagcagagggattatccaatttggaaggaacgcagatagcggtggcgatggcagcacttgtcggtcaaaccaaattgccttatatcgctgtttctaaacttcccatcggctcagtgttagaaaagcaacgacatactcagcaaatgctgttcagttctggctcaacgcggaatgtaccagccgccatcgatggagacgcagacggatcgcttaagggcgcaaatgcggatgatttattgcaggccatgcgtactattctggaaggatttctgggtgttgacgatctggacgtggacgccagtttcttctctttgggggcaacctcgctggatcttattcaattcgccaaaaaactggaacaacggctggaacgggatataccggtagcgctgttgtttaaggctgcttctttgcgggaattgagcaaagaactggcaccggaacaatccgttgcagaagaaccgcagatgccgcaacaagaactgggagataaacgtcgcacgttgcaggctcgacgcaaattacgcggcgttgtgtccggtcaggaaagatccagtcaggggagtgaagacaatgaataatactggattgatccgcataggcatttttttagtcgccatctatctcgcgctggtgggaagtgtgttcgctgacacgattgaccagaaacagattatcagccagaagcaagattctgatctggagcagatagtcagtgagttgagccgtcgttgggatattgagcaagttcccactggcggactgagtgtcatcgtcggcgataaagtccgtacatggcgactgggcaaggaagaggcagggacattcgaactcgcttccagttccaaagctttcactggattactgattgcgctgctggaacaggaaggtgtactcaaccagcaggacgcgattacacgatggatacccgagctggcggaacatccagaaatgggctactccgccgtgctacttaaaaacctgctgttccataccagcggtatttcaggcgacacaatcgatttgctgcaaccctatgatgcacctgatgctctggcgaaactgccggtattgctgcaaaaaattccgctggcctatcccgtcggtgctaaagaggaatacgctacgctgaattacagcctgttgggtctggcggctgaacgggcgacggggaaatcgttcgcaaccctgatgcgggaaaaaatctttctgcctttaggaatgaagaatacaacggtagagggcgaccggtcggtagaggggagtgccgctgcatctgcgcgtattccggggtataaaatcagttttacccgcgctcggccgtatgatgcgccccgctatctgcaaaatacacccgcaggttatgtgttcagtactccgcaggatatgggtatttggttacagttcttactgcaccggcagcctttaagtaacaacaaaggtgatggcgatgaacagcggtctgcgttatacgcggcactggagcaggcaaagcgcccttacggtggcaatggtgacgcggggtacgcttatggttgggatgtgaaaaccgatataaccacgagctggagtcatccgggtcagaaccccaatgccacagcctatgtcgcgtttgatccgaaagctggcgtggctgtttccctgttaggtaacagcaacagcccccaagtgattcaattagggcaggcaatattcgaacacctgcgtggtgcttctgcgaaaggtttgccggaaaatttccccgttgatgatggggactggatttccacggtggcggctgtgattttctggctgggtgggatactgcttttcgtggcggttatgtataaaagggagaacagggataaaggcggtcgcgatggagcaagtgttctggcgagtcgtgtggagacggcgatcatacaagagagttttgtccgatccgcagaaagcatcgctgaaaaaccggtctggcgcgcttttctcagtcggcttatcgtgcagaacgtggctcttgtgtccgtgctggcgattacaccgccgttattgttggggttaagctggacaaatctgcgggtttgggggccgttaagcctgcccgtggctgccgtggggctgctgttcttggtcaacgcggtcagcctgttcttttttctgctgacgcagcgcagcggcagatataccagcaagactttttcctcgttgatgattgcgaaagtcgtcggtctgacggtcatttccgggctgctcaattccgcattggttttattcatcattcaggctattgatagcccgcctgcgtattttctgtacagtgctattctgctgttcagctgtatttacttctacatttccgcccgtaaagcagctgaacagcagatcatgcgctttggacatgccttcgtgcagggctggcggatggagatcatccggaaactgctggcgtcggattacaaaaacatcgaacagctatcttcggggaaaatacagtccgtcgttggggaaaattcgcaagaattagcgaaaagcgttctggctttcgtgcctttctttgccaacttactgacgatcatctttttgttcacttatttgatggtgtttaagtcacctgtagccacttctgtgctgttggcctgcgctttgcccatgatcgtgctttattactgcatttctgaacgagccaatcgcattatgcctcaagcattaagtacccgtagcgaatttatggataccgtggaggatttgcagaaaggctataaaggactgcggcgtgaagcggtaaaacgcagtttctatcgccatgctcagggcgtgtcggatcgttttaaggcattgaggattcagtacgatctcggctttttaaatgccttctttatcggagagtcattgctcaccattttactggttgcggtggcgttgatgttcccgctcctgatcccccattttgacggtaatgtatcgaaagaatatctgatcattctgctgtacctcatcgggccgcttaacgcggtaatgtcggccatgcctgaactcatcaggctgaaaagcctgatgaataatatggtgatgttcagtcagtcaattcaggccgattctccggcggaggtgatgccgaaaattcaggatgtgaaaacgctcgaactgtctgcggtgtattttcactatccggcgacgggaggagagtgcttcggtgtagggccaatttcattgaaagcagaaagtggaaaaagctattttctgaccggtggcaatggctccggtaagagtacgctggctatgattctggcgggtttgtacgcacctgagcggggaacggtcaggataaatggtgaagaggcttcccagcatcagttgctggaacaaacacgggcgatcttcagcgacaattggttattcaaacgggtttatgaccctgcgttattgccgttgcgggaggctgtcaaccagaacatcgcgttgttgggattgacgcaaaaagcaacacttctgagtgatggtgctttcgacaacatcaaattatcaacgggtcagcgcaaacgtctttcgttggccatgctgttggccgatcccagccctctggtcgttctggacgaatgggcggcggatcaggaccctcgttctaaggcccgattttacaaggaatggcttcctatgttgaaagcccagaatcgtatcgtgtttgtcgtgacccatgatgacgaatatttttcggaagcagatgttctgatcacaatgaaaaatggtcagctcattgagttaaagggagagagttatgcttaatcagttgctgtcagaaaatcattttgatcattccaaccagagccgggcgccaaaggacactatcctgaattgttgtattcatgaactgtttgagcggcaggtagaaaaaacaccggatgcggttgccgttcgattcggggagcagtcactctcttatgcagaattaaaccgcagagcgaaccaactggcccgattcctcagagacgatttgcacgttggcccggatacattggtcggtgtgtgtgtggagcgcagcatagaaatggtggttgcgttgctggcggtattgaaagccggaggagcctacgtacctcttgaccctcactatcctgctgaaaggctcgactacatgctgcatgacgctgccccccgtgctttgttgtctcatggcgcggtgccggctggggttcgcgcgctgctggatcaatacgcgatgagcacaaatgtcagcgtgatcgatttggaggccgatgtctcgcagtggtccgggcaaaacagtgataatttgcatccggcggataacgggctgacttcttcccatctggcgtatgttatctatacctctggctcaaccgggcggccaaagggtgtgatgaaccagcacgttggcgtcgtcaatcgtttggtatggatgcaaaaggcctatcggttgaatgcgagtgatgccgttctgcaaaaaacaccctttagtttcgatgtgtccgtctgggagttcttctggcccctgatgtacggcgcccgtctggtggtggcaaaacctgagggacataaagatccggcttatctgagcgcgttgattcaagaacatcggataactaccctgcattttgtaccgtcaatgttatccgcctttttggatcaggctccgtcagaagttgacgattgcctgcaacgcgtgttttgcagcggtgaagcactgccggcgcgcagtatgcatcggtttcgggagcgttttgctaaggtcgaattacataacctgtatgggccgaccgaagcggccattgacgtcaccgcctggaattgctgccttgatgaaacggatagcttgatcccggaaaatgtgatcccgataggtaaaccgattgataacattcagatttatatcctcgatgctgacggccaaccgtgcccggtcggtgtggcgggtgagcttcacattgccggtgtgggcgtggcgcgcggatatctgaaccagcccgaactaacagcggaaaaattcatcaaaaatccctttagtccggcattaaatggcgtcatgtaccgaacgggggatctggctcggtatttacccagcggcgacattgaatatctgggacgtaatgactttcaggtcaagttacgtggcttccgtattgaactgggtgaaattgaagcacgtctgatgaagcatccggccgtacgcgatgccgttgtgctggcgcagggcgagagtgcggaagataaacgcttggttggatttgtcattgccgcggaacgcgccttacagcgccagtccagagagagcgtgaaagagagtattcaacggcttatcaacgatacggtgcccgattacatgaggcttgccgctattgttattgtcagcggatttcctttatccgccagcggtaaaattgaccgcaagtcctttccggtgatcacttttgatgaattcacagcacaagacgttgaaccgccgaaaaatgcgttggagcaaaccttggttgaggtgtggagtgagctgctcggcgttaaaaacatcggcagaaacgcccacttttttaacttgggcggccactctctactgtctctgaaaatggtactggcgctgcgtcgtcgtggactctttgtggatggctacacgctgtatcagtatcccgtattgtccgaactggcgacacagttgcaggtgtccgatccacaggaaacccgctctgacatggcggaatgctctatggtggaagcgtccgcctgggcgcaactcagccaaaaagaaatcgacgttctgactgccgccattcccggaggcctcaccaatatccaagatatttatcctttgggggcattgcagcaggggatgctctatcactatctgacgaatttggcgggagatccctatgtgctttggcaggtcgtccgtttccgcaatgcagacttgctgcacgcttatgttaacgccctgcgcggcacgattgcccgtcacgatacgtttcgggtcagcgttcattataaaggacttagccagccggtgcaggtggtttggcgggacgctgaattgacggtggaagagctgaaacccacgatggattgcgatgatccgttggtcatcttgaaacagcattgcgatcccgccatgctgcgttttgatatcactaaagcacctttgcagcgttgtctttattgctatgacccgaaacgggacgaatgggtattgctgcatttgatccatcatatgacggtggatcacacgacggtagaaaagatgcagcaggaaatagaagcgcaactgagttcagaaccgcctgctccgattgtgcccatatcgttcaggcaggtgaacgcggatcttgtccgtgcaactggcgcggaagcgcaaaaagcattctttgacgctatgttgcgggattatgagccgactccggcaccgtttggtgccggtgaatacttagggggcaacgcggtggtggtggaagcctggcgaccgctgcaagaacgtttatgtagtcagatacgccaacaagccaaagcacacggtgtcagtgcggccgcagtttttcatctggcttgggcgaaagtgatcgcctgcctgaccggatgcaacgatgtcgttttcggtactgtcttactggggcgcatgtttgcaggtgaaaacgctgaaaacatcatggggccgtttatcaatacgctgccgatccggatacgtctggataaccttgctgtttttgagtgtctttggaatgctcaggatactctgacgcagctggtcaggcatgaacaggcgtcattagcgctggcacagaaatcagtacagacacagggaacagcgcctctgttcacttcattgctgaattatcgtcacagtgaagtgcgcaatattccttcggcagatccttttcaggcaatgaatccttcctccataaatggagtcagttattccggcagtatggagagaacccattatccggtttccgtcaatattgatgatttcaccaacgattttgttattaatgcacaggccgaacaggggcttgatcctgaacttatctgtgactacttgcagacagcgttacaggaaattgtcaccgcgctggaaagcgcaccagagagaagaattggtcggattcatgtcttgccggcgcaggaaaaagataaattgctgtggcaatggaatcagaccgaatctgattttccgcgacagacttgcctccataccctgattgaggatcaggtgcgtcggacgccggatgctattgcggtggtgttcgaagaccaagtgctgagttatgtgcaattgaaccagaaagcgaaccaactggcccgattcctcagagaagatttgcacgttggcccggatacattggtcggcgtgtgtatagaacgcagcatagaaatggtggttgcgctgctggcggtactgaaagccggaggagcctacgtacctcttgaccctcactatcctgctgaaaggctcgactacatgctgcatgacgccgctccccgtgcgttattgtctcatggtgcggtgccggctggggttcgcgctctgctggagaaatatgcgatgagcgcgaatatcagcgtgatcgacttgaaggcagatgcattgcaatggtccgggcaaaaagctgatgacttacatccaactgacagcggactgacttcttcccatctggcgtatgtgatctatacctctggatcaacgggacgaccaaagggcgtgatgaaccagcacgttggcgtcgtcaatcgtttggtctggatgcaaaaggcctatcggctgaatgcgaatgatgctgttctgcaaaaaacacccttcagtttcgatgtgtccgtctgggagttcttctggcccctgatgtacggtgcccgtctggtggtagcaaagcctgagggacataaagatccggcttatctgagcgccttaatccaagagcaccggataactaccctgcatttcgtgccgtcgatgctgtccgcctttttggatcaggcaccgccagaagtgggtgattgcctgcaacgcgtgttttgcagcggtgaagcactgccggctcgcagtgtgcatcggtttcgggagcgttttgccaaggtcgaattacataacctgtatgggccgaccgaagcggccattgacgtcaccgcctggaattgctgccttgatgaaacggatagcttgatcccggaaaatgtgatcccgataggtaagccgattgataacattcagctttatatcctcaatgcttacggtcagccgtgcccggtcggtgtggcgggtgagcttcacattgccggggtgggcgtggcgcgcggctatctgaaccagcccgaactgacagcggaaaaattcatcagagatccctttagtccggcattaaatggcgtcatgtaccgaacgggggatctggctcggtatttacccggcggcgacattgaatatctgggacgtaatgactttcaggtcaagttacgtggcttccgcattgaattgggtgaagtggaagcggcgttgttatcgcatgacagcgtgaaagagtgtgtggtgctggtgcgtgaggatgtgccgggcgatgctcgtctggttgcctatgcgacccctgcttccggctacgtcgatcaggttccggaggagcggagtcaaacgctgagaatgcacttacagacgaatctgcccctatttatggtgccgtctcacttgctttggcttgatgcgtttcctctcactgcgaatggaaaactggatcgtaaagcgttgccatctcctgctgatgccccgatggggcaaacaataaccgtacagcctccacaggaaggaacggaaactcaattagcccagttgtgggccgagttactcaatctcaatcccaatgcgatcggacgtcaatctcacttttttgaagccggagggcattcattactggctgtcgctcttatggcgcggatacagcaagcgttcagcgtgtcattgctgctgagtgcgatagtggaacacttggatttggcttcgcaggccgagcttatcgagactgaaatagaaaaaggaaacgcagcaagggaaaacggggagcgagcgcatttaaccgagccaatcgaaccgacgcctgtcgagcagatccgggcgttaccaacgcaaaaagccatatataaagcagtaaaacttaatcctcaagacttaagcaataacagttttctcgcgttgtcgttcgacgatgatgtggagccggatcttaaacaactgcgtaatctattgcagtcggtactttcccgtcatgaaagcctccgggcgcaatttgttcttacaggcgatgaactctatttgcgccctgccaagcgttttttattccggctggagaaacgtcaaactcttggcgctctggaagaagatctgcgcgattttatccgcccgttctcgctggaagatggtatgaatgttcgcggtcggtgggttgttgatgggcggcatccgcttttgctgttggatttttcccacgcctgtattgatggttctggtctgatgcaaatactcagcgagttagccactgaaaatgaccctgctccttcgggaacccgtctggcaacttattctgagcttttctacagccgtgaatttaccactctgcgacaagaacacgcggacttctggcgaacgcagttacaggagtggtcgccccttgtgcatgcgcaggacaccgagtcagtcacgcacacttgcctgattacgctcgacacagggcttaaagggcagattgaaacgctcacgtcacgattaaagatcagcgttcctgaattctttatggccgcattcttgttgtttaaagcccgtctggattatcagcccgctcaacgcaatccgcacgatcaactgacgtccatgatctttcatggtcgggacaggttggatcaacagacggtcatcgtgccattgatgtcggttctgcccgtgcgggtaaggttgcggggcgagacgatggaaccggagatgcttcatgaagtgagcatagcggtgcgcgcggcctgtcgtcattacctgtttgatgccgaagaattgacggtacggtatccggcgctggctaaacaggtattatcccccacgtcttttttcggttacttccagaaagagggctttgacggccgtattgcaggccggctctgccggcagctggaaacgcccaatgttgcaggcgggcaatcgcactggaatctgacctgcgaaattgccgagcataccacgggctttgacgttcatctggaagcgctctcgttcagtacaggaagcgacgcaggaaattgggaagcgctgtttaagtcgattgtgcaaagtgcgctgagtgtcgggtgatatgaaaataaagcaggaaattgcggaaatgcacactaatgatcccattgtgatgaatgcaagaaaacaagcattaaaagattatgttcgccaacaactggatgccggatatcagggatgtcccttttttgtgtctcggctggcggcctcggggatgaacacagaggttgtcacgacgtcattcactcttgccgaaccactgaacagcagaattttcactatggcggcgtctccgctgcatcgtttgtcgctgttttccgcctgcatcaagtatctcgcctttttgcacagccgggagccggaagggagcttgatttgggcgatcggggcgcaagataggtcgggcaacggaacaccggcggttttgtccaatgaccctcccgccggagtttatctcgtcccagctaaatggcatctgacggaaacggagctgacacaaccggtaaaacggctgtttggtgaggagcttgcgcaatggaagcgaatagccgcgttgacgtccggcatgcctttgcaatcggcgtcttctgttatgtcgcaatcgccgcaagtgttggtaggttactctgaaacacagacaccctttgagggaacagatacggcgcattattcactgagtatctggatcgaagcctgtccccaaaagacctgtctgcatatgagattcgattcgcagagggtggacgcagaactgacatcgcttctgatggatcgcttgaccttgttattgaacagcatggtattcgagccaaactccccgctcgcgtcgatgccctggatgccggtgcaagagcgggagagaatcgctgcgctgtccgcccccgtacccgcgcagccactgaggtacaaaaatgtggagcaggccatgaccgcctccatgcgcgacagagctgaaacccagtttctggaggtcggtgatcagaccgttaactttaaacagttggagcagtacacggctattttgttgaccgatcctaatttgccacaatgggaatcgttaggcgactgtgtgcttattgtcggcgccaagggagtggaaatcacactcgccgcaatggcatgtatgcgtatcggtaagccgttctgcctgcaatcccacagcgcgcctgaaagccagttattggacatcatcgagctgcataacaccaaggtggttctgctacaggaaagttgcggtgagatggccgaactctttcgcgctcagggctgtcaggtcgttatgctgccttattatgtaccggatgcgccagtcaggctgacgcatcgaacggagatgtctgttctggcggcgttgctgcgcaaaggtgaggcagtcaatcccgacgacccattgtgtgtggtgatgacctccggcagtgagggcaaaccgaaaggctgtatcaatactcacaaagccttacttaatctcagtgctgaaaaacaagccctgtatcacaccgccggctccagagttgcctccgtagcgaatcatacttttgattatttcgtactggaatgtgtgcagtgtctgactcaggacatcgtgctggtcatgccgccggaagaagcgcgttcagacgctggaaaatgcgtcagatttctgcgggaaagccgcatcgatttattgttcaccacgaccgtgctggcggaatacatcatggagcagggagatattcctaacttgcggcaattgtattttggcggcgaaagtctgagaacgtttcaaaaaaataattacgagctgtttaatgtatacggccccagtgaaaccggcgttctgacaacttatttatccatagtgcgtaatgaccagaaagtcactatcggtaaaccgttcggcggctgccagtgtgttgtggtatttcccgataccttagaaccctgtcctatcggtgtatcgggtgagttgttgataggaggagccggcgttggggcgggctacataaatcgccctgatctcactgaaaaggcgttcatagatctggatacggaatggttgaaggggaaatattatcgcagcggtgatctctgttgctggaatgttcagggtgagattgaaattgaaggaaggcgtgatcgccaactgaaagtgaacggtttccgcatcgaattggatgccattgaaaaaaacatcttagatctgccgacggtggctcaaacggcagtgattggcatagaagaccagcgggggcacactcacgtaggtgcttttatcgtaacgacggacagtggggtcacggaacaaaacgtcagagaggcgttattaagccggatgcccgcttatatggtgccaagtcaggtgattctggtagcggaattaccgctgacgcgcaatggcaaactgaatcgacaagggctaaaacaggcgtttggcaaggcgatgaacggtaaagttgtccggcctgacggggcaacccaagaatggctggcagcctgttgggcgcggtatttggagttggatgttgacaccttgtcggtagacaaaagttttttctctctggggggtcattcgttacgggctgcaagggttctggcggagattcaacatgaatttgggcaggctgtctctttgttggaattttttcaaaacgatacgattgaggcacttgcgaaaacaatcgacgccagacgaaccggcggtgacagcatggtgacggagagtttctcaaatctgctggaaaccgcacctcagtttgcggttgacgggcgtgggccgttatcggcacaagaagttcggctttatgcagaatatcgtctgcatccagaatcacaggcttatattttggcgctggagatcccgctatcccatgacctctttcctgatgcagtgaaacaagccctacaggctctaattgaccgccacgatattttgcgtacccgatatcgtattgatagtgaaggtattccctatgctgagatattaccgtctctgccggttgacagggtactgatcgatgatcggaatcagtggttgcagatgcggacgcaggctttcgagttgggagaagcccctttgttgagaggctgtctacaggaaataaacacagagcacgcctgtttgcagttacagatccaccatattttagtggacaaaccttcgttggagatcctacagcgtgagtttcagcaattgctggcgcacgaatcgttgtcttgcgtggcactgagttacaggcactacgcaatggcattagcggatgcccgtcaacgcccggtctggacacaggctgaggcattctgggtagactatcttgaagggctggaattcgatccgttcggacatggcgcggtggatgcaggtggcaaggtgaaaaccctatcctggcatctatcggccgcagatatggcagcagtgaaacatctttgcggagccgtcaacgtgactccggccatgtttttcctgtcggtgtgggggcttactgtggcgcgcgaagggggaagtcatgccttttccatttcagtggcgaatgcatttcgcccaaaaaatgcgctggagaccgtgggtatgttcgtctcgttatccccttgcgcgtttcgttttgataagccgacagcaacctttgaccgatttattaagaaattggccgatgagcagtggcgtatggtggatcagcttttttttccggttgaagaggcttttgcattgctcagccgtgatcccaggatgtttggcagcaatccactgcttaatgtcgcttattcctatcttgacgcagcagatcatgaagcgccggatgcagacgatttatcgctggaagcgcatgggccgctcaatcttaccgtcagccatcgtacgcaaggtatacaaaagacacaaagttgccgattgacactggaatatcagatcgaggctttccctgattcacaaatagaagccatcgcaaccggctatcaggaaattttgcggcagatcttgagtcacgctccttccattttgcagattgatgagctgatggtgtctgctgatgcagttaaaaaggcctttcggccagtacaacgacgtgcgtcgtatcgccaaatcgatgccatgctgattaatgggtttctgacattgaccgaccgtcccgcagtgattgatgaagaaggcatcatgacttgggaagaattcgctgcattaaccgctgcatatatgcaggttctaaatcaggggacgattcgacgggcactcattttaggacgtcaggggcgtcaattacaggcatttctggcggcgtgtttcctgacgcataccacttatctggcactcgaaacggggacgccggaggagcgtattaacgaagtgatccgccatgcagagccggatcttgtgatcatgcacggagcggaaattgacgcggcggcggtgtcagagatgggtgtgcaattgcaggataataatctgcttgctcctgtttccattaattggcaaggctttcacagcctgaagtcctgcgacgataatcctatcgcatggatattgtacagttccgggactaccggcaaacccaaaggcatctgtgttgccgcgcatacggcggcgcagtatgtggattcactcgtcaataagctggggttaaagcaagaattgcagacaacgccgcagggattgcggattgtgcaacagttctcgcccagttttgacggttatcttgaagaagttctgctcgcttgggcgttgcagggaacaagtgtggtcgctgaccgttacagtttattggatgaacgcaaggtgagggcgtttttacttcgctactgccctgatgtcatttctgcggctccggctcttttctcagcctggaaccgtatgccagagttggcacctttgcccaagatctgcattagtggtggtgattttctcgctgccggagatatcagccaattactcgaacgtacacagatttggaacagttatggccccacagagacctgcattgctgtatcgatggtgaactgcactcagttggcgtcaggcgcggcactttccatcggagaacccttcgaacatgccgcttttgccgtgatcgatcaggatggcggccggcttcggatcggtcaatggggagaactggtcatttatggggattttgagcgtcacggttatctgaatgacccggcgctgactgcaagtaaatttggccgggacgttcagggaacgttcttccgtaccggcgatttagcgatggcggacaaaaacggcctgttttacctcagagggcgaatggatgatagctgtaaagtgcgagggaatttcatcggcttgggcgaattggaaaaccgagccggacagtatcctgatgtgattgcggcgggtgccgcagtggcgttcgccggaacaccggaggcctgtctggtactggcgattgaaggaaaagagaatatacagtcggatctgcaacagtatctggcgcgacattatccccgttcccacttgccgtcggcgatatttccgctggcgtctttgccgcgaaccgaaataggcaagctggatcggcagcggatcgtggcacggtttctggaatggcgtgaaaacacgcaccaaacacaggaggagcaggtagcaacaatgagcgagggagtgcaaaaattaatcgcctgctggaggacatgtttgggatataaaggggagttgacacaggattctgacttctttctggtatccggatcatccctgagtgccgtgcgactggctaatcaactggaaacgctgttcaacgtgacattcagccccgtcgatgtgttccgcaatgccacgatcggcgggcaatggtcgctgatcaacgcacggcagggagcggatgacacaatgccagtgaaattgttacaagagcgttttctgaacgccgatgatcctaacattgccaaactgatactgttgccgccggcgttagggggattgattgaattgcaggcgctggcggacaaattggccggtcgcgtcaccgtgtctgttttaacaacggaaccccgcgatgttgaaaacctgtcagtgcaggaatttaaacaggcgttgctagatgctctgacatcgcacattaaagcgcagggcatacacccgtcacgctcactgtggttgggcggctattcccttggggcggagatgctggtggcattgctggcgcaacaagcggaactatcgcagccatcgcagcatttttcccaatacatagacaaattggtatttctcgatcctaacctgcgcaccgatatttttgcgggggatgagctgtatgcagagttcgttgagttctttcgcgatgttaatcggttggcttttgattgtgcaggttttgatgccgatatggatgttgaaacattgcggcggcagtttccttcgctctatcaggagtggcgctattaccaattacagcatcagatccttgaaaacaagacattttatgagcggattctggctctgccatcagaaaatctccctgtcgcgatgttcttttccgacgatgcagacgaagccggtattgatggacttacgcaaaaaatgaaagggtgctgcaccgtccggcgtaaaagcggtgatcacgctgaattcgttaagcaattaacgtccgatgactttatcgatctggaacagggtaagacattatgcgtacagaaataagagaagatttggatatcgctgtcatcggtttatcaggccggtttccgggagcagggaattacagtgagttctggcgaaatttactgatgggcgtggatgggatctcccgctttacggcagaagaattgcttaaagcagggcatgatgccggcaagatacgtcataaagacttcgtgccggttaacggagtactggaaggtgcacagtatttcgatgcggagttcttcggctacagtcaggcagaagcggcgcttttggatccgcaaacccgtttgatgatggagtgcgtttggcatgctttagagaacgccggcgtcgatccggacaaacggagtcgtaatatcgggctgtttctgggggcgcgtagttcggtgcagtggacgatgcaggcgatgttgtctgaacaggttgagaatacaggcggctttcttgcctcccaattgtccaataaagatgcgatgagtacgctaatctcctggaagttaggactggaaggccccagtttcaccttgcagaccgcctgttcaaccagtttggtcagtgtccatcaggccgtgcagagcttgttgagtggtgaatgtgatttcgccgttgccggcggagtcagcctgctgttaccgcagcaaaacgggcatacctatcaagacgggatgttattttcgaaagacggcaagaccagagcgtttgacgcggaggctaccggcagcgtgttcggtagcggactcggcgcggtagtattgcggcgggcgggagatgctattgcggataacgatcctatctgggcgatcctcaaaggctctgccattaacaacgatggtgcccgcaaggtaggctacaccgcgcctagcgttaaagggcaggcggaagtgattcgctctgctttgcagatggcagaggtagacgcggcggatctggatttcatcgagtgtcatggcacggcgacctctttgggagacagcatcgaatttatggcgttgcgtgaggttttcaacgaaagaggatcttccgccagtgcagaggagacactcaatcaatgtgcattgggtaccgttaaaaccaacatcgggcatctggattctgccgcgggtatcgcgggtttcattaagatggtattggcactcagacatggcatgataccgcccacgctgcatttccaacggccgaatcctcaattggaatttgaacactccccgttttatgtcaatacccgcgctgaactgtggccgtcaaaccaagggaaattgagaaccggtggcgtcagcagttttggtattggcggaaccaatgcgcatatggtgttacagcaatatgtgctccctccgcagaccatgaagacaagcggcggtgacaaagtacccggagtctgtttttttccgttttcagcaaaaaacagcacttctctggcacggcaactggaatcagtatcccagtggttggtttcacagcccgatccggatttatccgcgctgtcccataccttgggcaaacggcacagttttccgtatcgagccgtgtttgcggcagattcgaagtttgctctgatgcagcaaattgaacgctatctggcaccggatgaacagacggagagtctggcgctggttcggcaagtcctggaaacgacatcgccggatagtctctcagagaattttgctgctatcagcgactgggtatccggtcagacaaaagagcttgagaaatgtcttttcagccccggtaacggacaaccgttgatggatgtccccggatacgctttcattcgcgaggagcatggaatcggacacattacagataaaatctggtcgcagattgccgatatcgtcgcggcacctgatggcaaagatctgtctaaaaatacggcgggtctgctaacaccattctggaaacctctacgcttgccggcacaaccgatgtcggaggtgaagccggataccgtgctgctggttgaccagacgttagcgtctcttgcgagcgggttggcagacaacagtcagattgaggttgtcagtctggatatgctgtgtccggtacggatgcggaacgttctggcaaaattgtctagtggttcgcaaataacaggttcgcaaaagaacccgtctctggtgttgtcgctggcgtttccgacagagggtttttcttttgcgccagcgtcactccaaattttatctgaattaggccgggcgcttgcggagactgatttctccgtgtttacttccgtgcatatttatttgatcgcgcccgctttctccatgaccggcgataatggatatctggctgaatctgtattgacggtggcggctcttaaagcgttagcgttagtgatacctcaggagattcccggtgtcagttgtgcgtttctgagcattcagaatcccagtacagattggacgcccgccgcgctgaccagactgctgcaaactccgttgcacgggcctctgaaacttaatgatgaggggttgtttgttgaagatttccgttgtccggatgcggaagaaaatgacgtgttggatgcggcgtatttcagcggaaaaacttacgtcattacgggtgctggcggcaggatggccaaggcgatggcacgggtgatcgcacgacgttttcagggacggttggcactaatcagtcgccagcctgcggactctcctgccatgaggagtttacaggaagagttgaaggacgcgggcgctgaggcggtggagatttttccgtatgcactggaatcggaagccgacgcattggcgctgtttgagtccattcgccgtcgttttggggagatcaacgtggttcttcacgccgctggcgtcacggatggtgattccttttcccctctggttcaactcaatgccgaccattattgcacgcaactcgcgccaaaagctcaggtggcggcagtactcgccaacgtattcgaaagcattcccgttgaatattgcttcgtgacatcttcgatgtcggcgtttttcggggggattgcccatgcgccatacgctgcggccaatctgtttctggatggttgggggcagatgcaaaacagacggttgacaggaacgcgttgggttgttgtgaactgggaaacggttcatttcgacgaagatcgtcgggctgatgcactcgtctggggtgccaatgaagttgctctctctggcgctgagtttcctgctctgtttgaacgcagcttgcgtgaatatgatcacgaaaaccagaaaattttctctgccggccagtttatggatagattgtatgcctggggaggaagacgtgctgccaagatcgatcacagaccgcaggccggagggaacgtcaaattgaagcccagaccgaaaacgctgacttccgtttatcaatcgcctgccaatgagatgcagaaggaaatcgccgctatatggagcagtattctcggtattgacggtatcggcattgatgaccgatttatggaactaggcggcgacagtctgaagaccattgtgatggcggaaaaagtgtataaaaaactcggtaagcgagtttctattcaggactttttttcacagcccacattacgggagattgaacgacagttagtcaacgaccaaaacgcttctcatcctatcttgccggccatcgacccgtctgagccaattatcgccagcgctgatcaggaattgttgtatatacatcaaaccacgtttaccgacgccagttataacatgccaatggctttccaatgcccggcggcgatcagtgcgatcgccatcgctacagcgatagaacaagttgcagaccggcatccggtcttgaaatgtctgtttaaaaggcaggggactaatttgatgatgctgcctcagcttgacgctaaagtcagcttggccatatttgaggctgaacccgcgcaggaggaaaatcaggctcgcctcgaacagtttgctaaagccccttttgacctgcataccgaactgccaatgcgcgccatgatgataaaaggtacggatgccggccagttccatcaggtgttgatcgtcgtccatcacatcgtatgcgatgcggtttctctgggcatactcgcccatgattttcagaataggcttgaggagcgtccgttacctgagccggagtacagtttcgcggcctatcggcgctataggctggagtttgagaacgaagatcaggtgcggaaaaataaagcctattggctcgccaatctattgcctttacctgcgtcgctggtattgcctacagtagatgattatgacggacatatcgacgccgacagccatcggggagtaacgcgggttaaaagtctttctgcgcaaaccagcgaagaaatcaggtgtttttgccgtgatctggggctccctgtatttacctttttcctcgggacattcggggtgctgatgacgaaaatcgcccgtgccgaatcctttcttctcggtgttcccgtcaccggacgcacacagccggaagaattggcgctggtgggctatcttgtcaatatgctggctctgaaaattgagccggatacggattttgccatgacggattatcttctggagcttaatgcacagtggtctgaaagcatcccttatcagacttatccgatgagcgcgctgctggatgatctgagtactgagcatgacttccaaaaccgtcaaggcaaacatccgttgttcgacgtggttttcgggtatctgccactgagtctgagcggtgcggatgaatccgcgtggcgtcccggattttcccgactggaactgacgtcagatacggccaaatttgatttggtgatggaaatatccgaaacccaagagacatttgattgcacgatacaatttcgtgaacgcatgtttagtgaagccatcattatggcggtgtttgagtacttcttcgcgttgatagaggaagtactcaccgatcctgatacggaaatacaggaattactcaagaaccttagcggtgagcctacgccggaaatgtccgctcagacgagcggccagaatgtggattcagagtttaatttttaggggagggcgagagatgagtctttttggtaatacatggaatgcgctcggtgatgtcgcgatgtgggcgtttgaagaaatgagtatttatcggcgcaggcaggggacacagcgagaggttggcaacaacgatgcactggcgcactttgaggcggctgaatatcgcaaggtggagaaagtttcggacatttctgtcgctgagttcagcgaacgctacttaatgaagaaagaaccggttattgtcactgatggtttgagaggctggcgagcgaagcaaatctggagctttgattacttttgtcaggagttcggcgatatgtccgtacgattgcaggatgcgggattcaaaccgaaagaccatgttgagttgcgcacctatttgcgggaaatcgcgtcattgcctgccgttgaactgggcgaaatgggggacaaccttagctatctgcgatacacctacgattcattttttaaacacctgctgttcacttggggatttggtcacagggtgaaaaccaactcgttcagttttctggcgtttcaacgcattcaggagcattggcgcagaccatattttctgccggatggcggttataagatcccctgggttcagataggatctctgcaccccaacaagcggatgtgtcaggattggggactctatttttctgctccgggagcgtgtacccgtttacatgtcgatggtatgcgaaccaatgcggtgttgtgtcaggttgcgggcagaaaagcaggctggatcttttctgcttcgcttgaaaatgtggtcagagatgctgctgaaagtcgtattgctttatcacccgtcgcctcccaaatctccggtagaaaaaatcaggcagattcaccacacagcaaagattgcatatggcaattcgatttgctgccgggtgagattatgctgatccccaaagggttagcccatgaagtgcataccttatcgccgagtatttctttgacttataactttgtcactaattcggaatatcgtgattacttcaatttcaaacgcgagcgcggccatggctggatagcaaatgcaccgattgccgctgttccagaattcgcccgtatttaccagcgtaaccagaggctttagttttgactgttgctggcggctctgtccagattgaccaagcctatttacatgtgatgaagtgataccatagtttgaagaacgagcaagggggtgagtatctcaaacttccgcttgtctttccctgagttatttgactgagcgccatcgtgcgctcgctgattccaaccaacgcgagtaagaagtatgcctttattttcacaaacaataactgatttttggcagaccccatttttgaacggagacgttctctatagtgatggaacctttacggtcactgtcaaccctgatctgaacgaagatcgtcgggtcatggtgctggaaacttccgacggccgagtgatggcggttctgacgcctgcactggctgataaggccggtctttatcaacagcaagagctgtctgaatcgattttccgccagaaattgactgaagcgggcgtcacgctgcatggtgcagattatattttttatttttcagaagtggataagaacgttttgctgcaagagagtccggcaggtgtcttgcgtcagttaacagagcaagatgaggcggttttctccgaattcgaatcatcttcctcagaacaagacttggatgacgcttatgtagaattggatcactgggcggtgttcggctcttttgaacagcatcgtctggtcagcgcggccagtatgtatccgtgggagaatgcgcaaattgcggatcttggtgtattaacgctgacatcttttagaggcaaaggccatgccagcaaagtcgtgcgttcaatcagtcaatatgcctgtcatcagggctatgaacctcagtaccgatgccagctcgataactatgcgtctacgtcattggctaaagcggcgggattgacgctgtttggcaagtgggaagtgatttctcctgattctactgagtgaacggtgccggtgatccaataaatgaaccggaaatagcaaccttttaaaacccaacaagaaagtagtcactatgtcaaaacttaaaatagctgtggttggtggcggaaatattggttctagtcttgctttcgattgtgcgttgcacgggcatgatgttgttgttatcgaaaaagatgttcttgcctgcgaacagagcagggaacgcgtcacggaaacggcgggttatgcacctttgttcagtccgctcgctaaaggaaaaacaaccgaggagatactgctcaacatcgtctggtcgcaggatttgcaagctgtgtcggattgtgggtttgtggtggaaaacatcacggaaaatatcgagcttaaacaggcattatatgcccgtatgtctgagtttattgcaccccacgcggtattggcggcgaacacttcctgcatccctatcacaaaactgggatcgtttcataaaacgccttctcaagtgattggtgtgcattttatgaacccggtttatctgaagcataccgtcgaagtgattgtcggtctgaatacttctgagcaaaccaaagcgcgatgtctggaaatcttggggatgttgggtaaaaacgccgtcgtagtgaaagatggtcccggtttcgtctctaaccggatttcccatttatttatgaatgaagccgctttcaccatacaggatggcgttgctcaacctgcggatgtggacgctatctttaaacaatgcttcggccataaaatggggccgcttgaaacagcggatctgatcggtattgacacagtggttaattccctcgatgtactttaccagatgtttcaggattcaaaatatcgggtctgtccgctgatgcggacaatggttgatgcgggacgtttgggacgaaaatccggccggggtttttacacttattaaatcttttatgttcaggttatatttttattcagcgagacagcagcagcgaccaaatatctggtcgctggtttgtgcgcaaatatcgtttttagccgtcgtgacgtaacagagaataatatcatgacgacgctatgtaagaaactatgtaatttaacctgggatcggtttaagccattacttgaagtcctgttttctcggtatttgagagattcagtgatggcttttttggcttcaaacaataggcaatcaaaccggcagtgtcgcgttaacggcggcaagttagcaaaagtggtgttgccggttatttaggccgccagcaaatagaattgttccgcgggtgataatccatcactttgtggatgttgatattgccctttgcgtatcatgtgaatcagttcgatgccggccaggagcgtctgtgcccggcgaaacgatttgaaccccagcatctgtcgtatccgacgtttgatattgcggtgatcttgctcaaccagattattcaggtatttattttgccggatttcaatcccctgctgaggcgatccttccgcattgaggagagtgagcgcggcagtattggccccacttttatcgatagtcacgacggcgggtctgccgtgcaggcgtatcgctttacggaaaaaacgctgggcagccattgcatcgcggcgagcggtcagcaggaagtcaaccgtctgaccgtcggtatcgaccgcccggtaaaggtatttccactgacctttcactttgatatacgtttcatccattcgccaccgggagccaacgggctttttgcgaggtcggaaagccttgccgagcaggggcaccagacgtaacacccaacgatgtattgtggcatggtcgacctcaatgccgcgctctgccatcatctcttcgagattgcgcagactcaaggcataagcgaggtaccaacggacacattgggccatgatatcgacaggataatggaggcgtttaaacgcgtttcggatcagggacatcactctggactcgctcaaaaacaggggagcttacctgatgaccgcttaatgcgacagaaccctcaaagcagcccaaaatacggtcatgtattaaatagttagttgttatgataatcttccggtatttcgtggtggaacatggctaaagtagaagttgattgtcgttattgtcacaaatcagaagatgtcaaaggacatggaaaaggtcatagaggttatccccgctaccgctgctatgcctgcagtaaagtctttcagttggcatacacctatcaagcttgcaaaccgggagtcaaagagcagattattgatatggcgatgaataacagcggcatccgtgacacggcccgcgtattgaaggtggcaacagctactgtaatgaaaacgcttaaaaactcaacccccggaacgtgacgacgcttcctcttgacggggatgacattcatcttatctgtgaagtggatgagcaggggtcgtttgtagggagtcagaaaaatcagcgctggctctggtatgcctgggagccgcgtatgaaacggatagtggcacatacttttggggatcgcagcagaaaaacatgggaaaaactactggcactcttgtcacccattaatatccggttttactgtacggatgattatgccgtttatgattgtcttcctgaagaagcccatcttactggaaagatatttacccaacgtatggtcatgtattaaatagttagttgttatgataatcttccggtatttcgtggtggaacatggctaaagtagaaattgattgtcgttattgtcacaaatcagaagatgtcaaaggacagggaaaaggtcatagaggttatccccgctaccgctgctatgcctgcagtaaagtctttcagttggcatacacctatcaagcttgcaaaccgggagtcaaagagcagactattgatatggcgatgaataacagcggcatccgtgacacggcccgcgtattgaaggtggcaacagctactgtgatgaaaacgcttaaaaactcaacccccggaacgtgacgacgcttcctcttgacggggatgacattcatcttatctgtgaagtggatgagcaggagtcgtttgtggggagtcagaaaaatcagcgctggctctggtatgcctgggagccgcgtatgaaacggatagtggcacatacttttggggatcgcagcagaaaaacatgggaaaaactactggcactcttgtcaccctttaatatccggttttactgtacggatgattatgccgtttatgattgtcttcctgaagaagtccatcttactggaaagatatttacccaacgtatagagagaaccaaccttacccatcgtacccgaataaaaaggctgaatagaaaaacaatcggttattccaaatctgaagaaatgcacgataaagtgataggcactttcattgagagtgaaaactatatttagtgagcattctaactatttaatacacgacccaaaatacggaagtctggctgtggcccataatcgaaaacctactccaacgggcgtggtcggaaacctgtttttggctggaaaaagcccaagcgtatttatgtcagaacgcgttcaaaacaccacaaagaaaatcatgtaaatacaaaacattggatgcgtgttttgaaaggcttaattcttaagagcctgtatatgtatgttcatatatgatttttatagtttttaattataattaattaattgtttttaatcgattattttatacataaggatatgtcactgcaaaacgtgccaaaaatggaatggaggcccgtttttatctgtagattgtaagaatgatctgcaaatagaaggtgctgaaaatatttcaacgtatttctcttccgcgtgggcagaacgggctttttgtaataaatgtggaacacaccttttctaccatttacttcagcctagtgtatattatgttccggttgccctgttcgaaaatagtcattcaagtaaattatctaatcaagtctatgtggacagtaaacctgcgtactataattttgttgaaaaaacatcgatgttaagtaaaaatcccccttcatagaagggggcattgatttcgccccaaaggggcgctattagttcagactctgagagccttcacttcacatccctttcaacgataattgattgtcctcatgttcgtgcttctcttgatacttcacatacttccttatcatttcttcatttatacctacggtatctacacagtagcctcttgaccaaaaatgatttccccacaactttttctttctcaaatagggaaatttattaaatagacgaatagctgttcggccttttagatgaccaagcacttgagatactgataattttggcggaatttttactaaaagatgcacatgatctatttgaacattcaattccacaatttctattccgagctgctcactggaaatccttatctgcttatttcctttcctacattatttttcaggatcctaaatcggtatttgggtgtccatacgatatggtattgacaacaccaaagcacatgcgatgctttcttgaatctactcatggttaaatccttctctgttatggggataacggattcggattttcccatgagtagcattattggcagagccaacctgttgctaaccacctccgcaggaggtggttttcagttaagaataaacaggatattcttaatttatttaaataatggttttaatatgaggggaattattccctcatattttttgatataaatatatgttttagaataagatattttaattctatttaataatgatttaatatagggtgaataataaatgtggtttattaaatttattaatctgatttttactttatttataggtaacaattttctttctgtttaggattaatatccgtataatcgcttacttatcaaaaagatcttgatatctatcgacagaagatgttgccactatttcagtggatattacgttagtggagacgttgtttgattaatgttttgttagttgatgatcacgaactggttcgcattggcgtgaaaggcatactcgaggatgtaaaaggaattaaggttgcaggagaagccggtagcggagaagaggcggtcagatggtgcagatcaaacagtacggatgttgttattatggatattggaatgccgggaataggtggccttgaggcagccaaaaaaatcattcgctattcgcctgatacgcgggtaattatgctgactatccatacggaaagctccttgccagcgaaagtgatgcaggccggagtcagaggatatttgagtaaggcagcaacacctcaagacatgattaatgctattcggacggtttatgcaggtcagcgttatatctctcctgatattgcacagcagatggcactcgaccagttatccccaccaaaagaaaacccactggctgaactctcagagcgggagttacagataatgacgatgatcactcagggccgaaaagttaatgagatttccacgttacttaaccttagcccaaaaacagtaaatagctatcgctatagaatgttcagtaaactaaatatcaagggtgatgtagagttgacccatatggcgatacgttgtgggttgcttgacgcacagaatatggtaaaccatagtggatgacagttgatgggtggtaaatcgtggcagagcaatttgattcaacggtatttttaaaaacagtaaccagccagccgggagtctatcgaatgtatgacaccactggctcggtgatttatgttggtaaggccaaggatctgaaaaaacggctatccagttattttcggacacaagttggcagccgcaagacagaatcactggtaaaaaatatcgtccagatagatgtcacggttacgcatacagagacggaagcgctcctgctcgaacataactacatcaaactttatcaacctcgctacaatgtcttgttgcgggatgataaatcctatccttacattttcttgagcggagatacccatccgcgtctgaccctgtaccgtggtgccaaacatgcgaaaggcgagtatttcggaccatttcctaactcccatgctgtgcgtgataccttagctctcttgcagaaactttttccgattcgtcaatgtgaggacagcgtatatcgcaatcgttcaaggccctgtctgcaatatcagattggtcgctgtcttgctccttgtgtcaacggttttgtgacgaatgaagaatatcagcagcaggttgactatgtccgtctgtttctgtctggcaaagatcagcaggtactgacagagctggttggcagaatggaagcagcaagtaaacaactgcaatttgaagatgcggctcgctaccgtgaccagatccaagccgtgagacaggtaactgaacggcaatttgtttctggagaaggggatgatctggatgttatcagtgttgcttttgatacaggaatggcgtgcctgcatgttttgtttatccgtcagggaaaaatcctgggcagtcgcagttactaccctaaaattcccgctgataccaaattggatgaagtagtacagacttttctcggccaattctaccttcaaggcagccagaacaggacattgccggcggagatcctgctggatttctcgttgcctgaaaaagaacttttggaagcatccctttctgaattatcggggaggaaagtgcatattcaacctcgcccaagaggtgacagggcgcgttatctcaaattggcacgtaccaatgctgcaatagcattgaccacgaaactatcccagcaatcgactgtccaccagcggttggcatcacttgctgaatttgctggcattaaaaaagttcatagaatggaatgtttcgatatcagccatacgatgggagaacagaccgttgcatcctgtgtcgtttttgatgggaatggtcctgtgcgctctgaataccgccgttataacattgcgggaatcacaccgggagacgattatgcggcgatgaatcaagttttacgccgccgatatggcaaagccattgagcagaccagaattcctgacatcatctttattgatggaggtaaagggcaattagcgcaagcgctggaggtttttggctcgctggatgttgaatggaataaaaaccatcctaagctaattggagttgcgaaaggtagtgatcgcaaagcgggtctggaaactctgtttttcgaggcagaaggcgggggaaaggcactttcttcggattcaccggcgttgcacgttatccagcatattcgtgatgaatctcacaaccatgccatcacaggacatcgccagcggcgggataaagtgaaaaagaccagcacattggaatcaatagaaggtatcgggccaaaacgcagacaaatgttgttaaaatacatgggtggattacagccgttacgcaacgcaagtgtagaggagatcgcaaaagtgccttctatttcgtattcgttagcagaaaaaatctataatgcgttgaaacactaagattattgatgcaccatactgataaactttacatggccagatagttacgaagcattatgcaattaaatattccaacatggcttactctattccgtattgccttaatcccattctttgttttggcattttacctgccattccagtggtcaccgatgctgtgcgctattatctttgttattgcggctgcgacagattggtttgatggtttccttgctcgtttatggaagcaaacaacgcgctttggggcatttcttgatccggttgcggataaagtcatggttgctagtgcgctggtgttgatagctgaacattatcatgcatggtggattacgttaccggcagcgaccatgattgctcgagagattattatatcttctctgcgggaatggatggctgaattaggaaaacgcagtagtgttgctgtatcctggctggggaaaataaaaacgacagcgcagatggcagcattggttgctttactgtggcgtcccagccat

SEQ ID NO: 14960 - DNA, 48223 bp, Xenorhabdus bovienii
  Genomic contig Name=Xb4151_4152.C419
ttcgacgaagagctgaaaaatcactacagttcaggctgctattgactacgttgaaaacgcaggtaaataagcaacacaccttaggcgggcgttcgaccgcctatgttcttcgtcctaaattttttccctccctggaggataaccgtgtctaagcgtcgagtagtcgtgaccggactaggcatgttatctcctgtcggcaatacagtagagtcttcttggaacgctgtttgtgccggacagagtggtatcagccttatcgaacattttgacaccgctaaccatgcaactaagtttgctggtgtggtgaaaaattttaatcatgaagatttcaatatttcgcgcaaagatgcgcgaaaaatggatctgtttattcagtatggaattgctgctggtgtacaagctatcgaagatgcaggaatcgaagtaacagaagccaatgctagccgctttggtgctgctattggttctggtattggtggtttgggtcttattgaagaaaaccacagtacattgctttcggcgggacctcgcaaggtcagcccattctttgtaccttcgaccatcatcaatatggttgcaggccatctgagcatcctttatggtcttcgtggtcctagcatctccattgcaactgcttgtacctctggcgtgcacaatatcggtcatgcagctcgtattattgcgtacaatgatgctgatattatgctggcaggtggtactgagaaagccagtactacatttggcgttgcagggtttggtgctgctcgtgcattatcgacccgtaatgatgatcctcaaggtgcaagccgcccttgggataaagatcgagatgggtttgtgctgggtgatggtgccggtgtactggttcttgaagaatacgaacatgccaaaaaacgtggtgcaaaaatttacgctgaaatcgttggctttggtatgagcagtgatgcttatcatatgacatcaccacctgaagatggagcgggtgctgcgcttgcaatggagaatgccctgaaagatgcggatatttccccagaccaagtgggctacattaatgctcatgggacttcaacgccagttggtgatcttgcagaggctcgtgcggtagaatctgtttttggtgaaggcactaaagtattggtgagttcaaccaaatcaatgacaggtcatttgctgggtgctgcgggagcgattgaatcaattttcactattcttgctttacgtgagcagattgttcctccgaccattaatttggaaaatcaggatgaaaactgccgtttggatcttgttccaggcgaagcacgtaaagttgaagggatggaatacgcactgtgtaattctttcggtttcggtgggactaatgggtcactgattttccgtaagatataaaaacgtcctctttttatgaagagcctcaacatttgttgaggcttttttattcctgattttatgatttttttgaataggcatttttgcactgccacggttcatataatatgataacgctccttaatgtctgaggttatcacgccttcttatcgaaaattagaaaatgaaatgatgtattggattaatggcaaaccgtgtaatcaattacctgttaatgatcgtgcggtacaatttggtgatggctgttttacaacaataagagttgagcaaggtcaggcagctttgctacctttgcacataaaacggttacaaaaaggcgttgaaaaactgtttatgccagcactggattggttgcaacttgaggatcacattaagcaggtggctaccggttgtgaatcaggtgtcctgaaaattattctctccagaggagttggtggtcgtggttatggtattagtgatgctatcgagacaaatcaggttctctcgttgagttcatatccagaacagtatgctatccagcgtaaaaatggtgtttcactcgttcttagcccaattatgatgggtatcaatccccatttggcaggtattaaacacttgaaccgcttggaacaggttctgataaaaagattcattgagcaggcaaggtctgatgaagcactggttcttgatagtgatgggttattggttgagtgttgtactgctaatattttctggcggaaaggtaaaaacgtttatacgcctgatttgaatcaatgtggtgtagaaggggtgatgcggcagaagattatgcaattattggcagaaagtgattataacctgtcatgtgtcatgcgttatcctgaggtattggctcatgctgatgaggtgattatctgcaattccttgatgcctgttatcgcagtaaaccaaattcaggcgcacaaaaatcagcctgcatggaaatatcaatcaagagaattgcatgagtatttattgcctggatgtttaaggctgtagttattcaatactcatcattgaaggatcggtcaaaagtgattacccatgaaacttaaaaagcgtattttcattttacccagcttgattattattgtagcaatcatgtttttttcttttgtgaaaaaaatagaaagctttgctaatcagaaaattaatcttaatcaagaaatgatatttactgtaccggcaggaacagggcgtgccgggctgggaatattgttggttcagcataacttaatcaaagatcaccaattgttgccgtggctattccgattaaaaccagaattggcgaaatttaaggctggcacttaccgtttgcaacaaggcatgtcattgagagcaatcttgcaactattttccagcggtaaagaagtgcaattttctatccgtttcgttgaaggaagtcgattgtctgactgggagaaaatattacagaatgcgccatacttaaaacatgaagcagagggcaaatcaccaaaggaattgactgacgctttagacatgaaagcggaagaaccactggaaggttggctctatcccgatacttacctgtataccgcaggaaccagtgatgttgaattgctaaaacgtgctcatcaaaacatgaacagggcactagagcaagagtggaaaaatcgcgaaaaaaatctgccatataagaatgcttatgaaatgttgatcatggcatccatcattgaaaaagagacagcaatagactctgaacgtacaaaagttgcttcggtatttattaatcggctgcggttaaagatgagattacaaactgatccgacagtaatatatgggttgggggataagtatatgggttctattttccgtagtaacctgactgcttttacgccatataatacttatatgattgaaggattaccaccgacgcctattgctatgccaagcctggcttcgattaaagctgcggcacaccctgctgtgacagggtacttatactttgttgcaaatggtaatggcggtcatacatttacggtgaatctggcagaacataatagggcggtaaatctttatcgtcagagattaaagcaggataaatgaacagcaaatttattgttattgaagggcttgagggggcagggaaaacgactgcaatccgaacagtggttgaaacattgaagcagtatggcatttctgatctgatttttacccgtgaaccgggtggaactccgttggcagaaaaattacgtcaacttatcaaacagggtgttgaaggtgaatcactgacgaataaggcagaagtattgatgctatatgcagccagagtccaattggtagaaaatgttatcaagccagcactggaaaaaggaacttgggtggttggagatcgtcatgatctttcctctcaggcatatcagggcggtggccgtggcattgatcagaaactgatgacatcattacgcgaatcggcactcggcgatttctacccggatttgactatttatctcgatttgccaccagaggttggtttacagcgcgctcgtgaacggggtgaattggatcgcattgaaaaagaatccttggattttttccaccgtacccgtgaaagatatctcgagcttgtggcacaagatgacaccatcaaaaaaatagatgcgacacaaccgctggaaaaagtgcagggtgctattcgtcagaccttattacagtggttgaaacaacaggacgtgcaggcatgaactggtatccgtggcttaaccatgcatatcgcctgttgattgaatcccatcaacaggagcgtggacaccatgcccttttgcttcatgctcatgaaggaacgggtgcaggtgcgttattgtatggattgagccgctggttgatgtgtcaggacaaacaaggaatgaaaagttgtggcaagtgtcacggttgtcatctgatgctggcagaaacgcattctgactggcatgctcttgcccctgaaaagggaaaaagtactattggagttgatgctgtgcgtcagctcaacgaaaggctttacgaatattctcaacaaggtggagctaaaattgtctggctaccttctgccgagtctctgaccgatgctgcttccaacgctttgctgaaaacattggaagaaccccctcaaaatacctatttcctgttgcagtgccagcgtccagctcgcttgctggcaacgctgcgcagtcgctgtttttactattttctacctgtgcctgaacagcgtgtagggctttactggctgcaacatcaactccctgcaatatcatctctggatgcgcagacggcgttaaaactttcacaaggtgcgcctcttgctgctgaacagttgcttcagactgaaaaatggcagcagagaaatgtgttttgtcaggcaattgaacaggcattgcataactgtgataccctgtcacttttacccttattgaatcgtgatgatgcacagcaatctttgtattggctggttagcctgttatccgatgcggtgaaatggcagcagcaggcgcaggattactgcgtcaaccaagatcagcaggctttgatccatcatctggcttccactcaaagtgtgggaaaattattaagtacagttgatgattgggtacattgtcgtcatcaattactctctgtggtgggcgtcaatcgggaattattgttgacaggacaattactcaattgggaaaagcagctttgttccacacggaaactcatttagatacgagcatattatgtttttagttgattcacactgtcatctcgattgccttgattatgaaactctacacaagagtgtggatgatgttgtggctaaggcagcagaacgggatgtaaagtatatgttggcggtggcgactacgctgccgggattccagcaaatgaagaatttgattggtaaacgtgaaaatatcgcgtattcctgcggtattcatccactgaatctggatgaaggctacgattttgatgaacttgcccggcttgcagcggacgatgatgtcgtcgcaatgggagaaaccggtctggattattattatcaaaaagacaatgcagagttacagcgaacttcctttcgtgaacatatccgcattggacgtaagttaaataagcctgtcattgttcatacccgcgatgcaaaggatgatacccttttggttttgcgagaagaaaaagtacaggaatgtggcggtgtgctgcactgttttacggaagataaagacacggcgagagctttgctggatctgggtttttatatttctttctctggtatcgtgacatttcgcaatgcagaacagatccgtgaagcggcaaggtttgtcccactcgatcgggttttggtagaaactgactcaccttatctggcacctatacctcatagaggcaagcagaatcagcctgcctatgtacgtgatattgctgaatatatggcagtattgaaaggggtgactcttgatgaattggccgcagtgacaaccagaaatttttgtaacctgtttcatatcaacatcccagaaaattaagttatctagataaccttttatgttttagtttagtatttagacttaatcatgagtcatctttaatggcaaaaaaggagaggtgagatggcagaagaaactatttttagcaaaatcattcgtcgtgaaattccttctgatattgtttatcaggatgatctggtgacagcattccgtgacattacgccacaagcgcccacccatattctgattgtgccaaacgtactgatcccaacggttaacgatgtcacttcagagcatgaacttgcattggggcgtctgttcacagtggcagcgaaaattgcagaacaagaaggcatcgcagaagatggttatcgcctcatcatgaactgtaatcgccattccgggcaggaagttttccatatccatatgcatatggtgggtggacgtccattggggccactgttggtaaagtaatgtgattcaccattattggtacacgatagcgctgtaaccggagtagattaatgaaaagaattctctttgttatattatcagcgatgtttctggcgagttgtaacttaccaatacagccgcctgctccggttacacctgtgaagccagagaaaaaaacggaaccacaagtacagccatcggataaagttcctcagccacccaagattcagtcgattaattggaatggcactgttcaaccgttggttgcgcagatggttaaggccaatggtgtggaaacgggaaaagtattacttgtcgatactgttaaaaacaacactaatggttcgctgcgagccctgcaagtgactgatatcattactgatgctgtaagtcgtaaacagctttttcagattgtaccgaaaaaacaagtgcgtagcgctcaacaggcattgggattgtcatcggaagatagcttgggattgcgcagtaaatctattggcttggcacgttatttgagcgctgattatgtgctctattccgtggtttcgggtagtaacaatcaacgtagtatagaaatgcagctgatgctggttaaaacgggtgaaatactttggtcaggtagcggtgacgttaactagcgataacagcttgctgagaatgctatgtcagcaatggcctggcattccagtaaaaaattgggaaatcaggcaattaaatgggctgacacagggaagtttctctattacagatggtgtgcgccagatggttgggcgcatacaaacacagaatagtgaaacactgggtgtggatcgtcagcgggaaaatcaggttttacgcaggttatcttccactggcatcgctcctaaagtaatagccatgaacggtgattggctattgctggaatggttttcgggaacaacaataactcacgaaacgttgaacttaccattattgcagcagttactggcacagatacttgccactcttcataaccatcaccgattgggttatcccctccaactcaaaaagcaaattgcatctcagtggcagcagattgaccaaagccgcttatctcctcgctggctgcgtttgcagaaattttttatggcagccagaacgccaacaaccctgaaaatagcacctgctcacatggatattcaccccgataatctacttatgactgtagagggattaaaattgattgattgggaatatgccgctgatgtcgatattggtttttcattggctgtgttgtttaaaggcaatcagtgggatgagatacagcaacagatttttttagattattattgtaattacgcatcaggatacgcggatatcatattattgcagcagagaattaaacagtggggaccgtgggtcagatatatgatgctgatgtggtatgaagtacgttggcagcagacgaaagatccacaatttttagcattagcgaaccctctgcgccaggggtttaaattagagcattaaactggcgttttaacacgctggatagtatcaatcgccattagtgacaatgagttatagatggtaaccaatgatatagaggtgaggagtgttatggggccagtaatgttagatgttgttggttatgaattggataatgaagaacgcgaaattctgcaacatccattagtgggcggtttaatcctgtttacccgcaacttccaggatacgcaacaattgcgtgaattaattcgccaaatccgcgctgcgtcctaccaccgtttggtgattgcggtcgatcaggaagggggacgtgttcagcgttttcatgaaggctttactcgtttacctgccgcacagtcttttgcctgcttgaatgactcgcttatgggaacgcatttggcgcaagaatcgggttggctaatggcatcagaaatgattgcaatggacattgatatcagttttgctcctgtactggatttaggacaccagtgcactgcgattggtgagcgctcatttcacggagagcttgaactcgcggtgatgatggcagaaaaatttatcaagggcatgcattccgcagggatgaaatcgacaggtaagcactttccggggcatggagcagttgtagcagattctcacaaagaaacgccaagggataatcgctcgatggatgccattagttgtcatgatatgcatatttttcgcgattttatccagcgtaacctgcttgatgcaattatgcctgctcatgtggtttattctcaagtagatgatcgcccggccagtggttcaccttattggttgaaatctattttgcgtcagcaactgggatttgaaggtgttattttttctgatgatctgtcgatggaaggtgcggctatcatgggcagctatgccgagcgaggaaaagcctcattggaagcgggttgtgacatgattctggtgtgcaacaatcggcagggggcaatcagcgtgctggataatttgccgatgatcagatctgatagggtagcacggttatatcatcagggcagtcaatacagtctggaagagttgaagaaatcagaacgctggcaacaggcaaataaagaattgaatggcttgtgtgaacagtggttaaattatatttaatcattgttttatatattgattttaataaaattgggaatggagttgctagttggcaattctatcccttttttgtatttcttctcgattcttcctttttgtatttccagatgaaaccttgttttatcaaatcaaactttatatttacacagcattaacattgtaaatttttattgttcataaataggatatacatccagttaactgaaagtaagcacgaaaattttgtgactggcgtctaattaatcaaaagaatttgatcgtgactatttttggtatgaccaactaaccagccatgatattctggagatatttacaatatgaaacttgtcaaatctgatgttatttaagaacgttattaaaagaaacggctttagcgccttacataacattagttgtattttcagtggggtagtcatgacaacgccaaagacaagaattgtcattattggtgggggcgctggtggtttagagctggcaacgcgtttagggcacaaattggggcgtaagcaaaaagccgaaattactttggtggatcgcaacaacagccatttatggaaaccattattacatgaagtagcaacgggctctcttgacgatggcgtcgatgcattgagctatttagctcatgccagtaaccatcattttcacttccagttaggcacgctcacgaatatcgatcgtgatggaaagaaaatcactctggcggaaatccgtgatgaaagcaatgatttgctggtagcggagcgagagctgacttacgatattcttgttatggcattgggtagccagtcgaatgatttcggtacggcaggtgtaagggaaaactgcattttcctcgataatccacagcaggcacatcgtttccacaatgaaatgctgaatttgtttctgaaatattctgccaaccaatgcacggaagaaaaagtcaacatcgcgattgttggcggtggtgcaactggcgtagaactttcggcagaactgtacaatgctgttaagcagtttaatagctatggttttgaaagtttgaattcagacgcgctgaatgtcactctggttgaagcgggtgagcgtattcttcctgcattgcctccacggatttccagtgcggcacatcaggaattgaccaaactcggtgtcaaggtgttgaccaagactatggtgaccagcgcagatgagcatggcctgaataccaaagacggagagctgatcaaggcttccctgatggtatgggcagcaggaattaaagcgcctgactttatgaaagacattggtgggctggaaacaaaccgcattaaccagttggttgtgaagccaacgttgcagacgacgttggatgcttatgttttcgccattggtgattgtgcatcatgcccgaaaaaagagggtggatttgttcctcctcgtgctcagtctgctcaccaaatggcgagtcgttgctatgataatattctggctttattgaatgaaaagccattgaaagaatatgtttataaagatcatggttcattggtttcattatctaagttcagtacagttggtagcctgatgggcaacttgatgcgcgggtcaatgatggtagaaggccgtattgcacgtgtggtttatatctcgttgtatcgtatgcatcaggtagcactgcatggatatataaaaacaggtttgatgatgctggttggtggaatcaatcgtgttattcgtccgcggttgaaattgcactaatttactgaaaaatggctcatctgaatttaattaacacagatgagccatttatttacctgttatatttattattacacctatcataattattcttatctaatttaattctgaattatttattataatcaacaagcgtattttattaaaagagcataaatttaatgattttattatattaaattaatgaaataggatttttcttaaataataaattgaacgcatttttagttctcctaaatattaagagggcatgcttcaatgaaaatgtgtataaaattattaatatatcaaggtgctatgtgggtaatttaaagataagacagtatggaataggctctataattgctattgctgccattggcactgccgcaacactttattttgaatccccacaacccaaagttgcgcaagtattatcttcagagcctatcagaataacggttcctgctcctcatcactattgccatgaggcagtattcgtcattcctattagatcagaagatataacaggaggggtctttacgggatatgaataccgtatattgactctttttgacaatttaaaagcaagcagagaatatcttgcattcaaccattcagcattaaaaaactgtctgatggtttatgtgagggagcaccgcaccgttgggtatgatgttgtttatactattggggataaccctggaaaagtgcgagtgacgtacaaaccggagcaaaccattccgttaaatgaaaaagggcaattaattctccagccatatttgtagctatacttttttcagaagatgattgcactatttcgcttggaactgtatcggcgaaacagtgcaatcgttgtgttatatctgatgctgaacgaaggcttctaataattgctggatgaaagacaaacgtgtagatctctcggttaaatcagtaataaatttcagtttcgaggggccatccagccgataaatgttaggctgtgtctgcaataaaccgatcagataatttgggtcgactttattgttatcactaaactcgataaagccacctttctcatgcgcttcaatgcgcttgatacccaaactctgcgcggtcagacgaattgaggcagattgcaataactggcgacccggatcaggcagtaaaccaaatcggtcaatcaattcaactttcagttcagctagttcagcatcattgtgggcgctggcaatgcgcttatagaaagacaggcgcatattcacgtcagggatataatcatcaggcaaaaataccggcatacgcagttcaatctcggtctggctgctggtgagatcttcaagtgatggttcacgtccgtttttcagtgcatcaatggcactttccagcagttccatgtagagtgtaaaaccgacgctggccatctgaccactttggtcttcacctaacaattcaccagcccccctgatctccagatcatgagtggcgagtgcaaaccctgcgcctaagtcctcaagggatgcaatggcctccaggcgcttttgggcgtcggtagtcatggcttttggatttggagtcagcagataagcatatgcctgatgatgggaacgcccgacacgcccgcgtaactggtgtaactgagccaatccaaagtgatcagcgcgttcaatgataatcgtattggcactggggatatcaattccggtttcaataatggtggtacataccagtacattaaaacgttggtgatggaaatctgccatgacccgttccagatcacgttcacgcatctgtccatggccgacgacgattctggcttcaggaactaattcttccagccgatttttggccttctcaatattttcgacatcattatagaggtaataaacctgaccaccacgcaaaatctcccgcaggatggattcacgaacgactaaactgtcatactcacgtacaaaggttttgaccgccagacgccgggcaggtggcgtggcgatgatcgacagatcacgcataccactcattgccatattaagcgtgcggggaatgggcgtcgcggttagagtcaggacgtcgacatcagcacgaatggctttgatacgttctttgtggcgaaccccaaaacggtgttcttcatcgacaatcaataaaccaatatctttccagcacagatcattttgtagaagtttatgggtaccgatgatgatatcgactttgccttcagcggccatatcaataacctgctgttgttcttttgcactgcgaaagcgtgacagtacttcaagatgcacaggccagtttgcaaagcgatcccggaaattatcataatgctgctgtgccaacagggttgtcggcacgagaacggctacctgtttgttattagtgatggccataaaagcggcgcgcatcgcgacttcggttttcccaaatccaacatcaccacacactaaccgatccatggcaacgggttggcacatatcatccagtaccgcattgatcgcttgttcttgatccggtgtcgtatcaaacggaaaactttgacaaaacagttggtattgctcgggatcctgtgtgcaggcaaagcccggtttaatggcacgctgcgcatacacatccagtaactcagctgcgacatcacgtactttttcagccgctttttgacgggctttattccatgcctctccacctaatttgtgcagtggtgcgctatcttcagcaccgccagcataacgactgatgagatgcagagaggagactggcacatacagtttgtcttctccggcataggtcaggatcagatactctgcctgaatgccacccgcctccagcatcatcaacccctgataacggccaacaccatgttcaaggtgaacaacgggctgaccgcgacgcagttcagcaaggttgcggatcaaaatatcagtattgatggtacgtcggctatcttgccggcgccggcttacgcgctcaccgagcatgtcactttcgcagataagtgcgagtttattatcttcatcaatgaaaccatgctctgccgctcctaccattaagaagcagccagatttattggcatctattaactgttttatttttatcgggctaatttttatacgtgacaacagcccttgtacggtttcccggcgcccctcactttctaccgagaaaatgatcctgccattgaactgttcgataaaacggcgcaccttatccaaaggtgttttgtgctgtgcagtaaccgataaatcagggagagcctgataagcaaggttggtgtttcctgccttttgagggagtgcttcatttttaacctgaatgcggggccaattttttaattcagcgaataatttatcgacaggtagccaaatctgctcaggagatagtaatggccgcattggatcaatttttcggctttcaaagcgttgtgctgtatcctgccaaaaacgctctgctgcactgactaaatcctgtgtaatgagcagggtattttcgggtagataattaaaaatcgcaggcaggggctgttcaaagaacaggggttgccagtactcaatgccagccggcagcattttcttgctgacctgctggtagatatgctcagcatcgcggcgaacttcaaactgctcacgccattggctgcggaataattcaatcgcctcttgatcagtcgggaattcatgagctggcaataaattgattgtttccacttcaaccagtgttcgctggctatctatatcgaaagtacgcaggctatcgatttcatcatcaaaaaaatcaatacggtaaggatgttcacttcccatcgggaacatatcaaacaaggcgccgcgtgtagcaaattcaccgtgttcaagtacttgctcaacactacgataaccggactgttccagttctgtccgcagtttatcccgtgaaaggcgctgacctttgaacataaccaaggcatgtctcttgagatattcatgtggacaaacacgctgcatcaacgtattgacgggtaggatcagtgcacctttcgtcatgaacggtaagtgataaagcgtggataagcgatttgagatgatttcttgatggggtgaaaaactatcgtaaggtaatgtttcccaatctgacagcatatttattggtgcgtgggtgaattgcagaatttcatcacgcaatcgcaaagcattctgcatatcttgtgtcaccagtagcactggacctgagtgacgttcaataatttcggcacattcgactgcacaggcggcaccagtcaaatgacccaactggcggatatcaccgcgacgttcaggaagttgataacggtattttgcggacataagcgtttgatgtgttctctaaggtttagtccattcccaacacatttttgaccaagtagccttgcaacaaatacgctggcaggttgagagaaagtaaaaaaacacagaaccggggtatgagtggttccatacagtactgctgccctttattatcactgaacactttgctttggcaacaggagagtaatagatttcatgtttattgattttggcaacaatatctgggcagtacttccagaggagtgcaagtcagattggatgacatcagaaactcttgttaatattagattatggcgatttcaaggctacgcatcggtgtagcctttttctgtatcaagccaaaattttcgagggttgagtataatagctgctttttttatttttcacttgaaattgacgataatcaaatctgagcgaaacgatgatactatgtgataagtaaggctgatgggatagatattggttttgtacatattggcatacataactagagataaaatatgacattttttcttaactcattgtttttaaaaacatcattttgatacggcggatttcatgtttcaatctgtctcattatttataggattgcgctatatgcgcggacgagcggtcgataaattcggccgttttgtctcttggttatcggccattggtattacgctgggtgtggctgcacttattactgtgttgtcagtcatgaatggttttgaacgttcattggaaagcagtattttgggttttatgccgcaggcaatcatcacatcagaaaaaggctctatcaatcctgatgagcatccgatgaatcagctttcgggtctaaaaggagttaaccgtattactccgattgtacaaagcgatgtggtgctacaaagtgcccgtaatgttggtgtgggagtcatgttgggtatcactcctgatgaatatacgccactggcggcgcatgttgctgataccgatcgtactcagttacaacccggacgttatttcgtcattttgggggagaagttggctataaagctgggtgttaaacgaggtgatcagatccgcgttatcgtaccaagtgccagccagcttacgccgatgggtagaattcccagccagcggttattcacggtgattggaacattttttgccaatagtgaagtcgatgacacggaaatgctggtcaatcaacaagatgcggtgcgcttattccgttatcccatggataatatcactggttggcgtctgtatctcaatcaaccgctgacggtggatgtattaagccagcaaactttaccggaaggattagtgtggaaagattggcgtgaacgcaagggcgaattttttcaggcggttcggatggaaaaaaatatgatggggttattgttgagcctgatcatcgcagtcgctgcttttaacatcatcacttccctctctttattggtgatggaaaaacagggtgaaattgccatcttgcagacgcagggactaacccgccgtcaggtaatggcgatcttcatgatccaaggggggagtgctggcatcattggtgctttgttgggaacggggctgggtgttctgctttccagtcagttaaacagtttaatgcctcttgttggcctgttgactgaaggtatccaattacctgttgcgattgatattacccaagtggtgcttattgccaccagtgccatgttgatctccctattatcgactctatatccttcctggcgcgcggctgccattcaacctgctgaggctttacgttatgagtaatcaacccttattgctgtgtcatcatctgtgcaaaaaatatcaggaagggcaggtttccacagaagtgttaaagaatgtcactttttccatacggcagagagaaatgatggcaattgtcggcagttcgggatcgggtaaaagtacacttctgcatttgcttggcggactggattcgcctacgtccggagaagttctttttaaagggcgatcattgaatgaaatgtctgcctctgtacgagccgagttacgcaacagtgaaatcggttttatttaccagttccatcatctgttgcctgatttcagtgcgttggaaaatgttgctatgccgttattgattggcagtaaaaagcgcaaggcttcacaaaaagcgctggaaatgctggcggcggttggattggaaaagcgggcacaccatcggcctgctgaactgtccggcggtgagcgccagcgtgtcgctattgcccgtgcattggtgaatgaaccatcactggtgctggcggatgaaccaacaggcaacctcgaccagcgtaatgcggacagcatctttgaaattttgcaggaattgaatcaacgccaagggactgcgtttctggtggtgactcatgatctgaaacttgctggccgattggctcgtcaggtcgaaatgcgcgatgggtttttacaggatgagctcgttctggtgggagagaggtaatggcgaatttgcctcttgcattatttaccgcattacggtttagccgaggacgtcgtcgtgcaggaatggtttctctggtttctgtcatttcgacattaggcattatgcttggtgttgcagtgctgattatcggcttgagtgccatgaacggttttgaacgagaactgaaaaaccgggtgctttctgttgtaccacatgggcagatctacacggtagagcagccttttcagcattgggaacaggcacttgagcgagtaaaacagacagtgggtattgttggtgcttccccttatattgaatttaccggattgatggagaaaggcgaaaaactccacgctgtacagatacaaggtgttgagccgaccaccgaagctgatgtcagtgctttgcctcaatttgtcggtgatgatgcatggaaagcgtttcatgctggcaaacatcaggtgatcttagggcagggtgtggcgcattcgctgcatgtgaaacaaggtgactggctgacggtcatgatccccaatagtgatccgagtttgaaacttttgcagccgaaacgcattcgcctacaggttgctggaattttccagttaagtggcatgctggatcatcgtctggctttggttcctttatctgatgcgcaacaatatctggattatggtcatgctattacgggaattgccatcaaagctgataatgtttttgccgcagaacagcgggttttggatgctggcaaatcgacagaaaagtatgtctatatcagtacatggataaaggactacggatatatgtacaacgatatccagatggtgcgcggcatcatgtacctagcaatggttctggttattggagtggcttgctttaatattgtttcaacactgattatggctgtgaaagacaaaagcagtgatattgctatcttgcgtactctgggggctaaagatggtcatatcagagcgatttttttatggtatggattactgactggcatggtcggcagtgttattggcacgatagctggcatcttcacatcgctgaatctgacgactattatcaaagggctggaaaagctgctcggtcatcaattcctttctggtgatatctattttattgattttctgccgtcagaattacatgctatggatattttctatgtcctgttaacggcattgatattgagtctgttggccagttggtatccggctcgtcgggccagtaaacttgatccagcacggattttgagcggtcaataatatgccaaagtatcaacaatcctctaagcgcgctatcgtgtcggtttaatcgatagtgatttaacgggtagggtcctaatcagcagaatagacaatctgagcatgttttaaacagaacagagccgggtgaagggaagattagggcaatgctaaggaaatagttttatgcgtgttcgtcatcggtttggtaagttttgcaaggttaaacgattgcggtgtcagcgattaaatagaaaaaatttttacagggacattcgattggcaaataaaataaaaaggcctcgtgtggtcgtgctgacgggggcgggtatttccgctgagtcaggcattcgaacatttcgctcttctgatggcctgtgggaagaacatcgtgttgaagatgttgctacgccagaaggtttccaacgtgatgctgaattagttcaggcattttacaatgcgcgtcgaaaacagctccagcagccggaaattcagcctaatgccgcgcactatgccttggtagagctagaacagcaactgggtgataattttctgctcgtgacacaaaatatcgataacttgcatgaacgagcaggaagccgtcgtgttttgcatatgcacggtgaattgttgaaagctcgctgttgccagtctggtcagatgattgaatggaagacagaattgacaaccgaagaccgctgccattgttgccagtttccatctccactacgtccccatgtcgtatggtttggtgaaatgccattggggatggagcagatttattctgctttagcggatgctgatctttttattgccatagggacgtctggtcacgtttatcctgccgcaggttttgtgcatgaagctaagttatctggcgcacttactattgagttgaatctggaacccagccaggtcgaaagcttatttgatgaaaaacactatggtcatgccagtaaaattgtcacgcaatatgttcagtcattacttcagcaaatgaagacagataaaagctgatttgacacaatatgtatactgttcctcttctccataatgaaaatagatgattcagggagaggagaaggtggacagattattagagcgttttactgaactgacagctatccgtgaaaacaattcattatttgacctatagaaaatccatctgcatagcagatggattttctactcatagattaatcattaaaataccagtaaccgctattgaccaacgcagctagcaggctgataaaacgaacatcatcaatggcatcacccagaatacccgcatccactcgatcatgctgacaaagcgcatcagcggcatggatatgaggagtatctattaattcgccattgacaaaacattgatcaccaactcgcaggacgcgtaacccacttaagcgattcaaactttcaccttgcttcagcagttcataaatttcatcgctttcataaggaggttctggtggggcaatgtccaactcatggcgtgattgggagataaattcgccaaaccaattttgaaaagttgttggttgttccagcagatcgcgcatcattattcgcagagtatccagttcatttgactgaattagcgctggattatcacgcaatgccagctctggatcgctataacgatggctccccaattcatttgccagaatataatcagcaaaaccactgaagagttcacgggcattgggtgcgcggaagcctacggaataatttagtgaatcctcgatagcgtagccttcgtgcgggaatccagggggaatataaagaatatcccctggcaacatttcttcatcaatgattgcctcaaaaggatcaacctgtaataaatcagggtgagggcaatgctgtttcattggtattttttcgcctacacgccagcgacggcgtccctgtccctgaatgataaagacatcatattggtcaaggtgaggaccgacaccaccgcctgatacagagaaagagaccatcagatcatccattcgccagtcggacagcatacgaaatggtttcataagggcagaagaaggaagatgccagtgattaacagcttgtacaagtaatgaccaatccttttcgcctaaatggtcataaatttcaaatggaccatgtgaaacttcccaacgaccgtttttctgactgaccaaacggctatcgatttcattttccatcgccagtcccgccagttcatcgggagaaaggggatcgataaattgctggaaaccctgcttaatcagcagtggccgtttttgccaatagttctgcaaaaacgattgccagtccagatttagctgataatccatggtgatatcctgagtgacaagtgaatttcaggccattataacgaatagtcaatcacgatatcagttttggttgaaatatttcgagctcgctcccactcagtattcactgctttgctgtgagcggaatactacatttaccctagcccccccaagtgggctatcttcaacgctgatgcttccgtcatattgcatgacaatttcagcagcaattgacagccctaatccttgaccagagcgtaatgtatctgcacgtagaccacgttcgaaaatcatgttacgtttttctggcggtacacctgggccatcatcatcgacaataatagtgacagaattatctcccattaaggcggtgatttcgacgaactccagacaatatttacaggcattctccagaacatttcccatcacctccaagaagtcattcttttcgcctaaccaattgatttcggaagaaacattcagtgtaatatcgacgcctttgtactgataaacttttgtcagtgcgatgatcagtctatccagcaaaattgagacggaagaaatctgtctcaagagtaggttatgatcgctgtgcatattggcacgacgtaggtagtagtcaaccagttgagacatccggttgatttgctcaagcatgattggttcagcctgtgtaatggacatttgtttacctgagcgcaatgaaagtagggtggattgcaacacggctaatggggtttttaggccatgtgacaagtcagaaagtgtcgtgcgatatcgagtataacgtcgacgttcattgcttaataatgcattcaggtttctgaccagaccttttaattcgttgggaggctcttcatccaatttttcacgttcacctctttccagagagcttatttgggtaattacaaatttaattggacgcagactccagtcggcagcaagccagattaatgggatgattaaaatcaggttggcaagcaatacatatccaaaccatgcccagactttcactgaactctgcatatcttgtgggatagtatcaataataacaattgtcatcgcaggcagcttatcggtcttagcataagaattgactgctacagaataggttaataactcattattatcgctccagttggttttggttgaattgtctgactgagtcggtgttttagggtagagaaaaccttccttatctttaaaagagatagataagtcatgcaagccatcttttttcagccattccccaggaatttttttttccaattctggcgtataactttggcgccagagaatacgaccttgattgtcataaatcagagccagagaacgattagtcatggataaattgggggggattttaataaccagcttgctaccatcccatttagccaaagtactaaataaattactttggctacggagtatggaataaattgttttatcaaaactcactaaatacccaataatggcgacaaggccatatgacagcgtcagcgcaaggataatggccgacgtcgccatgagaaatcgagttctcagcgagatatgctttttcgagaatttaaatatcatgttgtttcacatcgaaacgatacccctggcctcggactgtaacaatgacttcgtctgaccactcattcgatattttttttcttaagcgtcccattaatacatcaattgtatgactttcacgtaattcagcatcagggtataactggcgcatcagtgattctttactgacaactttgccattattacgcatcagcgtttcaataatcgtatattcgaacgcagtcaatttgatactgtttttattaactgaaaactctttgcgagagagatcaattaagaatggcgataattcaacgagttgagatgctagcccactatgacgtcgcattaatgcctgtatgcgcgcgttaatctcttccaaacgaaaaggcttggtaacataatcatctgctccagcattcagtactgtgaccttttcttgccagctgtcatgaactgtgaggattaaaatcggtaaattaacctgatcgctgcgccaacgtcgtatcatgctgaggccatcttctccgggtaaccccagatcgacgatagcaatatcaggatgattttctttcagataataatcagcttctttggtattttcagccgcatcaacctgatgaccgagttctcggagctgtactgtcaaatgatggcgaagtatcgcctcatcttcaataatgagtatacgcataatgattccttatactaatcagtaacgtttactaagtagatttaaaatagctaaatagtcaatttcgtcaacaggtattaaataaaattatatatatcattattatgattgaattaagtatagtaactattttggacaagccggaatattaatgaaagtgacttttaaaaacaagggattagaattgatgggagtagatgactttgcttctatttatgttttatgtaattttgcgcatgtttttttccggcatggacaggaaaatttcctgtccatggggagatatatgaaaaatttttattttaattcatcgactagtgaagtggcatagccaatgtagtttgctggtgtcatggatttgagacgagatttttcctcttcgggaagctcaaggccatcaatgaaggttttcataccttcggcatcaatacgtttaccgcgtgttagttctttcaatttttcatagggtttttcgataccgtaacggcgcatgacggtttggataggttcagccagcacttcccagttctgctccagctcatccaacaggtgctgtttgttgatctccaatttattcagccccttcatggtggcttgataagcaatcagagcgtagcccagaccgacacccagattgcgcaataccgttgaatccgtcagatcacgctgccaacgggaaacgggtagtttgctggcaagatgccccagaaccgcatttgccaatcccagatttccttcagaattttcaaaatcaattggattgactttgtgtggcatggtagaagagccgatttcacccgcaacggttttctgtttgaaatgattcagggcaatataaccccaggtatcacgatcaaaatccagtaggatagtgttaaaacgtgctacacaatcaaacagttccgcaatgtaatcatgtggctcgatttgagtggtatatggattccactgaattcccagagatgtgacgaatgattcgctgaactggtgccaattcacctgcggataggcagacagatgagcattgtagttgccgacagctccgttgattttaccgaggatctcaatctgtccaagctggcggaattgacgctccatacgataagccacgttagcaaattctttaccgacagtagaaggggttgcgggttgtccgtgtgtacgtgacagcaaaggcaagtcacggtagtcgtgggccatacgcttgatagtgtcgatcaactgacgccactgaggcagtagaatctcctcacgggcggttttgagcatcaatgcatgtgacaaattattgatgtcttctgatgtgcaggcaaaatgaataaattcagcgacttgatgaagagcaggaatgtgtgccactttttctttcagaaaatactcaacggccttaacgtcatgattggttgtgcgttcaatttctttgatgcgtaatgcgtcctgttcattgaaatttgcaacaatttcatccaggtaagcgtttgcgtttgcatcaaacgcaggaacttctctaatttctgttgtggcggccagtttttgcagccaacgtacttcaacctgtacgcggaatttcagtaagccgaactcactaaaaatagcgcgcagtgcgctaactttgtcgccgtaacggccatcaattggagaaacagcggtcagtgaggataattccattggtagcaactcccggattttatttaacaatgatcaagaatgtctttttcctgtcggatcaggcgctgacgagaaaacatgatttgcaggcgactaccgccaacttgctgccataatacagcactgcggatacctgccagtaatgctgctcggactttcgcctgtatcaacgtattgcgcaatatgtcaggtgaacctgtgacttgaatacgaggccctagcgggctgataacatcgacatagatacctgcaagggcattgaagataccttctgacataggttcaaagtaagtttgttggcgttctagctggttaatacgatgagcaagttcattagctgccgcttgatttttactgagccgacgctccagcactatcaaactcagcatatagcgggtaaggtcagcagagataccactgcgagtgttattgaacatgccctgaatggcatcaaggccaatgcggaggttgcaggcattattgccaaagacatcctgtgtggatgacggattcatgttcaggacactgttgatcatcacttcaaaagtatcgtcatcacactggccttcatgggcaagctgctgaaccagatggcctgactggcagatgcctgccagtgccagtgtaatgtcataataatttttagccacgactactcctgtatacgttgttcgatcacgccaccgcctagacagatttccccctgataaaatacggccgattgacctggggtgacagcggcaacggggctatcaaaacgaacttcaattttgtcttcgctcaagggaatgactgtgcagggaatatcatgttgacgatagcgcgtttttaccacgcagcgaatttctgtttttaacgcctgacgatcaacccaatcaagctgttgtgcaatcaaaccgacagacatcagacgaggatgatcatggccttgagcaacaatcagcgtattgttttcgacatccttatcgacaacataccatgcctcttcgctgccatctttggttccaccgatccccaaccctttgcgttggccgagtgtgtggtacatcaggccagtatgctgaccgatggtctgtccatcaaccgtaataatagaacctggctgggcaggcaggtagcgccccagaaaatcgcggaatttacgctcaccaataaagcaaatacctgtagagtcttttttcttggcagttaccagaccgatttcttcagcaaggcggcgaacttcgggtttttccaattccccgactggaaacaggcttttcgcaatttgctggtggctcagggtatacaaaaagtagctttgatctttattaccatccagtccacgaagtaactggctgataccatccacatcccgacggcggacataatggcctgttgcgatgtaatcagcacctaaatcttcagcagcaaattccagaaatgctttgaatttaatctctttgttacagaggatatcgggatttggcgttctgcccgctttatattcagcaaggaaatgttcaaatacattatcccaatactcagctgcaaaattaatggtatgcagctcaatacccagtttgtcacaaactgcctgggcatccgcaagatcagcggcagccgagcaatattcttcatcgtcgtcttcttcccagtttttcatgaacagaccagctaccttataaccctgctgttgcagaaggtaggcggaaacggatgaatctacaccgccggacatcccgacaatgacttttttctggctgttatctaacatggatatatctcactgcggaaaaaaacaagcgcaatactttaacacgtcggtagataaggtgcaccaaacgtcttcgcgcgctttcttattcggcttgttatttaaaaattcatttggtgaaaggtggcccatagctatctaatattgataatgggtaagtctgattttccagataacagcggatactttcagcaacgagcggtgatcgtaactgtgggctgctgaggatctcttctgcatttagccagtgacagcagtgaatatcgctatcttgtggttcggtatctacgatttgttccatttcaatcaggaacagaaaacggataaaaggcgtaccatcaggggcattccactgatgtaatttcaataatgcctgtggcttggcacgaataccggtttcttcccataattcgcgttcagcggcttccagcaacgtttcgctagcttcaagatgaccggcaggctggttccagaggggaatatcattaatgaattcttcgacgatcaaaaatttgctttttgcatgcacaatgcaggcaactgtgatgtgtggattaaacaaaatcaatttccctccattctccaggggatagctgccccaattgtaacgaacctatactgaaacggattaagcgcaacgttggaaagccaacatgggcagtcattctacgtacctgacggttgcgtccttcaaaaagggtaattttaagccagcttaccggaatatttttccgttcccgaataggaggagttctttcccagagccactctggttcttctaccaactcggcaccagcggaaagtgttgggccatctttcaatgtgacgccattgcgtagcttgttcagagtgctctcatcaggaattccttcaacctgaacataataaaccttagctgtttttttatggggctgcgtcaacttggcctgcaatttcccatcgttggttaaaattagcaatccttcgctatcgcgatccagacgacctgcggcataaacatcaggaaatgggataaaatcctttaacgttgtcctccccatttcatcggtgaattgtgggagcacatcataaggtttgttaaagatcagtaccctgcgagggcctgttaatttttttagagtatctttattttttctttggctgaatcggttaagtttacgttttttaaaagagatatttgtcatgataagccatcgtgcaaaatgagggtgcgtattataccttaattctgtgaccattggcgtttgcagaatattcaagtagtattgacacgtcccttacaaaaaattaacaagttattgcgcttatcttgaaaggagaggttaatggaaagcaaagtagttgttccggcggaaggtaaaaaaattactattgatgccaaaggtaaattaaatgttccgaataacccgataatcccttatatcgaaggggatggcattggtattgatgtaacgccggtcatgctgaaagttgttgatgctgcagttcagaaagcttacagcggtgagcgcaaaatttcttggatggaaatctacaccggagagaaatctacgcaggtttatggcaaagatgtctggttaccagaggaaactctggatctgatccgtgactaccgtgttgctatcaaaggccctctgacgacacctgttggtggcggtatccgttctctgaacgtggctctgcgtcagcaattagatttatacgtctgtttacgtccggttcgttactatcaaggtactccaagcccggttaaacaacctgaattaactgatatggtcatcttccgagaaaatgctgaagacatttatgcgggtattgaatggaaagcaggttcagcggaagcggataaagtgatcaaattcttgcaggatgaaatgggtgtcactaagatccgtttccctcaggagtgtggtattggtgtgaaaccatgttcggaagaagggactaagcgtctggtacgtgctgcgattgaatatgccatcgataacgaccgtgaatcagtgactttggttcacaaaggcaacatcatgaaattcacggaaggcgctttcaaagactggggttatgaactagctcttacggaatttggtggtgaactactggatggtggtccatggatgaagatcaagaatcctaagagtgataaagacatcatcattaaagatgtgatcgcggatgctttcctgcaacaaatcctgctgcgtccggctgagtacgatgttatcgcttgtatgaacctgaacggtgactacatttctgatgcattggcggcacaggtaggcggtattggtattgcaccaggggcaaatatcggtgatgaatgcgcattgtttgaagcgacacacggtactgcacctaaatatgccggtcaggacaaagtgaacccaggctctgtaattctctctgctgagatgatgctgcgccacatgggatggtttgaagctgctgatcttattgttaagggaacggaaggggcgattgctgccaagaccgtaacttatgactttgaacgcctgatggaaggcgctaagctgctgaaatgtagtgagttcggtgatgcacttatctctcatatgtgattgattgcgtaattgaatagataacgggggcttaacagttcccgtttgttttttgtacatcgaaaagcggttatcaaaacgttatcaaaatgatttatcaaaactagacaaaatttaatcaatttagagtgtgatttttatccaatctttcccgcgatcatcatgatatttgtctgtctgttgttggttcttatggcccaataaatctttcgtgtttataccttgctcacggtacagtcgttctgatagtgagcgctgttcgtggaaagttgctggagttccttctccccaatctatatctatcttgtctcgtgcttttttgaaatttgttgtcaatgtattcgctgttactttttcgcctcgtttagattgtgatgtggtgtgaaaatagtgaattaaatacgggctaaggacacgatccctctctgttagcatagttgtcacccccactaacaacgctgatagagagggtgaatgccccgcccgtgtggggagtccctacccaaagtgatttttggggagtggttagcagagtctaaggatagacacagagctgtggagtttgcctgcttcatttagtggactgcaaattttaaacaacctctcagttattaactgcgccccaaaacttactaatggggataaacaaatggaaaatatcactattttacctaaaggcggtcgtttgagttccaaaatgagtcgtcatctggaacgaggaaatttaatgactcgccgccgtttagaagaaaatattcgccagtctgaaataaaagcgcttgaaaatatgatcgatcaggcatttggattggagaccgaaccgcgcaaggtattaaccatccagcgtaagccacaaaatgatggcgttaacgtaatagccaatctgattgttcaggccaaagggcttgctaatgagccacaataagacagcttcaataactgctgcttgccacatgtagctctttactcaaccaagcaaagagctggcaatcagatactggagtcaggcggcgttacggcgagggggtgagattttctttctcagatatttaatcggcatcgatgaaatataaactatagccgcgctgataaggtacatcgtaacgaaataagttacggtttctggctgaaaatcaggaacgtgttcgcgtagccatgattcgagtggctcaagcctaaacgcgactaacaggccgcaaaccaatgcagcaaaattcgatttgttagcttgcttacccagcaaaccaacaacctttttccatttatttctatccatagattaaattttattctcattatagtaggggatttattctaaccgatttctttgcgctggggaatgcgaggaaccactgccgcctgatgtggtgaaacatgcaggcacatcaaattaacaacagtaacagcgagggtgtgatatgaatatagaattcaccaacgaaattcgggcatcaatgaaacgtgaccgtcagtctgctattaggtacgtaattgaatgtaaaagaaattatctagattttcgtcaatgggctatggatcatgagccacgttctactaatcatcgtgcattgaatagattagcttggcaacagcgtaaattctaccgtaagtgggcggctctcagttgactaatctatacccattatttagccgcaaagctataaaatatattggcgctatcgtcaccctgtcacaggtaaatatcacgctcttggtgataacgaacaggaagcaaaggaaattgctattgaggctaataatagattagccgagcaacgcagccgtcaagttatggcgattagtgatcgtgtagcaaaaatcaagggtaaagagattactgttaatacttggttggataaatactggaaaattcaggaggaacgtttagaaactaatgatatcaaattcaacacatttaaacaaaagcggaagcctgtagatttaatgcgacaggctcttgctatgaaaccgttgcccgctgttgatgctcgtgacattgcaggtattttggacgaatataaaaccgcaggtcagccgcgcatggcacaggttgttcgctcagttctgatagatgtattcaaagaggcgcaacatgcaggagaggttccccccggctataaccctgcattagcaactaagcaacctcgtagaaaaattacccgccaacggctgaacttggaggaatggaagcagatattcgaaattgcaaactcgcagcatcgatatatgggtaatgccatgctattggctattgtgaccggacaacgattaggtgatatttcagaaatgaaattttctgatatttgggatgatcaccttcatatttctcaggaaaaaacaggagcaagattagccattcccttagcattacgatgcaatgcacttaatacttccctcagagaagttgttgcacagtgccgtgatcgtgtccttagtccgtatttaattcactattttcacaccacatcacaatctaaacgaggcgaaaaagtaacagcgaatacattgacaacaaatttcaaaaaagcacgagacaagatagatatagattggggagaaggaactccagcaactttccacgaacagcgctcactatcagaacggttgtaccgtgagcaaggtataaacacgaaagatttattggggcataagaaccaacaacagacagacaaatatcatgatgatcgcgggaaagattggataaaaatcacactctaaattgattaaattttgtctagttttgataaatcattttgataacgttttgataaccgcttttcgatgtacaaaaaataaacgggaaccattaagcccccgttatctattcaattacgcaatcaatcacatatgagagataagtgcatcgccgaactcactacatttcagcagcttagcgccatccatcaaacgttcgaagtcgtaagttacggtcttggcagcaatcgccccttccgttcccttaacaataaggtcagcagcttcaagccatcccatgtggcgcagcaacaggataagattataatattaagttactgtatatattgaatatttaataactacaacatcatttttatgtatataaaatcacttaaataacacgttgttttatatactttcaataaaagttttgcagaatgcaaaaatcgcccagactattacaaattccaccatttaaagtaactttttcgataatgaatgcacgaaaaattcaataagctcatgccacagaaagcagagtaatcccaaaggtcagaaacctgcccttaagatgggatatcacaccttgcggcaactatagggatttccccaactgttgattaacccgttgatttatccgaggccgtcactttgacccaacggttgggaaaatcccaatggttactttatgttctggacaaacgcgataaatgtattgtgttttaacgtattgcttgagcgcaaggggctgggcaagcagacgacaaatctggcgtctgattagatatcaataggttatcaccaaagtccgaattagagctttactctgccgtcagatttgtcgttagccactcagttacattaagtaaccctataaatatgaaagcaaaaggtatggtggaaatccccataccctcacccgcgagtataaaaccaaagtaggcattccgtttgaaacggaaggattgaattaaaaggtgagaaaattccacctttagataacttgttgatttttcttatttccggcatggggcgggaatttaattaaatcaatgggttgggttaaaggggaggattgcccccctttaaatagaatcatgttttatcagtagaggaatagattttattgatcccccgtttgttattttatgtcatcctgccatcaaaatatgccactcacctaatcgttaaaacgagcttagtcaaaacgcattctccagtattgatgaacctattttatggatgttcactggcggagaagtaacccgccttcatgttatttagcaatgtttactgttgattaaatgagggaataaatatgcaagataataagcctgatacaacggtattagacgataacaatcttgtgatcgttacaacaccggattaggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagactccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttacgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgacccgctgcctcatggaaataaacctaatatttcggacaagccaagattagctcaatatttttgttgttttccaaggactgatctcactgagcagcaaattacagaacgaattgctgcttataaacaaggattacctactacatctataacgggtaaacctttcccggttaaaaaaatcaatcaacaaggtacatccagcataaatttaacagagctgggtgaattattgttggggagttagcatattgtctttaaggtgttattatggatgaaataatgcatcacggagagaataatattgatgtttcaattattcttcctaggtataatgaaaattatttagttatagaaaaaaccatacagcgcattaaaaatattcaagaagtattgaaagtacaggtcattataattaatgattcaaataaaaatactttccatgatatagatattatcaaggtaaaaaaacagtaccctgatgttgaagttgtctctaactgtggtaactatggaaaaggatatagcattagacgaggcgttgatttagcgaaaggaagatatattttttatactgatattgatttcccgataaaagagagtgatttttttagtgcatatcaaaaaattgaaacatccaatgttgatctcgttattggagagcgattctcaaagagtaaatcaaaagcgaatctatatcgaaaaataacaagtaagttttttttaaaaattgttaacttgatactaaactgtaaagtatctgattctcagtgtccattcaagatgttaaagtctgatgtggcaaaagaagtattttctaagcaaaggattaaggggtatgcatttgatgctgaaattatttaccttatgaataggctttcgaagacactatatcaatttcctgttatttgggaggatacaagggaaaactggagtttgatgaggacgattattaattatagcattatgattttaggggttttttctattaaaatttactggattatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtatatctataaacaggcgtctttccttgctccactgatacatttacatatttattgttttctaactgacaagtaaattcggccgcattagcgtttccaaaaattaccccaaagaaaattatcgcagcaataatctctttcatttcattacctcaaaatatattaactattccagtatattctatggaaatgtgaaaggcatgattaaacgtatttttacgtactaaatgctgcatattttacgaacatttttaaataagaatttatcaagcaccccttttcggatgctttgcagaattttgtgaaatggtcattgatccagtgaccaatgcaaatatcagtgagttagtgtaatcagacaattttttggccgattggagctgaaccaaagtgacggcctcgctaatttcagatagttagctgaattaaccgaggccaccaaactgagggcctcgataatatcaatcgcttatcgtgtcagagggtagctgagctattaatcctcatcgaaaagtaattttggctgcgtcaaagataaaatttgttcatattccaattccagcaactttttctctttctttctatcgttcatcaatcggctacccattcgagctttgatttcggatttcgcaactttcagagcatgacgatgttgcgcctcttcgcctaggtctttccatctgtcaatttgctccgccatccaattgaaggcctgaatgtagttaaccttgattagcatcgctgctttaccagtaaagcccattacaaccaatatgtaaccatcttttgttagattgaacatcggttgtacatcgccatttttatcaatgaaatcagcctcctcaaaattgagggcggcaaaattatcaggacactcatctctaacttggcgaatctttcttaaaacgttgtcatgacgcttgccaaaatatgaggctattttgagactggttgtcactaccttatcttgtacggctgttaccatctcttgaaaatcgaatggagggataacggttacttctttcatgggttagttccttttagagataaaccttgcgctcaggaataaccagcccaaagagggttaaccagaccactgccggtattcctcaaggcttatcctgaaaggttctttggtatttatgcgtcgagcgggacgcggtgaaatgcagatacaaaaatgccacccgtgttaactgatggcatgggggattcctttaaccactcaagggaatgggtaaagaaatattggctttagtttcagagagtaactaattgttcagtattattcgcttgttgttgggtggagatgggtttattaggtttactcgtctttgtgataataacgttgtaaaagatgtggagaatgattatgaaaaaatatcttcttctttgcctagtagcaggcacgactcttttagcttcaatgcagacttatgctaatttctgcttacctcttgctctatcacccatattatatgcagagtgtacagctgcctgtcttttgttaaattcggataacacgactcaatactgtttataataacaatcaagcaggagacaggatggctcctgcaaccccagtatcacttactctgaggttctccaataaactgaacggcctctggagactgtttcttgtcctgccagtgatcttctatcgcttcactcatgcgtcgcatccagtccgcgagtcttaacgccgcttctttctctgactccagtctcggaaagttttcaaattccatttttgcagtgtattcaccgaattggtctttgttaatgaggagtgtttggtcaagaattgtttctaaattgtcatgcaatacatagtatttactgagctgcgttcgctcggttctgtctttctcaaagtagaccagatcaacttctgttctcatttcttcacctcataacattcagtattaacgtaatcctgcaaatatcttaattttgcgaggtcgttgatgatgtcttctcggatatcgagaacagttgatccagtttctccagagagttcgacggtggttgcatcgaccatgctgcgggaggaagtggtttcaggcacgggacagatggctttgatgcgcaacttgcgacggccagcggcaacatcagccctaagagtatcaatttcagatttggcattgtcgagttcctgagtgtgcttggtgtccatctcatgcagcatatcaatgtgcgtgttctggtagtttagggtgtcggtcagttgctggatttcagttgcctgacgcccattagcctctttctgtttctcatactcagtactgtaatggtagcttccgaatgaggttatgcctgtagtaacaaacagaacaatgatcgtgtagtgggtcagtgtgagtttcatgacaaaaacatctgttgttcagatgccctacgccgagtcaggccgttcatcaccttaccagccgccttattccatcggggaaattctgccgctgcgcctgcataatcaccggcattgattttctttagcaaagtagaaccggagaaattgccggtaccacaattgaagataaaggagcacaaggcatcaaactgaccttgagtcagtggcaccttaaccaatcgctccagtgtggcgtaagcgggtatgaggtcatcatgcaagaaagcttcggcctgctgctctgtgattacttgaccgggcttcacatctttcgtatggccataaccaatcgtccacgggatgccacctgttgccgggtcagggtaggctttcagtttcaggccttcccattgctgaatgaattccagtcctttattgctgattttcatcagaggatacccccgctcttttctctgccgccttacgcagcaattgaccgatgaagtctgtaccgagatagccaatcaccacactgccgatgtaggccaggtcaggattcagacccatgaaatttaatacgtcacgaatgaaccaggcgaacatggcacacataaaagcgtcgattgaaacctttacccagccgccaccgttatagcgaccgcgaaaaaatgccatcgttccggcaagagttgcccaaatgccttgctctcttaccgatatgagccactctccgaggtgtacccatacatcaggattctctttcatcttcatattccaccccatttgaacaatgggcgtccgtggggtgagctatggtcgcccctgtgagttgagttaataggagatgccgccccgaactggcgacggcagatacgcaatgcgtaacatttagcaggtattaccctgcatggtttttttgagttaaattgtgatcctgccaatttatgagagtttgctgtcggctggaataggtaacccagcaacccacccaacacttacacggcagttggcagcctaaaagaaaaaaggccacctaagcgaccttcgataatttggtggaacctctcggaatcgaaccgagtcctgatgctcttcaggcatccgcgcgaaccctctacgccaaagttccagatacaggaaaggccacaccgaagtgcagccttggatttgaactagtcggtctcaccgacaggttgagttatccatggggatcaaggtgctgctcatgtcaccagaaatcacatttaacacattgatttaacagtgatataaggtgttgtccgaccccgatcaattatccggtattgataaattaatcatcgaggattaaattagtgaggttaatttttaatcactgaggtttatcatgaacacgaacgcatacaccctgattggacgcgctatctgtcagttattggatgacaatacgccgatttataaaacgactatcggtgaggcgatgtcggatatttttaacgccgaatatcgcggcgtctatgatgaacactgcgaggcattcaacgatgcgctgaaattactgatgaataaaaatgaaaattgactacgagtagatatgaaaaagccccacttgatttagtgaggcttaactgcttttcggttttactgcccgagcataacataaaacatatagtttttaggcgcgtttgtcaaatatttttctccttatttattattttatagaattaattactatttctttctgacataatggaataaatcatatcctcagcagccttgttagcccacctgatacgccttttggcagaatcaatatcaatacccgtcttatgagaaagcgcttctaaaatgttttgcgagcttttgcacttcttgtatcgtttaataactacatcgcgaattggattatcaatagtgaatatttcggtcatgcatttctcaacaaactcggcgtcatctttttctttggcgaggcgaagtgcaccgagtgttgactgatgaggcataatgacttctttcactttttccagtaattcttttccggtgtagcctaacttcgcataattgatcataaccagtttaattgcggtagtcgttccatcatcccacgtatccctcaccatcaggcggccaatgacattgatattcccaccatccggcaaatcatccccctgattatcagccccccatagcatcagcatgtatcgtacccatgtgcgatcagatggcgtaatttttcccactcctttgcaccatttctgacggagttgattttcagaccgaaaataggccaaatccgtaaaatctccctttttcatctcacctccggcaatactgtgtgttgttgttttaccctgttgactaatcgccgtatcgccccacgcgtaacatcaaatttattggccacgctccgctgtgacagaccagaggccagtaagccgatgatgagcggggtatcagacagctctaatttaactagtgggtgaggttttacgccgtaacgctcaaatcgcagatcatccagtgttgaccatgtagggcgtttgcagtctgtcagcctagtgacatagagatgattactacgttgccgaaccgcaaaatgcttcctctcatcccgtcgccgtcttctggcataggaaattgcctcgttaaagttgtcgaatgtcatgtctccagctcccatatctggacatccaaatagcctccagaaactcgttcacctcgcctgatccgcatatcatcaatttggccgtcatcaacccagaaattggcataagttaacgagtcgaaaaccgctttaggcaggttatcgaggtctctctgtcgtctgtccgggggatttgctgtaattgagattttgatgcgagactgggtactgatattgaggttttgctgctgaatgatgttactgatttgctgtcggtaggtgatgcctttctctgatatgtagtgactccgctttgtgtgccgccagtaggtgttattcgatggaggccacggcaattttagattgtaggttttcataatgctccaattaatcccctcctggtcagttccttgacggtaagaacaatagacctgtccatctcgtgtctacgctcgtctctgctcatgtcggttccattgtcgatagcatgatggcattcaggacacagagctgccgtgagactatcatcaaccttcaatcccattccctttccttcgttccggtgggctacctgaatgccgaatctcccacatctaacacagcattcaatttgaccaactgctgccagccattttttactgcggtaggttttctgtttcactctatcctcctaacactatccccataatcagcatggctgctatccaaaacccgaagaatattaggtatttcatttgatttgctccatatgcagcccatgcccaaataccgcgcctgtgtcgatataaagctggttccagtgttttgctgggattgcagcgggagtgtggccaaatataaacaggtcagcccctgtaatttctccactgatatcaacaccagcattgtaaatccggcctcggttccagatgacatcaaaccagtcaacctctttgccgaactcatattcgtcatcggggtagtcggcatgggcgatcactattttcttgtgtcctgcgttgacctcgataattaacggcagctgttcagctttcgctaagagcgcttttgccagtatttcctgctcataatccaagtagagaaaccagtgaccgccattttggaaccagaggtcactatcgccattgtgaaatagcgcatctatcgccatttgctcatgattaccccgaaccgccctgaaccacggttgagttatcaggtcgaggcattcgacatttcgatcccccctgtcaatcaggtcgcccactgatatcaacaaatcattttcataattaaaatcaatctgttgcattttatccgtcagtaactgatagcacccgtggaggtcgccgactacaaaaatactctgatatcgatccccattgattttcaggtaatttccatttctgatttcgttcaccgttcttgctcctctttgagtttcatatactcgctgtcatgcggaattgtcacaaaacaacctaatccagcagcccattgttcaacctgctccatgaatcgaaacatctcgcctgtgtccaatttggaggtctggcgcagtgtcctgacacgctctggttcctgagttctggcatcaatccgctccactgcctcatagcccaaaaatgtgtgtttcatcatttccttgacttcatccggtgagaatttagcgccattagatttcagaaaacgactaatctcgccaaaccacatatgtgcggtcgcgttctgagataatgagcgggtgtttttccacggtttgataataatgcggtgaggttggtttgttgcgagaacttctttgagttgttgccatgcggtgtgtttggttgattcatggaatagaaaattacactccattcctaacctccgttatttgccctctggttccatgcctgaattgctgcgtgtgcgtcagttccataaactgaattgccgcatctgtaacactctacaaaattacaggggcggatcccatttatcgccaaaaaatcgtcgctgtcacattcaggacacaactcaagccgtgtcataccccctccaccagctcatctggtatctctatctcatcacccaacttagcagccactaccgcgcgacagatggcgatttgtggggtgctgccatcttcaattacactttcaaacttttcataattaaatatgtatgccgaccagacttcgtttactgaattaaaatacaattcaatatggtatttctcaatcaactcgccacactgagaccagttagttgatggagagtaagattttgcttcaccgttgaactcaatacgcattttcccacaaaaatcaatagtaactatggacgttaaaaatgactccattgtgacgttgttattaccaatccatccatattcagcatcactagggcggccaaaaatataaatatccatatctgtcgctttagctacggaaaaatccaacgcccgaccagtcagctcactcgtttttagtttcatttcaccccctccaaatgatcaatgaatattgcgtacttaccttcaatctcccaaaactggccttttttgtcggtcatctgataccacaagccgggattaaattttccagtaacacgtcgcgctctgacaaaatagccatcccgatgcgggttaatttctcccgcccacggattgcgcatgtggtcaccaaactgcggcttacgtccattgttgattttgacggcatctgctgccctttctttttcacgttcatgtagtagatctagactcatctcaaaagtccttatggtggggttaaacgttagcgcctttcgcgaagcgcttttgtggtttatcgttgctatgacagatccgcgcggcctcgtcctgatcagtcggcatgaaatgaccatgtttgaaacgctgatagaccgttccaagctgcccgaacctgttttttgtaacaataatttcagcatagggcgctgcgggggaattctcattgtacaccgcatcgcgatacaacatgatgatgctgtccgcatcttgctcaatactgccggaatctcgtaagtctgcgttgaccggacgcctatctgcgcgcttttcaacatcgcgggatagctggctcagggctataacaggcgtttttaggtctttcgccagtcgttttaagctggaagaaatatgcgccacggccagatcattacgctctgcctttggtttatcaatcagccccagataatcaaccatgatgagagataatgccggatgtgctttcttgtggcgccgtgaaattgaagcaatttgctccaccgtcaatttactggcatcaatgatccatacatccagattttgtaatcgcctcagtccaacagtaacccaatcccagccctcatcatccagtcgggcaggatttcgtaaagctgatactggcaggttagcggctccagccaactggcgttcgataatctgctgggaatccatttccattgagaagatcagtacaccgcgtttctgtttggttcctgtgattgtctggtttgcgactccctccgcgactttcagcgcaaactctgttttacccatgccggggcgagcagcaacaatcaccaaatcgacggggtttataccaccggtgatctcgtccagctcttcaatgccggtcttcaacgtgtctgattgctcgccatttttgaggcgtttctccaaaacctcagtgtaatcatccagtaactcagaaacatgcagcggacggatctcatcgcgtggcttacgcacctctgcaacttgggaaataaaccagtccatagactccgctgcattctcaaccgtgccactcagaatgcgttccttagcctcatcaattaactcaatcatgagcctgcgctcatagttggctgaaactgtgttcgcatagccagtaaggttagcggcgctggggcagttcttggcagtcatcatgacattggcgaaatgattttcacccatcgcatcagccaccatcagagaatcaattaaccctctggttttggcctgtgagcgaatggttttgaataattctcggtagaacggggtagcaaacgcctctggctccagtgttgccaatacatcactggcatcaggtgtgagtccactaatcaacaatccgccaatcacactggattcaaaatcgtaattattcatgatctctccctacaaattttccttcacgaacgccagttagcgttgtttctctcagcaaataatcaatatccgccgtccagcccctgtcgttttctccaaaataaaacggacgagccattttcacgaatgccttaacgtaagctctccagccatccacgttctgagtgactagctttgaaatgattttctttaaggctctttggcgtctgctattggcttctacagcgtgtggtaatttctcgccaacctcctcgttgtaggcactgaggtattcgtcgtagttgatgctgggagtggattttcgctttttaggtttagccacctcatcctcattcccctcttgaggggtaaggggtgtattattgtctttcttgtcttttgtaatattgtcttttgtgtttgactgattcggtaaagagtcgtttactgattcggtaaaacttttctttaccgatttggtaaaacttttaccgaatccgttaaacttggtctcccactccgaaatgttcttgttcatgcccacctgacgaccgttttgtatcagcactttcatcttgattaactgattttttgcggtagagcatttagtgctgtctttggtggtcattcgttcgaactgatcattaccaatccagtctatttttttattaaacccgtaggtttttctccagatagcaatcaaaatgtgcaactgcgttgcattgaagccagacaacaaaacggcatcaagaatgtcatttgctattctggtgaacccatcttcaagattcgccactgtcaccgtcggcctctcttgcctgtttttagctccaaaatcagcgtatgcaacgttactcatggcgtttccctccggtcagttcctcgcgatgctccagccgcaatttggcatcctccagagcatcacgcagtttttcacatccctgttcggtgactaaacgagcctcccgttcgcgcgtgagatttttatgcactgcgctgtgattaaatttcggtttcatgtataattacctctgttaaatgtgttgttgagagggacttgcatacttcctctcagtcgttaaatcgacatctcaagttgcatttcagaagcctcggttgctcgaacagccgaggtttttctttttgggtatctgaggttatccaatgctgataacaattggctggcttcaatgcctgtcagaacaatgttcgcctcacatcccggcgctgcaacgcttccttctggtaaccccaattccacaaccaacctgctagccagttttacgatccggctcttttcccgactcaatcccgttgggtgaattcccatgtctctggctaacggactgtttccagtttccgcggctgatttgaaccaaaatgtttccagctcttggggtttacacgtaacgcgagtattgcgagtttttgcgacttccatctgctacagttcctatagttaaattcagttaatgtttgtttattaaataaacaggaatatcgtctatcctgagatagatgatggtgagttgctccaagagcgcctagagcggatcgataatgttaaagagcggtactggttatgctgagagcagttttttcctgctgatatctaacaaatcgttcgcctgatatttgccatcagaaatttgttggatcttctcggcatagttggtcttaccaaaaaactctgtcttggggagaaatccgtttttaagccacttataaacggctctttcgctaactccacatgcatgagctacttcggtaatgccaatatttttaattggttcttccaaagatcgcatagtcactcctttattttcgtactttcagtacacattatgattgaactgaaagttttttcaagtggattatcatcgtacttatggtacagacagaaaaaacgcgcgaacaattttcccagcggctggcgcaagcctgtgagcgggctggtctaaatgaacatggtcggggagctgcgatagtcagagctttaggggtgtcatctaaggcggtgagcaaatggtttaattcggaatctttacctagacaggaaaagatgaatgctctcgctgattaccttaatgtcgatatcgtctggctacagcatggtatagataataccagcgataacgctcgcccagagaaaacacgggaagttaaaccactagttagaaatctaactaaggaacaagaagaactattagaactatttgataggttgccggcagaagaagctaagcgttttttgaaagaaatgcagacaaaagcggcacattttgatgcgattttttcggaaatgctggcaaaacgtggcagtaaagcaagttaacaaaacatatatcaatagtaaacaatcactatttgaaatgttaactatgtcataaattttaatataggctgcgaggagcggctttcaccttgtgtcacaaattagacaattttcgatcaaaaggttaacaggattgtgtagggtaaaatggttaagcctcagtgttctgatgacacattctagagagcgatagataaaatggataattgacagtggcaaaatctacagattaccttcctagtcaggcagaagttgataatgtgctttactgtaaaaagcaggttgattttactggtgttagatggggggagaaaccacccccaaataaaccttttttatggttacaaatgagcctgctcccaacagactctgatggtatacctattcaagggttatctgttcttatccagtggaaaccagatcatgaacccaaacgggaaggagatccggtttatccaaagataaatatcgtagctttttataataaaaaacgagtttttgctgttgatacatatccatttgatggacatacaaatcgttacagaatagaccacccagactttaaagagtatgtattaggcgctcattatcatatttactacgaagaagcagggcattatagtggagtaggatttccaatcaaaagcaacataaagccagatgatttgcttggatattggaattttttctgtgagaaactaaatattacttgtata

SEQ ID NO: 14961 - DNA, 65520 bp, Xenorhabdus bovienii
  Genomic contig Name=Xb4151_4152.C420
ccccaactgtggcaagcgatggaacaagaagttcgtcgtcaggaagaacacattgaactgattgcttctgaaaactacaccagcccaagagttatgcaggctcaaggatctcaactcaccaacaagtatgcggaaggctatccgggtaaacgttactacggtggctgcgaatatgttgatgtggttgaacagcttgcaattgaccgtgcaaaagaactgtttggtgcagattatgccaacgtccagccacactccggctctcaggcaaatgcggcagtatacatggctctgttgaaaccaggcgacaccgttttaggaatgaatctggctcatggtggtcatcttactcacggttctccagttaacttctccggtaaactctataatgtagtcccttatggtattgatgagagtggcaaaatcgattacaacgatatccgttctcaggcacagaaacatcagccaaaaatgatcatcggcggcttctctgcctactccggtgttgttgattgggcgaagatgcgtgaaattgccgatgaaatcggggcttatctgtttgttgacatggctcacgttgctggcctgatcgcagcaggtgtttatccaaaccctgttcctcatgctcatatcgtcacaacgacaacgcataaaacactggctggcccacgtggcggcctgattttagcgaaaggcggcgatgaagaactgtacaaaaaattgaactcttctgttttcccaggtggccagggtggcccgctgatgcatgttatcgcgggcaaggcggttgcactgaaagaagcgatggaacctgaattcaaaatatatcagcagcaagtggctaaaaatgccaaagcaatggtcgatgtatttttagagcgcggttataaagtcgtttcgggtgggactgaaaaccatctgttcctgctggatctggtggataaggagattacgggtaaagacgctgacgctgcattagggcgcgctaatattaccgttaacaaaaacagcgttcctaacgatcctcgcagtccctttgtgacttctggtatccgcattggtactcctgcaatcacccgacgaggattcaaggaagcagaaacttgcgaactggctggctggatgtgtgatgtgctggataacatcaatgatgaagcgatcattgaaaacgttaaacaaaaagttttggcaatctgcgctaaatacccggtttacgcataatttagaataaaaatattactaatactaagcccgactcataacattagttttgagcgggtttttttacatttgaaaaatgggggatttgatggttgttccatcgacattttggctggggttaagttatttcacttactttttttcttttggcatctttttgccattttgggcggtctggttgaaaggtgagggaattgaaccagccattatcggaatattgttgggagtaggcttagttgcccgtttcctcggtagtatgtttattgcacctacagttaaagatccttcgaaattaatcactgcattgcgattactgtccctattggcactgctctttgctattggttttacatttggtagccattgggcatggattttctttgtcatgataggtttcaatctgttcttttcgccactggttcccttatcggacgccttggcgggaacgtggcaaaaacagtttacttttgattatggcaaggtacgggtctgggggtcgattgcctttattatcagttcttcgctaacaggtatattgatgtcttccaatggcatcaacttttcaatcagcaatttagaattgagtctttcttttgacagaataaataattgggttggaagcaatttgtttggccatcaccatatcattcttgccttcttgattttcagcctttctgtcatgttgctgggtatgatgttaaaaccatccattatgcctgcgggtaagatcaaagccgtaaatactcatatggtatcgtttaaagaactgctgtctgagaagtctgtatggcagtttttattgtgtgtcaccttattacagggagcacatgcaggttattacagcttcggttccatttattgggaaaatgcaggctattcttcagcaaccatcggttatctctggtcgctgggcgttgtgacagaagtcattatttttactttcagtaagcagttgttccgtcgttggaatgcccgtaacttactgttgctctctgctatttgtggcgttcttcgttggggactgatgggcatatcaactgaattgccagtgctgatcatcattcagctcctgcattgcggaactttcacagtttgccacttggcggctatgcgttttattggtgccagaaaagaaaatgaaattattcgattgcaggcaatttactccgggttggcgatggggggaggtattgccgtgatgagtgtgattgctggattcttatacgaatatatgcaaagtggcatctattgggtgatggcgttagtggcatttccggcgcttttcctaaggcctaaagtagaagcacgagtgcactcattacctaaataacaacaaaaaagggcaccagatggtgccctgaaaataatattgctcaaatagtcattattgtaataataaaaatcagcgctttaatgcttcgcttaattcttcacgcatttcagacaacatgtctttaacgatacgtgggctacctgcaacgatattaccggagttgatataattgtgacccccgacaaagtcggtaacgatgcaacctgattcacgtaccagcaattcgccgcccataaaatcccaaggcttcagaccaatctcgaagaaaccatcaacacgcccggcggcaacatacgccatatccagagcagcagaaccagtgcgacggaagtctgcacagcggtcaaataatttgcccaggattttaatataaggggtagtgtgctgttttgccttgaatgggaaaccagtggcaaggatcgtgccatccagatcacgggcattggtgccacgcagacgataaccattcaattgtgcgccttggccacgggctgagctgaacagttcattgcgcattggatcataaactacagccacttcggtacggcctttgatgcgcacagcaatggaaacagcaaaatggggaagacgtttaataaagttggtggtgccatccagtggatcgatcacccagtggaaatcgtcttcttcacctaagtgctcaccgctttcttcagtgataatggtgtgcttagggtaagacttacggataatatcgatgatcagcctttctgcttcacgatcaacattagttacaaaatcgttgctgcctttttggctagcttcgacggcatcaggtgtttcgtagcttttggcaatgtaattgccggctttacgcgcagcgcgtatagcgatggttagcatcggatgcatggggtatcttccaccgggatgttaaagaacgggaaataaatcgggtcgtactatagcagtagttcggcaaaataactaatgctgtgttaagatattcgactcttataccgaatctaaaagccgtcatgttagagaatatccgcattattctggtagaaacttcccacacgggcaacatggggtcagctgccagggccatgaaaacaatgggattaaccaacctttatctggtgaatccgctcgttcaacctgactctcactctattgcactttcagcaggtgccagtgatgtcattggtaatgcaacaattgtgaatacactggatgaagcattggctggatgtgagctcgtcatcggaaccagtgcccgttcccgtacgctttcctggccgatggttgaaccacgtgaatgtggagaacgctgtattaaggcagccggccattccccggttgcagttgtgtttggccgtgaacgtgttggcctgacaaatgaagaattacagaagtgtaattaccacctttatattccgaccaacccagaatatggctcgttaaatctggcaatggctgttcaattggccagctatgagattcgcatggcttatctcgcagttcaggaaaagtcagaacacgtggaatccacggaacatgaggtagaatatccccctgtcgaggatatggaacgtttttatcagcaccttgagcaggtattgaatgattctggtttcattcgcaaggcgcatccaggacaaataatgaacaagttaagacgtctttatacccgtgcacgtccagaaactcaggagctgaatattctgcgtggtatactgacttccatgggaaaatggtctggaaaataaccggaatagcaggaaacagccagaaatcgggtggatagcaggtgaaaaaaaagtgacaggcaaccaaaataatagttgactaaattagtaggttaaatagttgactaaaacactcaggaatgccacaatttcactcatatttcaccatggagtttttgttatgagactgacatcaaaaggacgttatgcggtaacagccatgctagatgtggcgttgcattcacaagaagggccggtgccattagccgacatttctgagcgtcagggaatctccctttcctatcttgagcaattgttttcccgcctgcgtaaaaatggtttggtttctagtgtccgtggtccaggtggcggctatttgctgggcagaaatgccggtaatattttcgttgccgaagtgatttctgctgttgatgaatctgttgatgcaactcgctgtcagggcagggaaggctgtcaaggtggtgatcgttgtctgacccatacactgtggcgtgatctcagtgatcgcatcacgagtttcctcagcagtattagtttagaagaattagttaagaatcaagaagtcttagacgttgctgatcgtcaagacagcgataaacgccgtacacctaacggcaggcctcaagagacgattaacgttaacctgcgtgcgtaaactttgcggcaaacagaagtattaaaagtgttttacggagcatgtgagcaatgaaattacccatttatttggactattcagcaactacaccggttgatcagcgtgtagctgaaaagatgatgaactatctgactatggacggggttttcggcaaccctgcttcccgttcacaccgttttggctggcaggctgaagaagcggttgatattgcgcgtaatcaaattgcagatttggttggagctgacccgcgtgaaatcgtgttgacttcaggtgcaacagaatcagataacctcgcgatcaaaggtgctgcaaaattttatcagaaaaaaggcaagcacattattacctgcaaaactgaacataaggccgttttggatacttgtcgccagttagagcgtgaaggttttgaagtgacttatcttgcgccgatgagcaatggcatgcttgatctgaaagaactggaagccgccatgcgcgacgatactattctagtttccatcatgcatgtgaacaacgaaatcggtgtcattcaggatattgtcaccattggtgatatttgccgcagccgtggcatcatgttccacgttgatgcaactcaaagcgttggtaaattacctatcgatctcagcaaattgaaagttgacctgatgtctttctctgctcacaaattatatgggccaatgggcatcggagcactgtatgttcgccgtaaaccacgcgcccgtattgaagctcagcagcatggtggcggtcatgagcgcggtatgcgttccggtacattgcctgttcatcagatcgtggggatgggtgaagcttaccgcatcgcaaaagaagggctggaaacagaatcagaacgtctgcgcggtttgcgcctgcgtttgtggaacggtattaaagatattgaagaagtttacctgaacggtgatttggaactgggtgcaccacacattctgaatgtcagcttcaactatgttgaaggtgaatcattgatgatgtcgttgaaagatttggctgtttcttctggctcagcatgtacttccgcgagtctggaaccttcttatgtcctgcgtgcgctgggcatgaatgatgagctggcacacagttctattcgtttctctttgggacgttttaccacagaagaagaaatagactatgcaatcaaattgattcacaacgcgattggtcacctgcgcgagctttctccattatgggaaatgttcaagcaaggtgtggatatcagcgccatcgagtggtctcatcattaatcaaacagtttcaggagtaacgaaatggcttacagcgataaagtaattgatcactacgaaaacccacgtaatgtgggttcatttgacagtgaagatccttcagttggcagtggcatggttggtgcacctgcttgtggtgacgttatgagactgcaaatcaaggtcaataacgaaggtatcatcgaagacgcgcgttttaaaacctatggttgcggctctgcgattgcgtccagttctctggtaacagaatggatgaaaggaaaatcgctggaacaggctgaggctattaaaaatacagcgattgccgatgagctggaattaccacccgtgaagattcactgctctattctggcagaagatgctatcaaagcagcgattgcggattataaaagcaagcgcgaagctaagtaattcttttaacaagaagacataattctggtggatattgattcaatatccacctttactagttttaaaagtgaggtgttgtatgtcaatttccctgacagaaagtgcagcccagcgtattttggcttttcttgataatcgtgggaaaggggtagggttgcgtttgggagtgagaacatccggctgctctggtatggcatatatacttgaattcgctgataccgttaacgaagaagatcaagtttttgaagacaagggcgtgaaagtcatcgttgatggtaaaagcatcgtttaccttgatggtactgagttggattttgctaaagaaggtctgaacgaaggcttcaaattcaataaccccaatgtttccagcgagtgcggttgtggggaaagttttcacgtttaacccattttttgactgagcactttacgaaatatctgtatttgcaaaacatgagtaacttatggactattttactttattcgggctgcctgtacgctacgtgattgaccgtgaacaattgtcgatccgttatcgggaattgcagcgtcagtttcaccctgatcgttttgctaaccagccagaacgtgaaaaagcgcaggctcttcagcaagcgtccatcattaatgatgctctttatactctgatacatcccttaaaacgtgcagaatatatgctgtctcagcaagggttcaatttgtccggcgagcagcataccatgcaggataccgcgttcctgatgcaacagttggagttgcgtgaagagcttgatgccattgagcatagcgcggagccagaaatcgcattggccgatttttcatctcgcttgagtaaaatgatcaaaacacgcagtgagcagatggaacagcagcttgatgctgcacaatggctaattgcagccgataccgtccgtaaattacgctttctggataaattgcaacagcaggttgaacaactggaagagcggttgctggatgatttttagctggatagctttttagtaaaatcgcttttggctgaatagtttttataggggcacacatggctttattacaaatcagtgaacctggtttatctgccgaaccacatcagcgtcgtctggccgtggggattgatcttggtacaacacactctctggttgcgacagttcgcagtggtcaggtagaaaccttggcagacagtgaaaaccgtcacttacttccttccgttgtacaatatcgcaaagatgaaactcaggtcggctggcaggcgcgtcagcaagcggcatccgatcctgttaataccattatttccgtcaaacgcatgatgggacgctctttggctgacattcagcagcgttacccaaatttgccataccagcttcaggcaagtgaaaacgggctgccgttaatcaatactgtggcaggtctggtggatcctattcaggtttcttctgaaatattaaaatcgttggcacaacgggcagaagaaaccttggatggcaaacttgatggtgttgttatcactgttccggcctattttgatgatgcgcagcgacagggaacaaaggatgctgcgcgtttagcaggtctgcacgtcctgcgccttttaaatgaaccgactgccgctgctattgcttatggtcttgattctggtcaggaaggtattattgctgtttacgatcttggtggcggaacattcgacgtttctgttctccgccttagccgtggtgtatttgaagttctggcaaccggtggtgataccgcactgggcggtgacgattttgacctgttgctggcgaattggatccgtgaacaggccgggatcagcgatagtgaccacgggttacagcgtcaactgttggatgtcgcgacgcaggctaaaattgctttgagtgatgcagatacggctgagatcaacattgcaggctggcagggcaatattactcgtaccgaatttaatgagttgatcgtatctctggtcaaacgcacattactggcctgtcgtcgagccctgaaagatgcgggtgtcacaacggatgaagttttgcaggtagtgatggtcggcggctcaacgcgcgtaccattggtacgcagcatggtgggcgaatttttcgaccgtgaaccactgacctctatcgatcctgacagagtcgttgctgttggggcagcgattcaggctgatattctggtcggtaataagcctgatagcgaaatgttactgctggatgttatcccgttatcactcggtctggagaccatgggtgggctgatcgaaaaagtcattccacgcaacaccaccattcctgtggcaagagcgcaggagtttaccacattcaaagacggccaaggtgcgatgagtatccatgtggttcagggagaaagggagttagtgaatgattgccgttcactggctcgtttcacgctgcgtggtattcctccattaccggctggtggtgcacatattcgcgtgacttttcaggtcgatgcggatggtttgctgagtgtcagcgccctggaaaaatccacgggcgttgaagcttccattcaggttaaaccttcctatggcctgtctgatgcggaaatcgcccgaatgctcagagactcaatgaccaatgcgcaggaagatattcaggcgcgtaaactggctgaacaaaaagtagaagcggcgcgggtgctggaaagtttaaccagcgcactggaaaaagatgccgacttactgagtcaggaagaacaggctgccattgatgctgccgtagaagtattaatcgagagcgcacagggaacctcttctgatgcgattgaaagtgcaattaaacaattggacaaacaaacgcaggagtttgcagcgcgtcgcatggacacatcaatccgccgggctttggcgggtcattctgtggatgagatttaattatgcctaaaattgtatttttacctcataacgaactttgccctgaaggtgcagtattggaagccaaagaaggcgaatcgattctggatgttgcactacgcaatggtatcgaaattgaacatgcctgtgaaaaatcctgtgcgtgtaccacttgtcactgcattgtcagagagggctttgactcattaaaggaaagctctgaattggaagatgatatgctggacaaggcatgggggctggagccagaaagccgtttgagttgtcaggccaaagtcactgatgaggatttgattgttgaaatccccaaatactccattaaccacgcgcgcgagcactgataggagaatggaaaatgaaatgggctgacagtcgtgacattggtgaagcactgtatgataaatttccggatttagaccccaaaacggtgcgtttcaccgatttgcaccagtgggtttgtgaactggatggttttgatgacgatcctcagaaatccaacgaaaaaatcctagaagctattttgctggtttggctagatgaatttgagtagtcaaatgaagtgtgaaaaaaatagcacaagttcacctatcattgctcaatagcttggcataacctgcatttaatggaaaactggcaatcgccagtttttttacattaataaacccttactgtgaaaacagtgaaaataagataagaagtgagaaaaaatgacaaagcaagctatatcaaagcaaatcatgccgataacactgtcttatgagccagctaacgcttgctggggtgaaaaagcgctagttagttcaagtgagcaaggaattaccatccatttggagggtaatggtaaatccggagcaatccaacgtgctggacgtaaaattaatgggcagggtatccacaacgtcgctttgacaggtgaaggttgggatctggaaaaaagctgggcattctggcaaggctttcgtggttcaaaggggctgcgtaccattgaatggccacaattacctgcggtagacaaaaaagaactggataatagaatcaaattcgttgattgggtgcgagataccatcaacatgccggcagaagaattagggccagagcaacttactcagcgagcgattgacctactgaatggtgtagcgggtgatgccattagttatcgcatcataaaaggcaacgatttacgtgagcaaggttatgttggggtgcataccgttggccgtggttcttcccgtgatccggtttttctggcgttggatttcaatccgacaaaagaggaaaacgcacctgtatttgcctgtttggtaggtaaaggcatcacctttgactcagggggttacagcctgaagccgtctaattccatggattccatgaaatcagacatgggtggctctgcaacattgacgggcgcactggcattggcgatcagccggggtttggaacagcgggtcaaattatttctgtgcatcgcggacaatatggtgagcagcaatgccttcaaactgggcgacatcattcgttatcgcaatggtaaaactgttgaggtgatgaacactgatgcggaagggcgtttggtactggctgatggcttgattgatgccagtgcggagaaagcaccccttatcattgatgctgcaactttaaccggtgcggcgaaaatggcggtaggtaacgattaccactctgtattcagttttgatgatcaattggcagcagacttgctggcagcggctgatgctgaaaatgaattgttctggcgtctgccattggctgaatttcatcgtagccaactgccatccaattttgctgacctgaacaatattgcttcaccttctcactcagcaggcgcaagtacagcagcggctttcttgtctcattttgtggaaaactacaaaaaaggctgggtacatatcgattgttcagcaacttaccgcaaatcggctgttgaacagtgggcggcgggtgcaacagggtatggtgtgcgcacaattgctaatctattgctggctaaagcaaaataaacagcgatacccaatagatttaagattacctttattcatagtctcccttaaaaagggaagactatgattgaacctttcaatagtctttaacttcaattcaaatatcactgttcggagattttcatgagcttatcaaatgggtctgttgccaccgaaatggaggttctcagtggaagtcgcattaccctcagtcagccagaggaacaaccaagccagcttattgacgccttgagtggtttatttaagcagcacaaacctgtgcgacgggcttttctgattatggctcacgacaaaaatctggatgagaaacccaatctattaattgggctagaattgagtgacgcaccgatagacaatgatatcaatgtgctcattcaagaggcaggggaagtggcctgtgaataccttacggaagatgaatcggtagatttttgcctgatcaatgaaaacgaaaggggtattagccattacctgattcagcatactcagcctttctaccagcgaaaattaggaagctggctgcgcgataccattcctgttgttaatcgggaataaatgcaggaaaaattttgtactagatgaaagttcagttattttttctgtgctttggttatgcaaaataggaagtatcataataactatctataaaaaataatatttctaaatatccggcaaactacaagggttattgttatgtctcaacgtcaatcttggcaatggtcggcaaggaaaaagcgatatctcgcggtcatgcttgccacgttatttacgctattcgcgctatctgcatgcgatcaatccgaaagtcctgcgaaagaaaatacagaagaacgacagacatcattgtctaagaatagtgatactgccaatggtcatgcaaaatcggcagctacatcgcctgagaacaaacaagctacggcaaaaaaacaggaaccccaatcgtcagcacagcgctatgcgggtaaagacgtcacgatcctggatgcatcagatctgcaattggatggtgccagtgcgatggttgtgacattttccgttcctttagactctaatcaagatttttcacagaaaatacatctggttgatgtgaaatcggggaaattagagggtgcatgggaactgtccaataaccagatggaacttagactccgtcatttaccgcctgaccgtgaattgcagctaaccgtggacgaaggcgtgaagggtatcaatgaacgccaattggcaaccgcatatgagaaaaaattcaagactgctccaattacaccaactgttggtttcgccagcaaagggctgcttttgccaagcaaagcagcagaaggcctgcctgttctggcgctcaatgttgaccgtgtagatgtaaactttttccgtataaaagatgaggccctgccgtcatttattgctgattggcaatacagcaacaacatgaattactggaattccaaagagttactgaaagatactgagttagtctacactggccgcttcgaccttaatcctactgctaatacccgtgaaaaattactgctgccattaagtgacatcaaagagctgcaaagagagggtgtttatctggcagtcatgcagcaggcaggaaaatatacctatagtaatccgagcactctgtttaccctgagtgacattggcgtttcgatgcacagctatctgaatagggtagacgtattcactcagtcattggaacaaggttccagtctgaaaggtgttgaaattcgtctgctggatgcaaaggggcaacttctgtcaaaagccacgacagatagtgatggacatgccacactggaaaaaaatgctaaggcaaaattattgctggcgatccagggtaggctaaccagcatgatagacctgacatctcctgcacttgatctgtctgaatttgatatcggtggctcacaggggtatagcaagcaattctttgtatttggcccaagggatctgtatcgtcccggagaaatgttgattgtcaatggcttattgcgtgatgcggatggccgtccgcttaagccgcaacccgtcaaggttgatgtattgaaagcggataatcaggtcgttcgcagttttgtctggcaaccggaaaatgaactgtaccaataccgttacccaattccccgcgaggctgaaacggggatatggtcactgagattcgatttaggtgataataccccgcgttattacaaattccacgtcgaagatttcatgccggaacgcatggcgttggaaattaaaagtgcatctaataatcagtcactgctgaagaatgaaagtgttaatttcgctataacaggtcgttacttatatggcgcacctgctgctgataatcgcctacaagggcaactgttcctgcgtcctgcccgtgatgcagtggcaaaattaccgggatatgaatttggctcttcaaaagaagaggggttgagccgaacattggacgaatttgatttcacgctgaatgccgaaggaaaggctaatctttcagttagtgaggatgaatggaaacaggtgacatcccccgtgaaagttatcgttcaggccagtctgcttgaatccggtggacgtccggtgacgcgccgtgctgaacaggcggtgtggccagccgaaaaactggctggtatacgcccacttttcaataaaaaatctatttacaactaccgaacaggacatgatgaaaaccgctataacgtcgatgaaaattcactggcagaatttgacgtggtttatgcggatgccagcggtaaaaaatatgccacgaatgatttaagaacccgtctgatatatgagcgccgggattattattggcgttggtcagacagtactggctgggattcagggtatgaccagaaagatttagtcatggctgatgacactattcaaattgcggaaaatggcacagccaaagtcagtttccctgttgaatggggttcttatcgcattgaagtggtgaatccacaaaatcagctcgtgaccagcctgaatttctgggcaggttattcatggcaggataataccggaggtacaggcgccattcgtccggatcaggtcaagatgtcattagataaacccgcgtataaatcgggtgataaagtgaagttgcacatggttgcgccacaggaaggtaaaggttacttgctggtggaatccagtgatggcccactgtggtggcaggaaattgatgtaccggaaaaaggtctggatattgatgtgccaatcaatcaggaatgggctcgtcatgatttgtatctgaccgcagttatcgtgcgtccaggggataaatcccgtcaggccacgccgaaacgggcgattggggtattacacttgccgttgatggatgaagggcgcaaattgaatctgaccttgaatgcccctgataagatgcgtccaaatcaggatctcaccgttaaaatcaaagcgacttctcagcaggggcaaaaactgcctaaacaaatttatgtcctgctttctgccgtagattctggcgttctgagcattactgactttaaaacccccgacccttatgacgctttctttggacgtaagcgttacagtgttgatcagtatgatgtttatggccatctgattgaagccgaagggcgtaaggcgaatttgcgttttgggggagatggtgatgaaaatgtactcgatagaggcggtaaaaagccactgacggaagtaaaaatcatcgcagaacaggctaaaccgattactctggatgctaatggggaaggggaaattaccttacctattcctgatttcaacggtgagctcagactgatggctcaggcgtgggggggggaggaatttggtcacagtgaacgcaaaatcatcgtggctgctcctgttattactcagatgtcactgcctcgctttatggcaggtggtgatcaatcccaattggcgcttgatctcacgaatctgaccgaacagccgcaggctattaccgtgaatttagaagcgaaagggctgatcaaattacaagacccgataagcaaaaaaatcattctggagacaggaaagcgaaccaccattcaaattccggtcaaggctgattatggatttgggcagggagaagttttcctgaccattgatggattgaatttgcctgatgaaaagctgaaacagtaccaaaatagctggaaaattggcgttcgtccggcgcacccggccaaaaccattcagtttgcagatgtgattcaccaagggcaaaactggcaattaccgcagacagccactgctggtctggtactggatactctggaggggcaattattgctgaccagtcggccaccactgcaaatcgcacgttatatccgcgaattgtatgcttatccctatggctgtttggagcaaacagtaagcgggctttatccatcactctattccaatgaagctgagttgaaaaaactgggcatcgatacgcaaactgatgaaaaacgtcggtcagccattgatgcaggtattacccatctgctgagtatgcagcgtcatgatggtgctttttctctatggaaccgtaatggtgatgaagagttttggttgaccgcctatgcgacagatttcctgttccgcgcaactcaacaaggttacagcgttcctgctgatgctctgaagtcggcgaatagtcgcctgctgcgctacttacaggataaaagtgttattactgatcgttacagtggttcccgcatcgaaacacaattttctgtgcaggcctatgcgggtttggtcttggcaagtcagcaaaaagcgccgttgagcggtctgagacagctttatgaacgccatcaacaggcaggaaatggtttatctctggttcagttgggtattgcactgaaaatgatgggggataatacccgtagtcatgaggcagttcgtttagggattaataaggcccgccaatctggctatggattaggtgattatggcagcacaattcgtgataacgcattgattgtttctctactgacggagaacaaaatgttgcagaaagagcgtgatgaaaagctgctcgacttatccaatgaattgtcaactcgccattacttctcgacacaggaaagtaattcgctttatctggcggggcgttacttgattgacgcttctgagcaatcttggaaagcagagattaatcagcaaatgccaccccttcaccgtgacagtgcattgactgaaacattgacagcgaaacagatcctagaaggcatcgatatcagtaatcgtggtgacagcacattgtattcgcgcctgaatgtggtgggatatccattggccaccccagaaccttcctcaaatgttttgaaaattaagcgtacttaccttgacttagagggtcactatttccctaccgagcgtatgagaagtggtgaaatggtggttgtgaaacttgaggttaatgcgacacagtcagtgccggatgcattagttgtggatttactgccggctgggttggaaattgagaatcagaatctggcaagtagcagtgctagcctgagcgaaagtgctacgggattgcaggatattgtcgaaggcatgcaacaggcgaatatccgccacatggaataccgcgatgatcgttttgtcgctgctgttgccgtccagcctcaccagaccgtgacactgttgtatcttgctcgtgcggttgcgccgggtgtctatcaggtgcccgcaccacaggtcgaatccatgtatgttcctcactggcgtgccgtgggtgaaacaaacgaaaaactggaagttgtccgctaatcactacccgccccaatccttagtgataggggctgttccctttcggatacggttttaatgagaagattgtcttcccgcatttatctgattgcgttggttattttattcgcactccttgcggcagtgtggctggcagataaaatctggccgctgccactgcataatgtcaaaatggcgcgtgttgtggtgggagaagatggctcgccactgtggcgttttgccgacaatgagggggtctggcgttatcctgttactttggagcaggtttctcctgaatatattcaggcattgctgacctacgaagatcgctggttttacaaacatccgggcatcaatcctgtttctttgctgagggcggcatggcaggacatccgtgcaggaaaaattgtgtcggggggcagcacaatctccatgcaagtggctcgattgattgatccacatccgcgcaccttcgcaggaaaattcaggcagatttggcgcacgttgcaacttgaatggcattattcaaaagatcaaattttggaaatgtacctgaaccgtgcaccattcggtggtacgttgcagggtgttggagcagcaagctgggcgtatctgggcaagccgccgtcagaactttcgccgggtgaagcggcattattggcggtattaccacaagctcccagtagcttaaggccagatcgctacccagaacgtgcacaggctgctcgagacaaagtattacagcgactgaagcgatacaatgtctggtcagcggaaaacgtcgctgatatcaaagaagaaaatgtatggctggcgcctcgtcaggttcctcaccttgcgcctttactggtaaggcgagtggcaaatggaaacccgcaggaagtgatccagacaaccattgatacaggattacagcgccaactggaggatatggttctcaattggaaataccaactggcggacaaaacatcgattggggtgttggttgttgatcatacggatatggcagttaaagcctatattggttcggtagaccttcaggatgacagtcgttttgggcatgtggatatgataagcgcatggcgttcaccgggctccacactcaaaccttttttatatgccatggcgctggatgatggattgattcatggggaatccttattgcaggatgttccccgtcgttttaatgattaccgtccgggaaattttgacagcggctttaatgggcctgtcagtgccagtgaagcgctgacgcggtcgttgaatttgccagcagtacaacttctcgaatcttatggtgctaaacgattcaccgctaatttgcgtaatgtgggaatggtactgcgtttcccgcttggcagtgagccgaacttatcgcttattttgggaggaacggcggctcggatggatgaactggtatctgtttacagcgctttcgcccgtcaggggaaagcttcgccgttgcgctttacaccacagcagaaaattcgtgacagacaattattctcagcaggggcagcttggattgtcaggagggtcatggcaggtgaaggacgaccaaagcctgatgatagcctgtctgccgaagtccctttagcgtggaaaacaggtacgagttacggttatcgtgatgcatgggcgataggcctgaatgcccgttacaccataggcgtgtgggtcggcaggccagatggcactcccgtagtagggcaatttggttatgctacggcgatccccattatgaaccagatcaacgggctgttaatggaaaatttacgctatagctcacagcgtattcctgttgatccgcgaccgataagtgtcagtcaggcaactatttgctggccgagcggaacaatgtttactaaagaaataattgctaaaggaggcagtaattgccgtcagcgtcgcttaagctggattttggataatacaattccaccaacgttgcctgccgttgggcaagaagggatttcgggtattaacgaacagatatggatagataaaaatggtttacgtgttgcttccgattgtcctgatgcccggcctgaaaccgtagtcttgtggccgattacgttggaagcatggctaccggcaaaagaacgtcggtcgaatcggttaccaccgattaatccccaatgtccccctctgaaaatagatgtggctcccttgctcattgtgggaattcgtgaaggggatatcctgaaacgcattccggggaaaaatacgctggacttacggataacaacgcagggtggtagcggtcagcaatggtggtttttgaatggtgaacaagtttttgtgacaaaaaacaaccagtcgtggggggaaactttgtcacagcctgggaaatatcaacttagtgttttagatttgagtgggcaaatcagtgcaatcaattttgttttgaagtgattgatggtgtgtttgtgaccttgattaaagaaatattctgcttttaaaacatggtcttaaccatatcctttaaatctcaacaccttatttttatcgtaaaacaataaaaaattattgttttacgataatttaaagctataatttgatcacgctaaataatgggtcataaacatgatgcactcttcaaaatttacaagaatgacggcttgcagtttggtgatatctaaattatctttattaattattatcatattgatagtaattaatatttatagctggctggagccaaagttaatattagagaaatatgggttaggattttcgctgacaaatagaatattattgcattttaatgagaatactcttagcccgtggaaactgaccagtgggatatttatatcgacaatcccattattgttcttgggagggagcctctgggcttttcatcagttattcagcaattatcggaagagtaattatttttccaagaatacggtgaaatatttggaatatgcaggttggggggtcatcatctgggctatgttagatattctttttgaacctttattaactgtttggctcaccatgggagcgccagcgggtcagcgatttttttcattgagtctaagtcctagccatcttgttgctatttttatttcggtttgcctggctgtcatttcgcgtattctttatcaagcatgtgatatatatgacgaaaataagagcattatataggagatattgtggcaatttatatcactctagatgtgctcatggcaaaacgaaaggttaaatctaaagaattagcacaagccattggtattactgaacaaaacctttctttgctgaaaacgggaaaaattaaagggattcgattctctactcttgatgccatctgccaatatctagattgtcagcctggggatatattggaatccaaagatgattaatcagtaaatcatgtcggtagttctattaatttaaatcgcgaggaaaaaagatgaaaatttttttatatgctttgctactggggttattttacattcctgtttcttttgcagattcgtcagcaaaaggtgttgataataaaatggagaataaacaatcaggtaatcaaggagcgttgagaaaatgtacacatctattgcctgaaggtcataagtataccattagcattattggtacatcagataagacaacaaaagaggccaataagcagttcaaaggggaatttaaactatcgagtggaagtaaaaagccattggataagaaaagaaatgaagagagtaaaccttttattcaatgcgtaacagagacggttctgtaatcggaactgcattaaaacgctgagtcaatgatcttgatcagaatgcctatttgggattttatcgcctgaataggtattattttatagaatcaatcgggcaggatggtatgcattggcagaaagtaagtgatctccaatatcctggattggtgtaaaaaacagcttaattcgctttgtctcaaagtgtctgtatagtaaaaatgtgatttatgctaaaaaatgataattttcgctaagaaagctttaataaaatgttatgttttttgtaggcaagcagaaagtctcctcctataatcaacgcctatttttattcctgtcaggtacaggataaatctcgtctccctgttttagcaaagggagaataaaaaattaaaatgaatcatcgctgaaagtgccaaagaggttatctaatgacgattgaacgtactttttccattattaagcctaatgctgtgaagaaagatgctatcggttctatttatgcccgttttgaaagtgcagggtttaaaatcatcgcagccaaaatgctgtatttaacacgtgagcaggctgaaggtttttacgctgagcacaaaggccgtcctttctttgatggtctggtagaatttatgacttctggcccaattgtggtacaggttctggaaggtgaaaatgcggttcagcgccatcgtgatctgatgggtgctaccaacccggacaatgcactggccggtactctgcgtgcggactatgcagatagctttactgaaaatgcggttcacggttcagactccattgaatctgcaaaccgtgagattgcttattttttcagtgatgatgaaatcttcccccgccactgatattcagttactcgtagcatctgaacagtaaagtttgtacaatgtcgcgcctcactgatttgatttagtggggtgtttattattttatctcaatactcaattatcactgtatatagtggttattgaattgatagtcaccgaatcaaaacttagtgctgaaattaaatcagcacagagccgaaagtgtaacaacgaggcgatgtaaaaatgtcccaacttaacgaaaccgtacaaccttcaaccgccgctgtatctgtcactcctgaaaagaaaaacggcaagatcaatctgcttgatcttaaccgtaaacaaatgcgtcaattttttatcgatatgggggaaaagccttttcgtgccgatcaagtcatgaaatggatgtaccactattgctatgacgattttgagcagatgactgatatcaataaagtgctcagaatgaaattgcagcaggtggcagaaatcaaagcacctgaagtggcagaagaacagcgttctgcggatggcaccattaaatgggcaattactgttggtgatcaacaggttgaaacggtttatatcccagaggatgagcgcgcgacattatgtgtttcatctcaggtcggatgtgctttagagtgtaaattctgttccactgcccagcagggatttaaccgtaacctgcgggtttccgaaattattggtcaagtctggcgtgccgctaaaattattggctcgctgaaatccagtggtcgtcgcccaatcaccaatgtcgtcatgatggggatgggagaaccattgcttaacttaaacaatgtcgtgcccgctatggaaatcatgatggatgatttcggttttggattgtcaaaacgccgcgtgacgttgtcaacatctggtgtagtgcctgctttagacaaattgggcgatatggttgatgttgcactggcaatttccctgcatgcacctaccgatgatgtccgtgacgaaatcgtgccgattaaccgcaagtacaatatcgaagaatttttggcgggagtgcgtcgctatttggcaaaatctaatgccaatcaagggcgggttacggtggaatatgtgatgcttgatcacgtcaatgacagcgtggaacaggcacatcaattggcggaatgcctaaaagatacaccaagcaaaatcaacttgatcccatggaacccgttcccgggagcaccttatgggcgtagctccaacagccggattgaccgtttttcgaaagtcctgatggaatatggttttacgactattgtgcgtaaaacgcgaggggatgatattgatgccgcatgtgggcagcttgctggtgatgttattgatagaacaaaacggacactgaaaaaacgtctggcaggtgaaccaattcaggtaaaaccagtctaatttgtttgtttaatagcgattaatggttaaaaatctggcgaagtttaacataaccttataaatgaaaatggtatgatacggaaatcaataatttggtctatagtttgttttggcctgatcacgggttgtgcggaacgtgccccgcatcacggtcatcagatcgttgcaatagatactcgattacagctagggaaagcctatttagcggaacgaaatttatcggctgctaaatatcattttcaaaaggttttgctggcgaaacctcgccatccagaagcgcatttgggtatggcgttgtatgaatattatgcaggtcaacccaaagctgccgatcagcattatagaatggccatgcagtatgcggcaggaaatgatactgtaatacgtcattatgctgcttttctctgtgaacaaaagcggaatgaagaggctaaaaaattggtcacgggaaacaacacaagccactacacttgtgataaatgattttctgcgttcgacgcagtatgaaatgatttcgctgcacaaattaagttggatgttctatcaaattaatttgcgtaaatactttaacctgaacagtaccagtgcccttagctaatgaagactgaaacttacccagaagaagccaatctgacaacgggtcagattctgcgccaggctcgtgaaaaacttgagctttctcagcaaactgtggcagatcgtttgtgtctcaaactgtccactgttcgtgatattgaagaagataatacgcagtcaaatatcgccctgacattcttacgtggatatattcgggcttatgcgaaacttgtccaagtccctgaatccgatattttaagtacattaaataaacaaatgcccgctaagtctgggaaagtttccccgatgcaaagcttttcgtcaggaaaaaagcggaaaaaacgtgatggttggttgatgaaaacaacgtggggcgtgctcattgtgctgctgggaatgactgggtggtggtggtggcagaattacaccgcgcagcaaaaagacttagcttcaatgacaacacaatctgatgcttataacgcccagacgcaaggagatgaaagtgacttgggcacttcaacaacagatctaagtcaactacctgaccatgctaaagatgataactcagttgctgcggctcaagaagaaacctcttcagtattagcaaatccggcagcgaacagcaatacatcatcgccgggcaatcaatcagttgtaaattcagtaccagcgacaactaatacagcaccaaattctgctgtgaatacattatcggctgacgtgaataataccagtgcggttaacagtaatgaactggtgatgaattttaaggcaagatgctggttacagattacggatgccaatggtaagactttgttcatgggcacaaaagataaaggcagtagtctgaaactttcaggtgccttgccttataagctgaaaattggtgcgcctacggcggttgatatccagtttcagggaaaaaccgtggacatgactcgttttgtcaaggtgaaccgtattgcccaactgaaattgccagaaaataattaacaattttggcaaattggcgaacatttataggcgaatattgaatagaaattcaagttcgcctgtgtgtattattcaccacagcatagttgtaatttttataaacaaaatacagggatgtaggggagtaatgtaaaaatgcataatgaatcaccgataaaaagacgtaaatctacacgtatttatgtcggtaatgtgcccattggcgatggcgcacctattgcggtgcaatcaatgacgaacacacggacaaatgatgtagaagcgacggtcaggcagatcaaatcgctggagcgtgtaggtgttgatatcgtccgtgtttctgttccaaccatggacgctgcggaagcgttcaaatccatcaaacagcaggtcaatattcctctcgttgctgatattcatttcgattaccgtatcgcattgaaagtcgcagaatatggcgttgactgcctgcgtattaaccccggcaatattggcaatgaagaacgcatccgtcaggttgtggattgtgctcgtcattacaatatccctattcgtattggggttaatggtgggtcgctggaaaaggatatacaggaaaagtacggagaaccaacaccagaagccttggttgagtcggcaatgcggcatgttgatatacttgatagcttgaactttcatcaattcaaggtgagcgtcaaggcgtcagatgtctttctggctgtcggtgcttaccgtttgctggcacagaaaatcgatcaaccattacatttgggtattaccgaagcggggggcgctcgtgcaggtgcggtgaaatcctcaattggtctggggcttctgttgtctgaagggattggtgatacattacgtatttcgctggcggctgatccggtggaagaagttaaagtcggttttgatatccttaaggcattacgtatccgctcaagggggatcaattttattgcctgcccgacttgctcccgtcaggaattcgacgtcatcggtaccgtgaatgcgcttgaacagcgccttgaggatttgattacgccgatggatgtctccattattggctgtgtcgtgaatggtcccggggaagctgaagtttcaacactcggtgtgactggtgcaaaaaataaaagcggtttttatgaagatggcatccgtcagaaagagcgttttgacaacaataatttaattgatcaacttgaagcgaagatccgtgccaaggccacgatccttgatgcaagtaaccggattaacatcaatcagcttgatgaataatatacctgatactggctcatgctatcatgagccagtattgtttctgattgctgattgaaccccgcgagctttcgcttttataatcgacgctattgtagaaatattaataagagataaaacgtggcaaaaaatatcccagctattcgtggcatgaacgattgccttcctgctgaaaccgccatctggcaacgtgttgaatctacggttaagcgtgtgctggcaggttatggtttcagtgaaatcagaacaccgattgtagagcagaccccgttatttaaacgcgcaattggcgaagtcaccgatgtgatcgaaaaagaaatgtacacatttgacgaccgcaatggggaaagcctggccctgcgcccagaaaataccgcaggttgtgtccgcgctggtattcagcatggtctgctgtacaatcaggaacagcgcttgtggtacattgggccaatgttccgctacgaacgcccacaaaaaggccgctaccgtcaattccatcagttgggtgctgaagtttttggcctgcaagggccggatattgacgctgaaatgattttaatgactgctcgctggtggcgtgaactgggcatcgctgaacacgttacacttgaattaaactccattggttcactggacgcccgtgcgaattaccgtgaagctttggtggcgttccttgaacagcataaagaaacgctggacgaagactgtcagcgccgtatgtataccaacccgctgcgtgtactggattccaaaaatcctgaaattcaggttcttcttaatgatgcgccggcactgtttgactatcttgataccgaatcaaaagaacattttgatggggtgtgccggattctggatagtgcaggtatcaagtatcacctcaatcagcgtctggttcgtggccttgattattacaatcgtactgtctttgaatgggtaacttctgcattgggtgcacagggaacagtctgtgcgggcggtcgttatgatggcctggttgagcaattgggtgggaaatctacaccagcagtaggctttgcaatgggaatggaacgtatggttctgttagttcaggaagtcaatcctgagttcgttgcagatctggctgttgcggatgtttatctctcctcctttggtgaaggtagtcagcaggcggcattgaatctggcggagcagatccgtgatgagttgcctgaattacgcttgatgaccaatcatggtggtggcaacttcaagaaacagttggggcgtgcagataagcatggtgccaaagttgccctgatccttggagaagatgaaattcgtgcaggtaatatcactgtgaaagatttacgtaatggtgaacaagaaacgttgtcacaacaagcgattgcagcacgtttgagcgaactgttaggctaaggagagactctgtggaagtctataccactgaaactgaacaaattgatgtgataaagcgtttttttgccaacaacggtaaatatcttgctgttggcttggtgctgggcattggggtgctggctggctggcattactggcagtctcatcagacaaaccagttgcaggatactgcagcgacgtttgaaaaattgaataaatcattggaatcgggctcgaaagaaagtgttgttgccacagaaaaattcgctaatgaaacgaataatatctatggtgtcatggccgatatggatctggcaaagcgtgcagttgagcagaatgatttggctcaggcagaaaagcgcttgttggccgcctctggcaaagccaaagacgagaatatgcaggctttggccagtattcgtctggctcgagttcaattcgcagaagataaaacggatgctgcactgaaaacgctggaacaggtcaaggggaaaggttggttggtagctgttgagaacattcgtggtgatattctgacgaaaaaaggggatattgcgggtgcgcgtgcagcctattccagggggctggaagctgatggcccacagtctttgaaaagtagtattcaaattaaacttaataatttatccagctaagggagctaactttaatgcaactgcgaaaaacactcttggttgggctggttgcttctattctgttggctggttgttcaagcgaacaggatacgctagcaatgtcaccgctgccgaaggttgaaaatcaattcaatccccgtgtaatttgggataaatcagtcggaagcggtgttgggcaatattattctcacttgtcacctgtctggcaaggttcaacggtttatgttgctgatcgcaccggtgtcgttaaagcacttgaagtagatacgggtaaagagctgtgggccacagacctgtcggaaaaagccggttttctgtcatcccgtttacctgcattgctttctggtggtttgaccgtgtcaggtgagcgcctgtatgtcggtacagaacaggcaaaagtcatcgcactggatactactaacggtaaagttgaatgggaatcaagcgttgcgggtgaagcgttgtcacgtcccgtggtgagtgatggccttgtgttaatccacacgggtaacggtttgttgcaggcattgaacgaaaccaatggttccgctgtctggtcagtcaatatggatacaccttcattgtcagtccgtggtgaatcggctccagccgtagcctatggtgctgcgattgttggtggtgataatggccgtattagtgcggttctgatgtcacaagggcaattgatttggcagcagcgtattgctcagatgacaggttcaactgaaatcggccgcctgaatgatgttgatatgactccggtcatttctaataatattatttatgccattgcttataatggcaatttggtggcaatggatatgcgttccggccagcttatctggaaacgtgatatcggttctgtgaatgatatggttgtgacggatgaccatattttcattgttgaccaaaacgaccgtattctgtccctgcgtaaaaatgacggggtaacactgtggacgcaaagcgatttattgcaccgtaacctgacagcaccggaaatgtacaatggttatctggttgctggcgattctgaaggttatctacattggttgaatatggctgatggcaaatttgtggctcagcataaagttgatggttctggcttgctgagtcgcccggttgttgccggagataagctgatggtacaggcgaaggacggtaaggtttacctgtatacgcgctaatttcatcacgtgttttaacacaacacgaaataacacggctcctgtgctgacagtaacaggagccgtttcgtctttttagtatctgttgtagtggagcttcgagtggatcactttcagcaggatatcgatttacatctagttatgaggcatcaaaaaaatgatacctgttgttgcgctggttgggcgcccgaatgtcggaaaatccaccttatttaaccgtttaacccgaacccgagatgcgttggtagcggatttccctggtttgacccgtgatcgtaaatatggacgggcagaggttgaagggcaggaattcatcatcattgataccggtggtatcgatggtacagaagatggcgtagaaacgcatatggctgcgcaatctttgatggcaattgaagaagcggatatcgtcctgtttatggtcgatgccagatccggaatgatgccagccgatcatgcgattgcaaaacatctgcgtagccgtgaaaaagccacctttttggtagcgaataaaaccgatggtattgataccgatactgctatccctgagttctactcactggggttgggggatatatattccatcgccgcttcccacggccgtggtgtgacacaactgatcgagcatgtgttgttgccattctccgaaaaagagaaaacggaagaagttgaattaacggaagaagaagccaatgcagcttattggtctgaaatagagcaggctgaattggaggctgctgaagaggaagagaaggaggccgtttttgatcctactactttgccgctgaaattggcgattgttggtcgtccaaacgtgggtaaatccacattgactaaccgtattctgggcgaagagcgagtcgttgtttatgacatgccgggaactacccgagacagtatttatattccaatggagcgtgatggccgcgaatatatcctgattgatacagcaggggttcgtaaacgtggcaaagtaaccgaaacggttgagaaattttctgttatcaaaacgcttcaggccattgaagatgctaatgttgttttgctgatagttgatgcccgtgaaggggtttctgatcaggatctctctctgctcggttttattctcaatagtgggcgctctttggttattgcggtcaacaagtgggatggcatgagccaggaagacagagatcacgttaaggatatgctggatttgcgtctcggttttgtcgattttgctcgtgttcactttatttctgcgctgcatggcagtggggttggcaacttatttgactcgattctggaagcttacgaaagtgctacccatcgcgttagtacttccatgctgactcgtatcatgcatatggcagaagaagatcaccagccgccgatgatacgtgggcgcagagttaaaatgaaatatgcccacgcagggggatataacccacctatcgtggtgatccacggcaatcaggtgacaaatttgcctgattcttataaacgttacttgatgaactacttccgtcgctctttaaaagtcatgggaacacctattcgcattcaatttaaagaagggactaacccttatgcggataagaagaatactttgacggccacacagcttcgtaaacgtaaacgtttaatgtcgcatttgaaaaagcgttaaatattaaaataaatatgcatgaaataaagggctatttttagccctttattgttactgatatatatgatttacttagctatcttattaatttatttttgattctttttaaggtaataaaataatttcattactactgtctgaatggaaatttgttatcaatttacagccaaaactaattcaatttattaatgtataattattttttattattgcaacttgtcaggtttatttatctttttattatcagttgataaattatcttccggatgtaacgcctcctcttctttagctgaatttttcattgtattattaacatgttttaacgtccttatcacacattccctgtcattttcatcacaattattggcaatatattccagtagatagggaggaatgatattgtacttgtctattttactattacgcataatgttaaccagtttgtgtgttgttatatgtatctgttttagggtacttagatattagctaaaataatcatattagtcactggtagaaatgtaaatttattgtatttctatgtttttttattaaaatcaatgtattaatgcaagggtagtctaaatctaaaatatattgagctataaatattaagaaagggctatccttagccctttcttgtttaatatcaattattctgtttaataataattgatattgtattaatgattatattgatgttggtgttaattattttgttggaatgataatcccaactttgctccagcaattattcacgatatctgaaatttctttatcaaataatttttcagcgtttttaatggttaattctgcaaaatcatcaaaattggcatctgaagataaacgttcgtcgagtaacgtttcataccagattttacctgcacgttcccatgaataaccaccgagctccactgccagtagataaaaggctctgttaggaataccagaatatatatgaactccgccattgtcctttgtgaacggtagctctttatattgatccatatgaccaacttgcttgtctccggaaaaagccgttcccggatttacaaatgtacgtaaggcaacatccggtttattgtctggattaaacttagatccaagtagtccttttccgataagccaatcggattcactggctttttgtttatcgaagtactgttttaccataataccaaacacatctgagatggattcatttaacgcgccagattgataagcataaaaaagtcgtgcttcactctcaatcacaccatgcgttaattcatgtgctataacatcaatggcagaagtgaagcgattgaaatattttccacttttatctccatcgccaaaaaccatctgttttctagaccaaaatgcattcatgtagttttgaccataatgtacagttgcgactagcttgatgcctttgttatcgagtgaattacggccaaaaacttttttgtagaattcatgggtcttaccgagatactcataggcttcattgacagcaacatcctcactctcaggcataccttcgcgtcgtgctaccctatcacctggaaatatctcttcatattctgcatcgtagatagttcgatttaattcatcatcaaattctacttcattttcctgttgtaaaagctcttctccaatagagatattcattaagtgatgaacatgatctaatgtttttagtacataatgattagagcactcatcacaatcgctagagatgtgttctaaaacaaatggagggattaagctatatctgttgatttcattatttttcatgattatcccctttattattagatgttatgtttgtgttttttgggcccgtttgaatactaactataatagttgagttagtcactagggtaaatattgattttttatgtcagggaattgccaatgaaaaataataaattaaattattagtgttctgatatagaacaggaatataggtgttatccgatattcctgattttaattatcatatccaatctttttttattagaaaggaggtgtaaaattcagcttctggagagtttggctcaggagaatgattatattcccaacgtactaatggcggcatggacattaatattgattcagtgcgtccaccgctttgcaggccaaataatgttcctctgtcccaaactaaattaaattcaacgtaacggccacgtcgatataattggaattctctttcgcgttctccccagtttatatttttccttctttctacaataggcaaatacgcggccaaaaaaccattaccgacagcttgcgtaaagttaaaacaagtttcaaaatcaggggtatttaagtcgtcataaaataatccaccaattccgcgtggttcattacggtgttttataaagaaataatcatcacaccattttttatattcaggataaacattgttgccaaaaggttggcataatgttttggcgacggtatgccaatgaatggcatcttctttgaagccgtaataaggagtgagatcaaaaccaccaccaaaccaccatactggtgcttccccttctttttccgcaataaaaaagcgaacattggcatgactagtcggaatatagggattgagtgggtggataacaagggaaacgcccagtgcttgatagctacgacctgctaattcaggacggtgggcgcttgctgatggaggaagtgaagccccagtgatatgggagaaattcacgccagcctgttcaaaaacgttgcctgcctttaatacgcgactgcgaccaccaccgccttcttcccgctgccagcactcttccataaaattggagtgaccatcaagtcgctcaagttgtttgcagatttcatcctgtaatgagaggaaaaaattcttaacttgggatatgttaggtatattcatgattaaagcacaacctattgataatgtttagataaatatcattttttaacgagtttatttttgtctatttatgaagttgtttatacataaaacgctgaacaaacctataaacaaaacataagataagaacaatgtggaagaaaagaaagcataagaatgaatttgagatcaataaaacaaggtcagtacgctaagcgttctgaccttgtgagaggttgcaatgcacttcgccaagaaatctattgaggtgacaataacgaatgttactgttagtgagaagataccccgctacggctaaagacgcaccatttttacagttgatcgactatctccagtaaatcactgcgctggtcggcagtcagactctccagtctccggtcatccaggatgagcaactgactgcgactcagtttgctcaacaacccaaccggggataaagtcattctattcctttaccaaagtgtccgaatttattaaagcacaacagaaagttgcgggtttaattgttagctcagaattaggcggctcttactatgtaattgaatgctatgttgcggggtcgggtttctgttcctgttgaattagcaaccgcattatccatgtaaccataaccacccgaacccattcctatagcaatacccaatccccgaggatcagctccgtagttaatgttttcctggatgctattgaaaatgcggttccctgtacctaaattctcggctccagcagttgagctggaccacatgcggttaattctgtggctatgtggagcgatatctgctgcttgattagaaagcagatgtcgcccagtgtccactcctcgcccattatcccagccgcgaataaactcccctcgcaaatcgggtagtacaccagagggataagcaagggcaagtttcggatatcttactatatcaaacgagttaccgttacatatcagccagccttctggcggtgtttctgtaggccagggaacaggaacgccgacaggtaaggacaacccttccattaatggctctattccaaggttcttaacaaactcttttttatcaggtatatcagctccattccgatcttttgctaaacgagtattggcattgtcattcgcattactggcattctgattagctgtattagccaaattatacgttactttcactgcctttggtgttgccgccatagtttcactatcactaccgacatcattactcagaacaacaaaacctttatcctgtagtgttgcattggggtgattacggctttgggcgtgttcttcaatagattcttttacataattacgactgggtaccacgaaaagatcacagtcacaagggcatggtgtctcaggcttattattttgaatactcatacttaatccctcatttaatcaacaatacacattgctaaataacatgaaggcgggctacttctccgccagtgaacatcaataaaataggttcatcaatactggagaggacgttttgactaagttcggttggtgaattgtatgtttgtgatgtcaggatgacacgaaatgacggtttggaaattaataaaatccatatcccactgataaaacttagagtttaaaggagataattgtcccctttaacttaactcctttttgcttgagataagacatgacgttctgtttgcctatttaatcaccactctttttgattaccaataatgagaaattgaaagtatatttaacgcattggtaaatattggcagaatgcaaggtgagagccagtgtctaaaagtgattacgtggagaataacatgaagtatcgtctgagcggggtggctcttacagcagtattattggtgggatgtgccagttcgaattcggtggaacaagggcgttctgacccgctggagggcttcaaccgtgccatgttcaactttaattatgatgttctcgatccttatcttctgagacccgttgctgtagtttggcgagattatgtgccgatgccagcacgaaatggcattggtaacttcgtgagtaaccttgaagagccggccagtatggtcaacagtattctgcgcggtgatctccataatggcgcgaagcatttcaaccgattttttttgaatacccttctgggaatgggcgggttgattgatgtcgcttcaatggcgaatccgaagctggcaaaagaagatccaatgcgttttggtagtacgttggggtattacaatgttggttatggtccttatgttgttttgcctggttatggcaatttcactctgcgtgacgatggagggaatgtcgcggatatgacttaccccgtattaagctatctcacaccttggatgtccgtaggaaaatgggtatttggaggtattgaaacccgcgcacgtttgttggattccgatggcctattgaaaaactcttccgatccatatttgatgatgcgtgaagcgtacttccagcgccatgattttatggtcaatggaggcaagcttttgccagaacaaaaccctaatgcgacggtgattcaggatgaattggattccattgattaatgatggaaccatgatcaaaaaaggatagcacccgctatccttttttcgatttcagtattcggttagaacgtgtagttaaagttcataccgtacaaccatgcagttcctttggaatcgaactcatagggttgactaaaaggtccttgttgagcatcttctggtaatttttcgctaacacgtactttctttccacgcatgtaggaaacaccgatatccacagaagcgtctttattgaatgcgtaagtgcttcccacacttaaccagaaacgatcctgatctggaatggagatagagcggtttttggcgggcacagggctttcatcgaaggcgataccggtacggaatgtccagttgtcatcatagtagtaagttgtacccagagagacgcggtaagcattacggaaattttcatctttttggaacagcgtcttaccgttgtctttattcttacctctcaactccttaaattcactccagccagtatagaggaagctatagtgaatggcccactgaggtgcgacgcggttatagccggagacttcccacatatcaggtaaattcagatccagcgtacctttaattgtattgccgccagtgccacggggttctggtaagtcattgctgaaatcgccatctttaaacttcactttgacttttgaacggtaagtcaggctataacggttattctcatcatactgatacaaaatgcctgcattccagccatagccccaatctttgccttctaaacgggaagcttcataggttgctggaataggtgctcgtgggttataaggaccaacttcacccatgtgacgaacaattgtggcatctgcatagacggcgtttacgcccaaaccaaagctaaattgatcattaagcttatatgcactgctcagattcaggttaacggttttaagtgaggttttgcctccaaccaagccagcagcatagttattactgaattcggttgctaagccaaaattggaagtcgctgatgcaccaaggaaccactgatcattgatcggtgtaataaaatgtaagtttggtatccatgcatgtggggcaatatttttagcatcagtgctgtttttaacgccagttcctagttgaggaactggagatctacccgtgatatcaacatttggatttacataaaccaaaccgctggaaaatgatgggcgatcaaatagggtcatggctgcggggttacgactaccctcagacgcgttgtctgcaacgacacctgctccagaaaaagcacgaccgagtcctgatgatgaatactcatttaattgaaaaccggcagcactagcgttggatgaaatgactgcaaccgccactgctaatgctgaacgtgtaaacaggtttttttggctcataaccaaaacctcattatttaattattatttaacatgctactcaagtagctgagagcgcgggattgtagagtcggtttatcataatgacaaatcagaccagtgcaggaagtataggcctgacattagaagatgttgcaagaatgtttttaagatatgttcaaaatgattgccgaaatgggacgaacttaacaaaaaacagtcagcgcatgttaacgaattgtgatggctagtttgttagcgcgatgagatcaataaataatgaaataagtgatgccaaacagcgtaaacgctggttatcgggggttggaacaacgtaaaatcatcgataggctttcatcgcaggagaaaaaaatgcctgatacaattaaacgttgtaatgcggaagaaaccgctgcttgctgttgtgttgatgtcggtaccatcattgacaatgaaaactgcactgcctcttaccagagtgtttttgccaataatcaggaagcggaaatgatgcttaatatattgactgtaaaggcaaaatcaggagagtcagagccatgcgtaataagccataaaatcgaagcagttgacgatggggtgaaactgactatagattttacgtttagctgtcaggctgaggctctgatttttcaattaggattacgctaattatcttcataaccgttttcctatcgcggtttgttgcttttgctcgcatttttcgtctattcctgtttgctattttccaacattgcgttaacaatgctccatcaggtctgacctcttgtgaggtgagcaaatgtttttaatcaatcaattgatttaattaataattattgtcaggagttgctatgggtcgttcttcaacaaaagtggcacagcaaaaggagcgtgttgctattgtcagtgggttgcgccttccttttgcgaaacaggcaacgagttaccatggtatcccagctgtcgatttgggaaaagccgttgtcagtgaactggtcatcagaagcggattgtcgccagagaagatcgaccaactggtgtttggacaagtcgttcaaatgccggaagcaccaaatatcgcaagggaaattgtattaggcgcaggattaagtgttagcactgatgcttatagtgtttcccgtgcctgtgcaaccagctttcaggcgattgcgaatgtagctgaaagcattatggctggcacagtgaatgtaggcattgccggcggcgctgattcctcatctgtgttaccgattggggtaacaaaatcactggctcgcactttggtcgatatgaacaaagccaagagtttgtcacagcgcttaaaattaatcagtcgattgaaattgcgggatttactgccagtatctcctgcggttgctgaatattccaccggattgaggatgggcgatacggcggaacaaatggctaaaacctaccatatcagccgcgaagagcaggataagttggcacaccgttcccatatactggcagctaaagcctggcagcagggttgtttgaatgaggaagtggtagcggcgcattttccgccataccgagacacattgacagaagataataacatccgaaaaaattcagttctcacgtcttactccaaattgcggccggcctttgatcgtaagtacggaaccgtaaccgcggcgaatagtactccgttgactgatggtgctgccgcagtcatgttaatgcgcgaatcggtcgccaaagagcttggtatgactccgctgggttatttgcgtagttatgcgttttctgcgattgatgtctggcaggatatgctgttggggccatcctatgcgacgccgattgcgctggagcgggcgggtatcactttgaatgaactctcacttattgatatgcatgaagcgtttgccgctcaaacactggcgaacttgaaaatgtttgccagtgaaaagtttgcgcgtgaaaaactggggcgctctcaggcagtgggtgacgtagatatggataaattcaacgtattaggtggttcaatagcttatggtcatccatttgccgcgacaggtgccagaatggtcacccagacattgaacgaattgcgtcgtcgtggtggcgggtttgggctgacgacagcctgtgccgcaggtggattgggtgtagcgatggtattggaggtagaataatggctcagggcgaaaaagaaaccattatgtcagagacacaaccgaagcaatcggtattcaatttttcggtcagagatgacaaggttggtgtgattactattgatgtaccaggtgaaaaagtaaacacactgaaagctgaatttgttgagcaatttctgacagtctttgagaaggcacaacaggcttccggcttgaaagggttggtaatcgtgtctggtaagcctgatacttttatcgctggtgccgacatcacgatgatagcaggctgccaaaccgaagaagatgcgacggaactggctgaaaaaggtcagagattatttgctcagattgccaattatcctttacctgtagttgccgccattcacggtgcgtgtttggggggagggctggagctggccttggcctgtcatatacgtgtctgttctctggatgataaaactcgtcttggtttgccggaggttcagcttggattattgccgggctctggaggaactcagcgattacctcgcctgataggtgtcagcgcagcactggacataatattgactggccgacagctcaaggctaagcaggcacagcgtctgggtgtggtggatgatgcagttcccttggatattttgctggatgtggctgttcagtatgttaagaaaggcacccccaagcgtaagccattggcatggtctcagcgtattttggcgagcgctctgggcaggccattgttgttccatatggttcatcaaaaaacgcgtgcgaaaacccatgggcattatcctgcaccagagctgattattaatgtcgttcgcacaggattggaaaaggggcttaaaaaaggctttcaggcagaagccaaggcgtttggtgaactggcaatgtcaccggaatcggcagccttacgcagcttattttttgcctcaacgtcgctaaaaaatgaaaccggctcgtcggaacagcctgccgagatcaagtctgtgggaattttgggtggcggtttgatggggggcggtattgccaacgtgaccatgacacgcgggaatttgcctgttcgtatcaaagacatcaatcagaacggcatcaatcaggctttgaaatatacctgggatatcctttccaagcgagtaaaacagcgtcgtttgaaatcaagcgatcgttctcgccagatggctttgatttcgggaaccacagattacagtggcttcaggcaggtcgatattgtggttgaagccgtatttgaagatttggcgctgaaacgaaaaatggttgcagaagttgaagaacattcgaaacctgaaactatttttgcttcgaatacttcatcgttgccaatttgccagatcgctgaaatagcctctcgaccagagaaagtgattggcctccactatttcagtcccgttgataaaatgccattggtggaagttattccacatacgggaacaaatgaaaaaacgattgccaccgcagtcgcactagccaaaaaacagggaaaaacggctattgtcgtgggtgataaagccgggttctatgttaaccggattttgtccccttacattaatgaagcgggttattgtctggcggaaggtgaaccgatcgatcatatcgataaggcactggtagattttggtttcccgattgggcccattaatttgctggatgaagtcggcattgatgttggtacaaaaattattcctattctggtggcgcaattggggagcagatttaccgcaccgggcttcttggatgcagttttaaaagataaccgaaaaggtaaaaagaatggccgtggtttctattcatatggcgctaaaaagagcaaattctggccttttggtaacaaaaccaaagaggtggatgtctcgatttattccctgttaaaaattaagccacatgcaaaaatgcaaccatcagacattgcccagcgttgcatgatgctcatgttgaatgaagcagttcgctgtttagatgaaggtattatcagaagcccccgtgatggtgatattggtgcggtatttggcatcggtttccctccattcctgggggggccattccgttatatcgataggcttggcagcgataaagttgtggcaattttacatcgtctggaacagcagtacggagagagatttacgccctgtgagtatttagttcagatggctgaacagaaaaagaaattctacaaataaataacagtttcattcgcaaaatcagttatatcggctcttgtcatcggagccgatttttttatgaaaaataattgatatttttttgattattttaacccactgaatagcaggagataatgatattgagacaatcagatataaatcatttttagtcattttatttgtttttgttttagggcagaatgccagttagttctaaaagattatcttgataatattacttggatttcattattaatgccgtaaaccaatggcttgtctcataaatatttaattatatattggattaagacaggttctgaaattaactaaacggtggattatgtacgtttttattatgcgccacggtgatgctgccgtaaattcgatcagcgatgtaacacgggagctgactccccgtgggcagcaagaatcacaggaaatggcctgctggcttacgcaacaagagcctgatgttgattgtatcttagtcagcccttatatccgggcaaagcagactttaaaggtggttcgtgaaaacttaacgttgcccggcaatgaggaagagctggcggagttgacaccgtcgggagatgtcgcattggtggcgagttatttgcaagttttggcaacgcaaaagtacaacgctgtattggtggtttctcatttacccttagtgggatatttagtttctgagctttgccctgaacaaacgccacctatgttttcgacttccagtattgcctgtgtggaattagatcctcaaacagagaaaggtcgcctgttatggcaaacctctccggcgcagttagcagcaaaagattaacttcatccagaggataaattaacgctccatgagttcattcatttctatcaaaatgagcagtgcagcgttacctccccactctttgggggcttgatggaaagcaataatatcagggtgctgggcaagccataaaggcgtttgctgtttaagaatatgtttaccgtgaccatgcatgacgcaggcgcaataaatgtgttcacgacggcaggccgcaatcagagcgccaatttcttgcttggcctgtagttgggttaatccatgtaagtccagaaaaagctcaggggaataatcaccacgacgtagcttcttcaattcataatgattggcaccttctcgaatatagcgggttgggccttccatatccaaattaggttggaactcatcggaaaaatagtaactggcatcgacttgttcttgcatcaagcgttcaggtgcaatatagctcattttttttctttgaggggagtgcaaaacggtgtcttgaacgatgcggcgggctcccgtgacagacgttcgaaatagactgatatcttcttcactcatcaggtttttcttcttcattactctctaattcactgacaaattttggtaattgtacccgattttttgcgattttgcttagaagctattgcataagattaatatgtgcactcaggtgactgtgtaaattgtaaaatattcgcatcgtggcggatagcttctgaaaaattcatgatattcatccctgcccataaaattatttgacaatcttggctggttataaaataaatgtatatacaacataaaggttgataccaacaagaaaaataacaggacgatacaatgcctattgagctgaaagatactgacgttatttggcgtaatgccagacttgccacaatgaaccctacaatcaacaacattgatggcaaacatcattatggcatgctggagcagcatgatctgatcgttcggggtgaaaaaatattggcgattattccgacggctagcatgccaactcaccattgtcacattattgatgtggaacagcggctgatcacccccggattaattgactgccatactcatttggtttttggtggcaatcgggcatcagagtgggagcagcgtctcaatggcgcttcttatgaggaaatcagtgctaaaggaggaggaattaattctacggtcaatgcgacccgaaacaattccgcgcaacaattggaagtggccgcccagaagcgactcaatgctttgatcgctgaaggggtaacgacgattgagatgaaatcaggttatgggctggatctggtaaatgaagaaaaacagttgaatgtcgttcaggcactggcgcagaaaaatgccatcgaaatcagccccacattactctctgctcatgccgttccacctgaatataaacacaactctgatgcttatatcgatttaatttgtgattccattcttcctacactgtggcaaaaacaattatttgaatctgtagatgttttttgcgaaaccgtcggttttaatctcgaccagaccaaacgtgtgtttgatgcggcacaacgcctgaatattcctgtaaaaggccatgttgagcaattgtctaacatgggaggcagtgaattggttgctgattatcaaggctggtcggttgatcacattgaatatctggatgaaaaaggtattgaagccattagtcgtagcggtagtgtggccgtgttactgcccggcgcattttacttccttaaagagaaaaaactcccccctatttcgctattgcgtcaataccgagtgccgatggcaatatcgacagatttcaatccgggtaccagtccttttgcttctttgcgtctgattatgaatatggcctgcgtgcaatttgggtttaccccagaagaagcatggcagggcgtaaccattcatgccgcccgtgcattggggagagctgaaagccacggccagttggcggaaggttatatggcagattttattgtctgggatgccgagaacccggtggatatcttatatgaacttggacgtaacccactgattcatcgtatctatcgtggtgaaattacacacaatgttcaataatggtgagagaaacaacatgaaattatggcacccgacatcagaaaacatttggcaaggacgtaatgatctcgcagaagcggataatgccctgcgtgtgttccagacaataaaacaacccgccaatttttctccggaagaatttcctcaccatattgcgttattgggatttgagtgtgatgaaggcgttaaacttaaccatggtcggccgggagcgaaattagggccggaatatctgcgtcagtcattggccaatatggccagttatgatggtcatgagcggctggtggatttgggaaatattcgcgctgatcctgaaaaattggctgaagcacagaacgtgctgagtgaagctgtctatgagtgtcaacaccagaacatgcgaacactcatttttggcggtgggcatgaaacggcatttgctcatggaatgggaatttaccgcgcgtttccgacacaacgcgtaggtattattaattttgatgcgcatctggatctgcgtaattcggcgcaacctacatcaggaactcctttccggcagcttgccgattattgccagcagcatcagcgtccgttcaattacacttgtattggagccagtttggcatcaaatactcaggctttgttggacgaagccaatcatcttgatgtcaccatcatttgggatactcaatgtattgagtcgatgctggataaagtaaaggaacaaattcaaaatgtgattaatcaagttgatataatttatatgaccatcgatttggatgtactgccaatctggcaaatgccgtcggtttctgctcccgctgctctgggagtgccgttagagcgtttgttgccgttaattcaactcatctgccaaagcaaaaagttacaggctgtcgatttggttgagcttaatcctttgtatgacattcaaggaatgggaggcaaagcagcggctcgccttacgtggcaattggtgcattggtggaatgggtagctaatgagaagggatttattgtgacagtcgatttatcagatacatttgtcaaacctgtgcctttgtatgcaaaagttaagcaggcgattattgaaaaaatatatacaggagaatggaaaccccatgatcgggttccctcagaatctgaattggttaaacagtttagctgtagccgcatgacggcaaacagggcgttgcgggagttgatggcagaaggttttctatttcgtttgcaaggagtgggatcgtttgtgtctgaacccaaaggacagtccgctctgtttgaaattcacagtattgccgatgagattgcggaacgttctaaccagcatagttgtaaggtactgaaacttgcagaagtgaatgccaatataacacaggcggcagaattgggaattgtggctggtacggcaatctaccattcgattattgtgcactatgaaaatgatgtccctgtgcagattgaaaatcgttatgtcaacgctcaggctgtgccggcgtatctgcgacaagatttcaaccagcaaactacccacgattacttatcaatggtggctcccctgacggaaggggagcatattgttgaagcggttgcgggagatgtccgttcttgtcggttgctgcaaattgaggcagatacgccttgtcttttaattagccgccgaacatggtcgaaagaacatattgtctcaagtgctaaattattatttcccgggcatcgatataaattgaaagggcatttcagctcatgatttgcataaaaaaatctccctttgtttttaatatagggagattttttcacaaacaattgtgaccatcatgtaaatccgatgtgatgtaaaacacaaaaataataaaaacattcacctgccaactgaagaataaatcattatcatcttattgatatctagcataaaagataccatcctccaaattattgactttatctgtgtcacatttttttctattgaatctacatgtatatacaactatacaattaacaaactttataacgatgaaaaggaaaaaaccgtgacgatgcaaaataataaattcagcaacgaggtcatccgtgcccccagaggaacgcagctcacagcaaaaagttggttaacggaagccccgctccgcatgctcatgaataatctcgatcctgatgtggctgaaaatcctcatgaactggtcgtttatggagggataggccgtgccgccagaaattgggaatgttatgaaaaaattgtggaaaccctgaaaaatttagaaaataacgaaacattactggtgcagtcaggtaagccagtgggtgtttttaaaactcatgaaaacgcaccgcgtgtattgattgcaaactcgaatctggttccgcattgggcaacgtgggaacattttaacgaactggatgctaaagggctggcaatgtatggtcagatgacggcaggtagttggatttatattggcagtcagggcattgtgcaaggcacttacgaaacgtttgttgaagcgggacgccagcactataacggtgatttgaccggacgctgggtactgactgcgggtttgggcggtatggggggagcacagccgctggcggcaacgttggcaggtgtttcgtcactgaatattgagtgtcagcaaagtcgcattgatttccgtctgcgtacccaatacgtcgatgaacaggcaaccgatctggatgatgcgttggcgcgtatcaagcgatatacccaagaaggtaaggcagtatcggtggcattgtgtggtaatgcggcagaaattgtccctgagttggtacgtcgtggcgttcgtccggacatggtgacggatcaaactagtgcacatgatccactgcatggctatttgccggcaggctggacatgggaagaatattgtcgccgtgccgaaactgagccagaagtcgtgattcaagccgcgaaagcatcgatggcagtacacgtggaagcgatgctggctttccagaaacagggtgttcctactttcgattatggtaacaatatccgtcaaatggcgaaagaaatgggtgttgagcatgcctttgatttcccgggttttgttcctgcttatattcgtcctcttttttgtcggggaattgggcctttccgttgggtcgcgctctccggtgaccctgaagacatttacaaaactgatgctaaagttaaagagttactgtcagatgatgaacacctgcatcgctggctggatatggcgcgggaacgcatcagcttccagggtttacctgcccgtatttgttgggttggcttgggagaccgcgctaaattgggattggcattcaatgaaatggtacgtagcggcgaactttcagcaccgctcgtgattgggcgtgaccatttggattccggctccgtggcgagtcccaaccgtgaaaccgaatccatgaaggacggttctgatgccgtttcagattggccattgctgaatgccttattaaatacggccagtggtgcgacatgggtttccctgcatcatgggggcggagttggtatggggttctcacagcattccggtatggtgattgtctgtgatggcacggatgaagccgcagaacgtattgctcgtgtgttgcacaatgaccctgcaactggtgtcatgcgtcatgctgatgcgggttatgaacaggccatccagtgtgccaaagagagggacttaaacctgccgatgcttgatacaaaatcatcagacacaaaaaccgtcgaaacaaaataaggagcgtcattaatatgaaacacattactattcatcccggaaaaatgacgcttgaagagttacgccacatttatcagtatccggtgcaaattaccttagatgagcaatgcgttcctgccattgaacgcagcgttgattgtgttaaccgtattatcaatgaaaacagaacagcctatggtatcaacacgggttttggcctgctggcgagtactcggattgccgagcaggatttagaagaactgcaacgttcccttgtgttgtcacatgctgctggtgtcggtgagcctttgccggatgagattgtccggttgattatggtattgaaaatcaatagccttgcccgtggttattccggtattcgtttagacgtcattcaagcgttgatcactttggttaatgcagaagtttatccctgtattccgagcaaaggttctgtgggcgcttcgggagatttggctccactggcgcatatgagcctgttattgctgggcgagagtaaagcgcgttaccgtggggaatggctgccagctaaagacgccttggagaaggcaaatcttaaaccgattcggttggcggcaaaagaaggtctggcgttgcttaatggcacacaaacctctactgcttttgccttgaaaggactttttgcagcagaagacttacttgcctcagcagtgatttgtggcgcgatgtctgttgaagcggcactgggttctcgtaaaccatttgatgcgcgtatccatgaagcacgaggccagcaggggcaaatcgatgtagctgctctgtatcgtctggtattggaagaacaaagtggtctatctgaatctcataaaaactgtccgaaagttcaagacccttattcattgcgttgccagccacaagtaatgggcgcttgccttacacagatccgtcatgctgccgacgtgattatgactgaagccaatgcggtttctgataatccgttggtctttaccgaccaagatgaagtgatctctggcggtaacttccatgctgaacctgttgctatggcatcggataatctggctattgcactggcggaaataggtgcactgtcagaacgccgtatctctttgctgatggatagcaacatgtcccagttaccgccgttcctcgtcaataacagcggggtgaactccggctttatgattgctcaggtgacagcggcagcgttggcgagtgaaaacaaagcattggcgcatccttccagcgttgacagcttgccgacatcagcgaatcaggaagaccatgtatctatggctccggcggcaggtcgtcgtttatgggaaatggctgacaacgtgcggggtattttagcgattgagtggctgactgcctgtcagggcatggatttccgtgacggattgaagagcagcccgatactggaaaaagcccgtcatatcctccgtaataaagtcgcttattacgataaagatcgcttttttgcaccagatattgacgcagctatccaactgttgattgaacaacaactttcagcactgctacctaccggaaaattattgataaattaaacataaataagtcgtctaaggccggtttctgcccggccttatcgttgtatttatctttcatatctaataataaagacacaaggataaatcatgcaaaacacttcacaactcaagcgaggcttgagcgttcgccacattcggtttatggcgttggggtcagcaatcgggactgggcttttctatggttcagcagaagccattaaagccgcgggtcctgcggtattattggcatatgccattggtggggcggccgttttcatggtcatgcgggcattgggggagatggcggttcatcaccctgtggcgggttctttctctcattatgccagtcactacttagggccattggcaggttttctgacgggatggacttacgtatttgaaatgctggttgtctgccttgctgatatcaccgcatttggtctctatatgaaactctggtttccgcatgttgaccaatggatttgggtactcagcatcgtctttttcattggggcgataaatctgtgtaacgtcaaagtttttggtgaaatggagttctggctttctatcattaaagtcactgcaattgttgccatgattgtcggtggctttgtgatcatgatgtatggcttcggccaggaagcgggtcatgtcactggcctgtcaaacttgtgggaacatggcggatttatgccaaatggcattgcgggagtgattgcttcgtttacggtggtcatgtttgcattcggtggtatcgaagtaatcggtattacagccagtgaagcgaaaaatccagaaaaatccatcccccaggcaatcaacgctgttccattccgtattttgctgttttatgtactcactctgtttgtcctgatgtgtatctatccgtggaatcaaattggccaaaatggcagcccatttgtccagatattctcaagtctgggaatcgattctgcggctaatattctgaatgttgtcgtaattactgcggcgatttcagcgatcaacagtgatatcttcggctcaggacggatgatgtatggcatggcacaggagaaacaagcgccctcagccttcacgaaattaaccaaaaacggcgtaccgtggatcactgtgctggtgatgtcgtgtgtactgctaatcggtgtcgttttgaactacctgttacctgaaaaagtgtttgggatcattgcttccattgcgacatttgcaacggtgtgggtatggctgatgattttgttgtcacaattcatcatgcgccgaaaaataccggcggaagaggtcaaaaagttaaaattccctgttcccctttggcctgcagcacctattctgacgatttcattcatggcatttatcatcgtcgtattgggatatttccccagtacccgcatcgcgctgtacgtcgggatagcatggatagcattactcacccttagttatttcttgtgggtgaaaaagttgtgggtgaaaaaaacgagataacgcccaaatataccaccctgtgaatacagggtggttttcttaccctctccagaaaataattgcgctttattgaactctcccagtaggccattctatttgcttatttgcgtactctttctgtacaaactggctgtaacataggtactcactgagataggctcattattcactgacataattcccatgctcagatagctgatttgtgactgggatcatggcaaaataacgcgctaatacatttttgtggcttggagatgcttgtggataagatttttgtggatgaggccgtcgcggagctgcataccattctggatatgctgcgctggtcagccagccgttttaatgccgccaatatctattacggtcatgggacggacaattcgtgggatgaggctttgcagttggttctgccaacactgcacctgcctctggacgttcctgaatccatgatggcagctcgtctgacctcaaccgagcgtcattgtattgtggaacgtgttctgcgccgtattaatgaacgtattccggttgcctacctgactaaccgggcctggttctgcggtcatgaattttatgttgatgaacgtgtgctggttccccgctcaccgattggtgaattagttaacaaccaatttgcaggattgcttccacaggagccatctactattttggatctgtgtaccggaagtggctgtatcgcgattgcctgcgcacatgagttccctgaagccgaagttgatgccgttgacatttcaggtgatgcattggcagtgactgaacagaatattgaaaatcatgggcttttgaatcgcgttattcctatcctttctgatttattccgtgatatgccaccgatgaaatacgatctgattgtcactaatcctccttatgtggacgaagaagacatgaacgatctgcccgatgaattcctccgtgaacctgaattgggattggctgcgggagttgatgggttgatactggcttgtcgtattcttgcgaatgcgccggatttcctgaccgaagaaggggtgctgatctgtgaagtgggtaacagcatggtgcatctgattgatcaatatcctgacgtgccatttacatggctggagttcgaaaacggtggtgatggtgtctttatgctgacacgcgagcaattagtcgaacatcacgaatattttcgcctgtttaaagattaatattttttcatcatactcaatggataaggctgttcttgattaaattcaaggcaaataaaagtgccggaataagataggttttaatcattgagtgagttattgttaattaatctaatctttaacgcataattaattgatggcagggtaggaatggctggaaatagtattgggcaatttttccgtgttaccacattcggtgaatctcacggaattgcattgggatgtattgtcgatggcgttcctccaggaattgccattactgaagctgatctgcaaatcgatttggacaggcgacgtccgggaacctcccgttatacgacacagcgccgcgaacctgatcaagtccgtattctttcaggtgtctttgaaggagtaacaacgggcaccagcattggcctgatgattgaaaacaccgaccagcgttcacaagattacagtgcaattaaagatgtttttcgcccgggacatgctgattatacctacgaacaaaaatatgggctgcgtgattatcgcggaggcgggcgttcctctgcccgtgaaacagcgatgcgcgtcgcggctggcgcaattgctaaaaaatatctactggaaaaacacggtatccgaattcgtgcttgcctgactcagatgggggatattcattgcgaattgaaagattgggatctcgttgaacagaatccttttttctgccctgatgaaagtaaactgacccagcttgatgaattattgcgcaccctgaaaaaagaaggtgattctattggtgccaaagtgacccttgttgctgagaatgtgcctgtcggattgggtgagcctgtttttgaccgtctggatgcagatatcgcgcacgccttgatgagcattaatgcagtgaaaggcgttgaaatcggtgatggttttggtgttgtcaacttacgcggtagtgaaaaccgagacgaaattacctctcagggattcaccagtaatcatgctggcggcattctgggcgggatcagtagcagccagccgattatcgctcatatcgctctgaaaccgacgtccagtattatggtgtccggcaaaactattaatcgccagggtgaagaagtcgatatggtgacccgtggccgccacgatccttgtgtagggatacgtgctgtaccgattgcagaagcgatgatggcgattgtactgatggatcacttactgcgtcagcgggcgcaatgtgctgacgtcatctttccattgccacgctggtaaatcggtaagagaacgtctgaaatacaagcatctgggtgatgcggcaggcatcatgatcattggtaagcagttttctggtgaaataaatcatggaatggtcattattaagtccggaaatttacggtttcctgtttttggttgcgatagttgctgggtttatcgattctattgcaggtggtggtgggttgttgaccattcctgcattactgtcagtcggtgtttctcctgttcaggcgctggcgacgaataaacttcaagcggttggcggttctttctccgccagcctttattttattcgtcgtggcgcagtggattggcgctcccaacgttttgcgatagctatgactctgcttggtgccatgctgggagccttgctggttcaatttgtatccccagattttctgcgttatctcctgccggttctggtgattatcattggtctttattttctgctagtgccgaatattggcgctgaagatcggccgcgtcgcttggagcctctggcatttggttgccttgccggaggcggaattggcttttatgatggtgtatttgggccgggaacaggctcctttctggcgctgtcttatgtgatgctctacggttacaatctggcgaaagcgacggcacatgcgaaggtgctgaattttgcatccaatataggttcactgggcttttttattcttggtgggcaggtcttgtggctattgggtcttgtgatgctaatagggcaagcgattggtgctcggctaggagcgggtttagtcctgagccgagggcaaaaaatgatccgtccgatgctggtaacaatttcttttctgatgagtatcaaactactccatgaccatcatggcgatactatccgctcttggttagcattttatttttgattttaggatcctgccttaactcatgactgcacatcactatcaacaactcattgaaatttttgataattgctttagcgatgactgtaacacccgtttaataaaaggtgatgacgagccgatttatctgcctgtagatgatcaagtcggctataatcgggtagtgtttgcccacggtttttatgccagtggtttgcatgaaatatcgcattggtgcattgcgggtaaagagcgtcgcaaacgggtcgattttggttactggtactgccctgatgggcgtgatgcccaaactcagtctgagtttgagcaagtcgaaatcaaaccacaggcactggaatggctattctgtatggcagcgggttttcctttcaacgtcagttgtgacaatcttgaaggggattgtgagccagatcgctttgcttttcagcgtaaagttcatacacaagttatcgcatatcttgaaaacggaatacccacacgagcagcgcgctttattcaaggactgcactcgttctacaatacgccctcactgacagcagaacactttccttgtccggaaaatccttttgctaactgatatttgattttgaggaaatataatgctcgcagagtttgaaacacgcattctggcacatatagataacatggttgaacatgccagtgatgacgaattatttgctggtggatacctccgtgggcatctgacattggctgttgctgagttggaacaagaaggcgctaataccattgaacagcttcatcagcgtgttgaagagagcatccatagggcgatcagggcaggagagctggctccaccagatcaggttttggttttatcgacatggcaaaatctactggatagtgcgaaagaccaattaattgattataaataacttatatgtggggttattcatatagcccctttattttttctgttatgttggtgtaattatcatctgtaaatatataaatgttaatttattttttaaggttaaataaaataggatattaaatttatcaggatatataaatgtctttaacaaattgagagggaaggcatgttttttattcgtccaacacagatattagatgcaggagtattaccagcaatagaacggtcagcgagccagctatttctctcgacacctgaattggcatggattgctgatggccatacccaaacggaacagcagcatttagattatattttgcaacagaatagttgggttgccttgaatggcgataatcagcctgtcggttttattctggcaaaaccgctggatgatggcttacatattatggaactctcggtgcatagggattggcagaagaaaggtataggaaaagcgttgattgataccgttattcaggtcgctgagcagcgcggctttcaggctgtcacattgacaacttttcgtcatataaactggaacgccccattttatcggcgactggggttttttatcttagaacctcgacaaattgctggtgctttgtgtcagatcctgcaacgtgaaattgaatacgggtttgcagaaaatcaacgctgtgcgatgaagcgtttggttgttacaacagattatcacgattgagttttgagaatagagactgcgggttgttactctgcaccaaacactgtttgactgtgcctgatgcagatatatgactttatagtgtgtgatttaaggttttccagctttaacttccctgcctcgtaataattttctgacccagaatcggtttgggtgcaaggccgccaatgtttcatcatcaagtggtagagcttccccaaaaatctgccctgcgagtaattctgcgctcaacggagcagaacataatccacgggaacctaatgcaccaataacaaataaatcaggataataaggagattcttcaattgtctcatcagtgtttatcctttgagataaaccagcatatttgaccataatttgactgaaaataggtacattgcctaccatcggcatatgatcccgaataacacatcgtatcccttgacgggatttcgcttctgaaatattgacttgtttcacccaatcgacatcgggtaaagattttaataaacgatcacgattttcttgctgttctgcgggagaatactgagtatcaacgttccctcgctgatagctggcaccgatacaatgatgttgattttgaggattcgcaggagtcagatagccatcgtaacacagtacgtttttcagttgactgagacgggtagtggtcgggatatggctgacttgtccacgaacagcagtaacgggcagtttttcagtttgtgcaaattgcgtcaggcagtgtccattagcaatgataacgaccctgtggtttttgtgcagtgattgcccctggtgctcaatatgcaactgccaaccgtattcatcttgaactaattgagtcattttgtggttgaaataggtgagcattccacgccgttctgccagattgatggcttcctgagtcaattgagccggagataaccatcctccctgtggatagtggataccatgataattaacatctaatccgctcgcttggctcaatttctggcgatccattccaattgcaatctcttctaaccacgatgtttgcagcatcttggcaatttttttgtcacttttttcatcgtaagccaactggctgacaccgcaccattgataatcaaaggaaacattttcatcaattagctgatcatattgacggcgggcaaaggtaaaggcggagataaagaaacgttccagtaagtcgtcacggccattcagtaacggataaatggctccctgctgattgcctgatgcattttgtgcgggttggttatcttggcaatacagtgtcactttcgcgccccggcgtaatagtgcaagtgcagttaatacactggcgatgccgccaccaatgatggcgatatcatcggtatcggtagctgcttgtcgggcaaaccatggagtatctgatgaggaaaaaaggaaatgtgcagatggagccagaacccctgtcagcatctctcttttatgtccaaagccttttatttttttgacatcaaatccggctccctgcaatccacgtcgaacgattcccgctgacgtaaatgttgcaaatgttccttctggacgagaaaatcttgccattgcagtgaacagttgttcgctccacatctgcggatttttggatggtgcaaaaccatctaaaaaccaagcatcaatttttccagttaaattcgaatttatcctcggtaatagatcatttacgtcaccaaaccagagatccagtgtgacagtgccattattcagcattagcctgtgacagcctgcaagaggtaaaggccattgctgacataactcttcagaaaatacttgaagttctggccagcgctgatgcgcagtcttcaagtccgctgtcgttaatgggtatttttcaaaactgatgtaatgaagccgttttaaaggtgtatcaggatattgttgtctgaaggttgaaaaagctcgccaaagtgtcaggaaattcaacccagtaccgaatccagtttcagcaataatacaatcagggcgggagtgcgtattaaaacgttggggaaaatgattaccttttaaaaaaacatataaagtttcttccaagccatcttgatttgaaaaataaacatcatcaaactgctcagaaacaggtgtaccctgttcattccagtttagggttgcgctgctgatagcactctttttcacaataatgcctgtatggttgataaaaataatatgagattttaacggtgttcatactgttgtaccacccgtgagaaaagttagcacttgagtccagatcaacttttccgtgagtttttaacctgatcggacttgttcggcgtacaagtgtacgctaaagtgcagggcagaaatcccgcaggtaaaaatgatgaggtaatgaatgaaacgtgcagtaatcactggtctggggattgtttccagtattggtaataaccagaaagaggtgctggagtctctgagagaaggccgttccgggataactttttctgaagaattcaaagagatggggcttcgtagccacgtctggggtaatataaaactggatatatctggtctaattgatcgtaaaactcagcgttttatgagcgattcatctgtttatgcttatcttgcaatggatgaagcgattaaagattctggtttgtccgatgagcaagtttccaatttgcgcacgggtctggttgtgggttcaggtggcggttctccacgtaatcaggttagtggatcggatggtatgcgagccaaagggctgcgtggcgttgggccttatatggtgacgcgggcaatggcttctggtgtatcagcctgtctggcaacaccattcaaaatcaaaggggtgaactattccattagttctgcctgttcaacttctgcacactgtattggccacgcagttgaattgatccagcttggtaagcaggatgttatttttgccggcggcggtgaagaactgagctgggaaatggcctgtgagtttgatgcaatgggagcgctttctactaaatataacgaaacaccagaacttgcttcccgcacttatgatcaggggcgtgacggttttgtcatcgcaggcggtggcggtatcgttgtggttgaagaattagagcacgcattagctcgtggtgcgcacatatatgctgaaatcatcggttatggggcaaattctgatggcgcggatatggttgcaccttctggcgagggggctgttcgctgcatgaagctggctcttgatggtattgaaggtggcgtggattacatcaatacccacggaacatcaaccccgattggtgacttgaaggagttgggagctatccgcgaagtgtttggtgataacacccctgctatttcggccaccaaagcgatgacggggcactctttaggagcggctggtgcgcacgaagccatttacagtttattaatgctggaacatggtgttattgcaccaagtatcaatattgataacttggatgagaaagcgttaggcatgaatattatcactgaacctaccgaacgcgagctaagaacagtaatgtccaatagcttcgggttcggcggtacaaatgcatccctggtgatgcgcaaatattcgaactgattttttgacggctgaaaaattcatcagttaaaatgaaagccaatccattgattagatgggttggttttttattatattgttgtacgtctgttaccgcgttttatttttagtaaaataaatggaacaattattatcaataaagtggtgtttagaaattcataggaatattcactgtgaatgtttcggcacccctcatacagcattagctatacagtcgcatagatactatcgtttatggttactcctacattatttaattaagccaaaggatttagccaacccatgatattggacaacttgtttttttacataatcatctaattctttgccgaccatgttgaattcaaataatccacgtaaatcacgttcctttttaaactcttctgtttgctgtaattttttaaatgtttttatccaccattgatattgttcatctgtgacttttggacccatatagaaaccacgaacaactggccaaacgatgttatatccctgttcttttgcggttggaatatttgctagcttacctttcaaacgttgttcagcatagacagcaagaacacggattttatcgtcagtgaggtaaggtacggtttcactgagttcccaggaaacggcttgaatgtgattgcttagtagagcagtgataggttctccaccgccttcaaacgcaacatagcgtattttttgcggatcaacacccacttctttcgccagtagtgctgttttcatccaatcttgacttcctatggatgcacttgcaccgaatactatcttgttagggtctttttggaaggcacccattaagtcttttaaagtcttatagggagagtctccgcgcacagctatcattccatagtcagtacccatactagctaaccagcgtacatcattcacatggtaacgaccgaattttccttgagaaaggttaagcaaagaaccaccagagaatgccactatggttccaggctctgcgggacgttgagcgatgatggtattataagcgacagctccgattcctccaggcatgaaagccacgctcataggagagttgatagctttagtatctaataatgttatttgtgctagcttacaggttaaatcaaacccaccactaggtttggctggagcaatacattccgttttatcgggagcattgtctgcaaatgtattggtacaggcaagtaaagtagcaacagctaataccttgattaatattgtttccatttgtttcttctcatcgtatcagtaaatgagataactcaggcaagttgttgggctacaccatttatagatataaaacctttcatttacctttcattaatcagaaaaatttatttggatgtgacgttagtcactcaatttacataacacctcggataacggtgctaataaatgattaccaactttcttttgcttatgatcttgttgtagtgtgggaaaatgaaaaaaacagcaggtttcttatttatcttgccaatttatatgaggtaaacatattcagcgcactgaatatgttgaggtattgattaatgattataaatattattgattcttgaaaccataaaaaagcaaggagatacttaaaaatgcgtctcttattagttgaggaccaccctgacttgtcacattggctgcaaaaagcattaagcagttctggatttgcagttgatattgctgaagatggaattgcggcggatcagcttttgctgacggaagattataccctgctaatcttggatgttgccttacccagattggatggaatctccctgttatcacggctgcgtaagcgcgggcaaaatttgcccgtgttgttattgactgccaaagtggatgttgccgatcgcgtgaaagggttaaattcgggcgctgatgactatgtaactaagccttttgattttgaagaattagaagctcgtattcgagcactgttacgccgtggcatgggattgccgctagggatacagcaatttggctcattggtttacgaagacgcaggttatttcttattggataatcaaccgctggcgttgactcccagggaattctcagttttaacaaccctgtttcaccgtcgtggacgccctgtctcgaaacaacaactgtttgagcaggtattttctttatctgatgaagcaaatccacaaagcatcgaactgtatgtgcatcggttacggaagaagctttttaacagtgatgtcggaatatgtacattgcgaggattgggatatcgattggaattgcaaaaataatgaaactgttcaaagccccacgctcattgtttcatcagttactcctgttctttggtgcgccattgttgttattgggcggggcttctgtgtatacccattattttagtgcggaaaatgcggcgacacttgcctatgatcggacgttacttgcatcggcaagaacagttgcggagcgtctgacagtaaagaataaacagttaaacgttgatgtgccttatatcgttttggacagttttgaacgtaatacgaatgatcgtctctactatcaggtgatatcaccggcagggagaaccatttccggttacgataatttacctcccattcctcaatatacccagcgttcgcaactgtatacggccttggtatatttttataacgcggaatatcagggataccccatccgtgttgcggccttgtatcagccgatcaacgaaggaggggtaatgggcatggcattgatactggtggctgaaactgtggattcccgccaatatttagcgcgacaattactgatttcttccctgataagccagggaaccgtagtggtattgacactgattcttgcctatttcctgttaaagcagcttcttaaaccactgcgcaggttatcaggcatgatggtgctccgttcagccaatgacttaaccccattgccggatattttgccgtggtcagagctttcaccattgcttcgggcatttaatcgctacatagaacggttaaaactgatggttgggcgtcaagcccggttcagtgctgatgcttctcatcaactcaggacacctttaagtgtattaaaaacacagatagccgtggcactcaatgataaagatccttatccgagcagaaaaatcatcaactctattaacaagaccgtagataacatgatctcactgactgatcgtctgttatatctttcacagttgaaagtgcatgagaaagaagctatccagaattatcagcccgtcaatattgtggaattattacagcaagcctgtttttcccgtttgcaacaggcggaaagtaaaaatattgatttgggttatgaaggagaaaataccttttggatcaagggagaacccgtattgttgacagaaatgtgtgctaacttgttggataacgccattaaatatacgcctgctgcgggaatggtgacggcaagagtaagtatgacagcggacaaaaaatactgttgcctcgaagttgatgattcagggccgggcatcgcgcaagaaaatattactcaatcgttgatggcgtttaaccgtctggataatgcagcggggctggaaggcgctggattggggctgactattgttaaggatatcagcctgtaccacggtgcgactctccagcttttgcccagtattgtactgggcggtttgctggtgagaattttattccgccttcctgcgggtgagaggaatacgtaggcgctgggcgagtataacccctgccagaacaatgccgccgccgatcagatgatagctttgcattttctcacgcagaaacacaatggcgataatggcggtaaatacaggagccagattcataaatacagaagtcatattcgcgcctaggcgagtcacgccctgtatccacagatagggcgcaagaattgaggcggggatgcccgcgaacaggactaaggaaatgttatcgctagttaactggacatcttttgtcatcatgaaattaggcaaaagcagcaaaaggctaaacccgatttgtatataaagtgattgccaattgggtaatgggatcgcccaacgttttgtcaacaccccatataaggcgtaggaagcggatgcaataaatagcatcacttcgccgatccccagaccgtgctctaataaggaagcgggttcacctttgctgaccagccacactaggccgaacaacgaaaacacagtacccagggtgatacctactgtgggagcaatccgtaaggcaaagatactgatgataaccgtcaacaacggaatcagtgaagtaaagattcctatcaatgttgcactcacagtatgagcagcgtaataggccatactttggttaagtaccatgcccagagtacccagaatcaataacttccaccaatactggataaccattttccgctgtttcaggacaggccataaaacgaaaggagttaaagccagaaacgcaatgaaccaacgatagaaagcaatggcagcaggctcaattgcagtggctgctgctttactgacaacggcattaattgaccaaatcagaacagcaataaagggaaacaagaaatttatcattgaattaatttattcatgtaagtgcatagtgtatttagtgtaacaatgacccgttttttgggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccgttttttgtatatagtgataatcagacaacagatgtggca

SEQ ID NO: 14962 - DNA, 70443 bp, Xenorhabdus bovienii
  Genomic contig Name=Xb4151_4152.C421
gatacaattcgagctcggtaccccgtcatcgtttctaatcccgattcgcccattgctccacgagccattgttcggaacccatgtccgcaaacatcggttttggtgtcgtatcccatgccacgggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccttatcctatcgtcggcataaaagagccaacggggcggctttaccgatttgggtttgagttttttaaatgacgaagcacggtattcaggccaatccccatcactcgtgctgtcgcccggcatccatcccattcatagccatatcgacgatttgcttatgggtgccgggacgacaagcagcataagtgaactcaagttgccagaaatgacggcaggattggcagagataacgttgatgaccagaacgtgagcgcccgttgcgatattggcaaaatcaggcgctgacggaagcgacttcccgcaatatttgctggagcagcgtttaaaaaacgccaataaccctgaacatgcggactattggcagcagcatattgcggcaggattacctttaatggacgatgccacttcaagactggcgaatggcgatgagtcgttttatgattgagttcggtgatcgccttgacggtcattactaagaaaaggtatttacacaaaatggtatacaggctccccttgcaaggtaaacaaacgtctccatttctttttactttgagaattctttaattgcctcattattctcagttagctccttaaaccacaagcaagcctctatgtctccattcttacatgcaagcccaaacatatctctgccacgcttaaagtctttggtcaccccttgaccaagaagatacatcatggcgagatgaaactgtgactctccgtgattttgtcgggaggcattttcaaacaattgccaggctatctggtaatcgcgcagcactccggaatttcccccataatatatcacaccgagtttgtactgggcttcaggtagatcttgtgccgcagctttctcaaaccattctctggcaatcttgatactttgctctacaccgcgcccgtgaagataaatcattccaagctggtactgtgatattgcaatattttgctgggctgctttttcaaaccaatctctggctttgtttagattttggttatcattctcattattgtaaaaatagataagcccgagattattttgagccttagcaaaattttggttggccgatttttcaaaccattcgatggctgtctgtatgttttcaggcgtgccttttcctgtcatatacattacgccaaggtaattttccgcttccgccgaattctgttgggccgctttttcaaaccaactcttcgctagttgataatcctgtttcactccttggccgtggaaatacatgactccaagatcagtttgtgatttagcatcaccgccaattgccgcaaaacgcaaagtttctaaactcacctcacttgcataaagaaatccgttggtgaataacgccatcattaaaatgatagaggataagtattttttcactttaccttttatccttcccttagctgctgttcaatttatctcagatttagcccaatttgattgggctaaatctgttgataataatatggctacctactgtaaaactgcattctgatacaaatcccaccggtttccgtaaatatcctcaaataccaccaccacaccatattcctcctgacggggttcttcacagaaatgaacgccgttttctttcattttgtggtaatcacgccaaaagtcgtcagtttgcaggaaaaggaatactcgtccaccacactgattaccaataaattacagtatccgggttcccagagtcacgtctcgttctggctggagcagtacggtgccttgatcgtcacagacggcggccagaacgaggacttctgacttaaagcctgccactcttcttggtggaaagttgacaactgccaacacttgtttgccgattaattgttcttctgtgtagttttggcatatctgggcggagctctgtttttcaccgatatcactgccaaaatcgatataaagtttataggctggcttaatggctttttcgtttttttctgctttgatgattttgcctacacggatatcgagcgacataaaggcgtcaaaggtggcaggttcgagatgtatattttccataatgtatgacgggttgttcaaataatattatttaacataagcataatgcgaaacaatattcagggcaaaatgactttcgatttatggaatgttgatcgcaatgagtcgtcctctggcaaactattcctgttaacgcactccacccgcaatcattttgacagggtgtatctgtgggtagtagtcagaaatgggtttctgacctaactgccagaacaggtcatccatatcgtgctgatggctgttgcatagcaggccgacgatactgccgctatgggcgacattcaggccgtaaattccactttgttcgactaaatccaataattgataaaaccggggcttaggcagtatcggctgattcgcgatggcgctcagggtgcaggcttcccctagacgagagttgtcatgatgtttatttgcgatgcgaaactgctgccatgcctgttggagcagcggcgcactttccagcaagagttgacggcgatcccgccgatggtgctcttccgtcaaaatagtttgccgactttccaacagcaaaatatcgatatccggctgccatgcgaaggggatctgagtttgagcggtcaggtgatcgaacaacgttaatgattcaaataccgtgctgtcagtcggttcgagcttgacacagagttgcgcgagggtggtgctgttcagcgatttacccagtaatttggccgtggcgtgtgcggtggcggcaatatctgcggtgctgctggccatgcctttggcaaccggaatggtcgattggtattcaatgcgcaggcaggccgataattcagcaggttcattccagtgttccagcagcaattccaccatctggcgcatacgtggccgttcatcagcagaggcatggccctcgctgaccgcgacacaactgaaccaattaatgggacaggagatcagtttctctccgccgaatagccatccttgcagcagttctccacaggaagccgggcagcaggcttcagccatgtgcgaaaacgtgctgtatggcggcggtcaggcgtcggttttcccattcgctgcgtacggcgattcgatagtaactctcgtccaagccaacatagtttttgcaatggcggatcagcagtcggtgctcaagcagagtgtgccatagatcaagattgggctgatggcagcgaaagaacaggaaattcgcggaaggcggccagacggtgagttcagggcaggaggaaaggtacgtccatagataatgttgttgtgattttagccattgatgggtggcggtaatataagcctgatcatccaacaagacttcacccacctgcgccgcaagggcattaatagaccacggttcacgccggtttttcatccacgccacccctgcgcaatccccgctgaccagatagcctagccgcaaccccggaatggcgaagaattttgtcagtgaacgcagcacataaaggtggcgggtggcggcaatgtgcgggatcaggcctcggttatcgggcagaaaatcaataaaggcttcatcaacaatcagcgctatgcggtgctcttcacaatgttgccccagcgattgcagaaaccggctgtctggcattaaaccggttgggttattgggcgtagctataaagacacaatcgggttgaagaattgtcagtgtatccagcaggcgtagatcgggttgaaatcctgcgtcttctgttaatggatacgcgatgatctcagccccaacgtgctgcaaagctcggcggtattcggcaaatccgggggtgaggagcagggcgcgtttcgggttgaggtaacggacaacggcgtagatcagttctgttgcaccattgcctgctattaccgaagcggtatcgcactgatgggcgtcagccagtacctgatgcaaatggcgatattctacgtcgggatatttttcgatgcaggcaaggttatctttaatcagcgtcttcacccgttccggggcacccagcgggttgatattggcgcttaaatcgatgagttcgttggccggaatgccgaactgttgggcaacttcgatgatattgccgccgtgttcactcattatgtcaccagccgggtgagaggattcatcatgactgcggttgaactgagcgcaatgggggtggaggtaaaggcgagtatctcagttaaccggacgacattgccaatcacaattaatgcgggcgcatgtagttggtgatgttcaacttctgtggtcagcgttgccagtgtagcgatggtcatctcctgtctgggctggctggcatacataattaccgctgcgggcgtagcgggaggtttgccgaattgtatcaattgctggcagatttcggccagacggctcatgcccatcagaataatcagcgtgccatccaattgcgccaatgcgcgccagttctgtggctccttacctagggaaaggtggccggtcaccacatggaagccggatgcataatcgcggtgggtaacgggaataccggcataagccagcccgccaatggcggaactgatacccggaataatttcaaattcgataccctgttgtgccagcgtttctgcctcttcgcccccgcgtccgaatacatagggatcaccgcctttcaggcgcacgatttgtttcccgtccagtgcgtgtttaaccagaatctggttaatttcttcttgcgggatcgggtggtgattgcgttctttgccaacgttaatgatgtcgcagtgttctggtgcctgtgcaatcagctcaggattgacgagacgatcatgcacaataacatccgcagattgaatgtaatgcagccctttaacagtaattaacgctgcttcgcccgggcctgctccgattagccatactttgcctttattcatagaactccctttatattttccttcttatatagaagtgtatagggaacgcgggtggtatgaatgatacttaataaccggattgtatttttctcgttatttaacattaattcaatctggtttttaatttaacgtattattacgtaagtgtgaatgaaatggatttgatttaggtcaatattcatttatttaaaaataatggattcttttgattcatataataatcatctgaaaatatttatttgtatgaaggttttttggtcatattaatgatctgtattttggtttgccttattgttttaatataaaaagaaaatattattcaatgtgttatgtttattttaatgtagatatatttgttttttctataattatttttatttacccatgaataaaaatagtgtttaaaattcaataaatatgaacaagatcacaaaattaatcatgtgtgtatttataaatagtggaactatttattttaaaaggtgattaataacgcttcgttattttaatataaaactctggtttgtaatgataatgataatgttaatgtattctttgtgtgattaataaacggttgttttaagactctatggggtattttattaatataataatgaaataaacttattattatattattaaggttatgcgtgtgttttattatttaaaataggttgaatctgttttatttgataaatatcaatgagagagatcggatattccagttttaatagcaggtaatagttttagctaaatggtcagggtaaatagtttgaagtaaatagtctggggaaatcctatgcggcagaaatatgcttttgtcattgcaggtacaggcagcggatgtggcaaaaccaccgtcacactggggattatgcgagcactaatgtgccgccagttacgggttcagccattcaaggcggggcctgattatctggatggtggctggcatcgtgcggtgacgggggtagcctcccgcaatctggatgcttttatgctgcctgtccctattctgaatggcctgtttaatcaggctgtagccgataaggatgttgctgttattgaaggcgtcatggggctatatgatggctatggtgcagaccctgattattgcagtagcgcggcgttggcaaagcagcttggctgtccggtgattttagtggtggatggcaaggcggtatctacatccattgctgccacagtgatgggatttcagcactttgatccttccgtcaatattgcggctgtgctgatcaaccgggtgaaccatgatagccattttcagttgttgaaacaggcgattgaagactattgcgggcttcccgtcttggggcatattcccgtcatgccggatattgcactgccttcccgtcatcttgggctgatcccggcccaagagcgaaatagtcaatatgatgaacagtggcagcatctggcgcaccagatagaaacgacggtcgatctggacacgctgctggcgctgactccattaccggcattaccgcaaggcgatatcacttcccttgtcgatccggcgattggtcaggggttgacgctggcactggcggaagatgaagcctttcatttttattattccgataacctgctgttgctggaacacgcgggtgtggtcatcaaacgtttcagcccgttgcacgatagccagttgccggagtgtcagatgatctatctgggcgggggatatcctgaaatgtatgcccagtcactggcggccaatcacgcgatgcatgaggcattgcgtcaggcgcagcgacaaggcattgccatatatgcggaatgtggcggcctgatgtatctcggtgatgctctgaccgatgtacagggcgtccgccactctatggtgggtttgattgccggtgaaagccggatgggaaatagtctgaaacgctttggttactgcgaggcgacggcggtatgcgacacgcttttggtggcgaagggggaaaccctgcgcgggcatgagttccattattctgatttcacgtctgcccagccgccggtattccactgtaccaaacagcgtagcggcatggtgcagaaaagctggtttggcggatatcaaaacggcaatacgctggcggggtatctgcatgttcattttgcccaacgccctgatttgctccatcgctggctgacgatcgcccgcaagcagatggcaagggggcaatcatgaccgttttactttggtttgcggcgtttgttctcgatatgaaactgggcgatcccccgcattggccgcatccggtgcgctggatgggtcggctgatcaatcaggctgaacgcgttattcgtgggcgatgcaaaaccgacgctgatttgaaatggggcggggtggccttgtggctggtggtggtgggcagtgtctggctgatgagttatctggttctgtggctggcttatggtgtggcgttctggttcggcatgctggtggaagtctggctgatttataccgtgctggccggacgtagcctgagtgatgcggccaatgcagtctatcagccattgaaacagggcgatccggtggccagccgtcaacaactggctcagattgtcgggcgggatacatcacagttacaaccgccgcaaatcagccgtgctgccattgaaacggtggcagaaaacagcgtggatggcgtgattgctccgttgttcttcctgatgattggcggcgctccactcgcgatggcttataaggcggtcaatacccttgattcgatggtgggctataagacgccccgttatcgggcgctgggcatgttctcggctcgcatggacgatgtggcaaacgggatacctgcgcgtttgggctggcttttgctggcgctggcggcgaagtggctggggttgaattttcgtcaggcactgcgtatcggctggcgtgatcgctaccaacaccgcagccccaacagtggctggccggaagccacggtagcaggcgcattaggtatccggcttggcgggccgagtgtctattttaatcagcgggttgaaaaaccgtggatcggtgacgcacggcgtgaagtcacaccggaagatatcccgcagtccgtgcagatgatgagggtagcatcggtgatggcgctcctgctgtttgcgttgctgcatagtctggtcagtgtaacgccattcaacgcagtgctataagaagaggaaacacgatgaactatcctcaacgctcgtatattcaacaacctcagcagattgagcaacatagcttcgacattatcacggggattatccgtgaatcgcggcctgattatcattttgtggatgccggacaggaagcggtgattaaacgggtgatccacaccaccgctgattttgactggctcgatatcctccatttttcaccggatgtcctgcatcgtattcgtgatgggatcttacgcggctgcacgttatacaccgataccacgatggtgttatccggcatcaataaaacccgtctggcgcaatatggcagtgaatgtcgttgttatgtcagcgatccccgtgtcgtgcaaatggcgaaagtgcagcagatcacccgttcaatggcggcggtcgatatcgccttgcaagagtcaggagagaagatttttgtttttggtaatgcccccaccgcgctgtttcgcttgctggaacatcaatccacgcccattgccgtcgtcggggtgccggtgggttttgtcggggcggaagagtccaaaaatgcgcttatacatagcgacttgagctgcattgcggcgagagggcgcaaaggtggcagcaatattgcggcggcgattatcaacgctgttttgtaccggatgccggaggtgcggcatgaatgaaacgttgaatgaaacaccacacacgcaggcagaaagcctcggtacggtctggcacagagggaaacagtaccgcaaaggttataccaccggctcttgtgccacggctgctgcgcgggtcgcggcgttaatgatcctgcgccagcagattatccatcaggtttccatcgtaaccccttccggtgtcacgttggccttgaacgttgaacagccgctgattgaaggtcagcaggcagtggcggcgatccgcaaagatggcggtgatgatgttgacgccacccacgggatgttgatttttgcccgcgtctccctgaatgacagcggaatcatcacgctggatggcggtgcaggggttggccgagtcacgcgggtcgggatcggtttaccaataggctgggcggctatcaataaaacgccgcggcacactattgaagaagcagtgcgagaggtgattggtcttcagcgtggggcagatattgtgatctttgcgccagaaggcgaagaacgggcgaaaaaaacctataacgaccggctggggatcaaagggggaatttcgattatcggtacgacgggcattgtcatgccgatgtcagaagagagctggaagcgttcactggcgctggaattggaagctaaacgcgccagcggattggatcggattatctttgtgccgggtaatcacggtgagcgttttgtcagtcagcagttgggcattgacggaaactatgtggtgacgatgagtaactttgtcggctacatgcttcaggaagcggtgcgtttacagttcagtcatgtggtactggtgggtcatgtcggtaagctggtgaaaatcgcagcgggtattttccatacccacagccatatcgcggatggccgcatggaaaccctgatcgccaaccttgccttaatgggcgcgcctttcgaactgattcaggccgttgatcactgtgataccaccgaagccgccatcgaactgatcgcggaacgtggctggcaggcggtgcatcagcagattgcccggaagatctgcgggcgcgttgatcaaatgctgcgtttttccagtggcaggccacagtgcgatgccattcttttctcctttgataatcaagtgttgggctgcaatcggccagtggatgagattgtggaggggttccgatgattacggtcgttggtatcggccccggcgctatcgcaaatcaaacgctggccgcgctggatgccatcaaacaggcggaaatattggtaggaggtgctcgtcatctggctgaatttccccatttccggggcgaaacccgccgtttgaatgccgatatggatggattgatgcaatggcttgaactgcgccagcatcagcaggttgtggtgctggcgtcgggtgatcccctgttttatggcataggtaaacgcatcgctgaacattttgtcggcgagccgcaaaacattcgcatcatttccggtatcagtgccattcaatacctgtgcgcccgaattctgctggatatgaatgatatctaccttaccagcagccacggtcgaaaaccggattttgactggctgctccggcacgaaaaaatcgcaatggtgacagatgaggtgattggcccccgccagattgcggaggagattttggctcgcgggcagcatcgccggatggtgattggtgaaaatttgtcacaggagaacgagcggattgtttgtctgagtgcgcaacaggtcgccggatacggtgacattaattatggcttgaacgtggtggtgatccttaatgaaagatgaactgtttttgcgtggtcatcgcattcccatgaccaaagaaactgtcagagcgctggcactggaacggctggaactgacaaaagcccggcgtctgattgatgtcggagcggggacaggcagcgtcagtattgaagctgcattgcgttaccccacgctggatgttctcgcgattgaacgtaaggaagaggcgctggcactgatctatgaaaatgtccggcactttggctgtcacacagtccgcattcaggcgggtgttgcaccactgcccttggaggaagccgtcgatgccatttttatcggcggaacaggcgggcatttgacggaattaatcgattggtcgctgacacacctgaacccaggcgggcgtttggtgatgacgtttatcctgctggaaaactttatgcaggcattggcgcatctgcaatcttgtcaggtggtgtctcttgatggccgtgaaattcagattggggaactgaccccattggggcaggggcactatttcaaacccaacaaccccacctatttgatttcctgccagaaatttttcgaacacctgtccgagccagaggaaaacgcttatgcctgaatatgttgatcccgaatcagcgtgttttgatgctgaaaaagtctggtttgtcggggcggggccgggagataaaaccctgatcaccctgaagggatatcaactgctgcaacaggcgcaagtggtgatttatgccggatcgctgattaatcgggagctactggaatattgccgtgcggatgcagaatgctatgacagcgcgggtatgacattacaggaaatcactgatttgatggcgaacagtgtcaaagccggaaaattagttgtgcgtctgcaaacgggggatttgtcgctattcggttctatccgtgaacaggctgaaatgctggccggtcagggaataggttttgtctctgtgccgggtgtcagctcttttctcggtgcggctgcgcaattgggggtggaatataccgtccccgaagtggcgcaaagcctgatcatcacccgcatggttggccgaacgccgatgccgccacgggaaacactggaagctttcgccgctcatcagacatcgatggcgatcttcctgtcggtacaggatatagccggtgtcactgttcggctgatacagggcggctatccgcaggaaactcccgtcgcggtggtttacaaagcaacgtggccggactgccggattgttcgtggcacattggacacgattgtggaacaggtacgcacggcaggtattcagaaaaccgccctgattttggtcggcgcatttcttggcgaggagtaccactactcaaaactgtatgatgcggggttcagccatgaatatcgtcaagcatgatgagcggatcgcgttgttctgcctgacattcggcggcatggcattagcgcgccgtctgcaatctcatctggccgtggattgttttacttcccctgaactggtggaaacggggttcagggctttcgatagtggctttgccaatacggtacgcaatgcgtttatccaatatggctcgctggttatggttggtgcgacggggatcgctatccgcgtgattgcaccactgcttaaggacaaactgattgatccggcggttgtcgtgctggatgaaaaaggccagtttgccatcagcctgttatcggggcatatgggcggtgcgaatgatctggcgcgtcaggttgcggatctgcttggcgggcaagcggtcatcacaactgcaacggatgtcaaccaactcgctgcaattgatatgttatcccggcaaattgacggcgaaatggcggattttcgcgccagcgtcaagacagtgaaccaaatgctggtcaatggcaaacgggtgggaatatggtggcatccggcgctgattgacgaaaaagggcagtgtgatacccgtggatttattccggtggaatcccttgatgatttgccggaactcgatgccttggtttacgtcagccaccgacgggcaacacccgtattggcgatcccgaccttcaaattagtgccacgccggattatcgcgggtattggttgccggcgcgggatcgctgctgaacgggtcgcgcagttattggatcgtcatctggcagaacatgattttgatcctctggcattaaaagccatcggcagtgtggaactgaaacaagaagagccggctttagttcaactggcggaaaaacgccgcattccttttcaaattttctctgttaaccagctcgcccaatgtgaacaggcattccctgcctctgaattcgtgcgtaaaaccgtgggtgtcggctgtgtctcccaacccgttgcctggctgatgagtcaggggcggctggttggtcataccctgcgtgagcagggcgtcactatcacactaggagtattgcagccatgttaaccgtcattggaataggccccggcagtgaagccatgatgacgcaggaagcgatagccgcactgaaagccgcagatatcgtggtgggttacaaaacctacactcatttggtaaagccgctggtgggcgataaagagattatcaaaaccggcatgtgtaaagagattgagcgctgtcaggtggcgattgatctggcagaagaaggcaaaaatgtcgcgctggtctgtagcggcgatgcggggatttatggcatggcggggctggttctggaactggtcagtcagcatcaacgccatgtggaagtgcgtctggtggccggtgtgacggccagtaccgcttgcgcctcactgcttggtgctcctctgatgcacgatttctgtcatatcagcctgagcgatttgcttacgccgtgggcggtgattgaaaaacgggtacgggcagccgccgaagcggatttcgtggtgtgtttttacaatccgcgcagccgtggccgcgaagaccatctggcacacgcctttgcgttgatggcgccgtggacaccggcagaaacacccgtcggtgtggtcaaggcggcggggcgcaagaaagaagaaaaatggctgaccacttttggcgggatggatttttcccgcgttgatatgcgcagtctggtgattgtcggcaatcaatccacttacgtgcgtgatgggctgatgatcacaccgagagggtacagattgtgaaacagccacaaatccacatttttggcggcacaagtgatgcccgccagatttgcatgatgatggacagcgctggcattgattatcgcctgtctgttgccacggccacgggagcgcagcaggcggctgatatccgcggtgacattgtgattggccggatggaagcagagggcatggtggattatctgcaaaagcagaaaacgcagagggtcatcgatgcttctcatccttatgccgaacagttgagccaaaacatcgcgcaggcctgccagaagctggatattcctctgatccgttatatccgtccgagtgacattgatgatgtcgaacatgccttgatccataaagtggcgactcttgatcaggcatgcgaagtggccgccagattaggcgaacggattttgctgactaccggcagcaagcaactggccgattatgtgacgcgtttggcaggaaaaaccgtgctggcgcgtgtcttgccgacggcagaagtcttggcgctatgtgaatcctgcggcctgtcggttgatcagatttttgccctgaaaggcccgttcagtgccgattttaatcgggcattctaccaattctgtcaggcggatgtggtcatcaccaaagaatccggtgaacagggcggtttcaaggagaaagttgagccgtgccttgcgctgggtctgccctgcatcgtgatctgccgtccggtacatccgtttaacggtgagggaattacgcaggccaacggtttggaagaaatggctcagctattggcgaatttcccggcgatagctaactaataagggataatgcgatgaaaaaagcactgttggtgatcagtttcggaacccgttatcccgaaacgcgaaaaaataatattgaagcctgtgagcagcagttggcttctgtttttcctgatagggaactgtttcgcgcttttacctccggcatgattattcgcaaattgcgggagcgtgatggcatccacattgacacgcctcacgatgcgctgaccagactgtatcacgctggttatcacgatatcgctgttcagtgcctgcatatcatcaaaggtgacgagtatgaaaaagtccttcatgaagtagaacgatttcgcccgcagtttcaacgtctggtactgggcgcccctttactgaatcattttgaagactatctgcaattgatgagggcgttgcaccaccagctccccagattgggtgacaaagagtgtgtggtcttcatgggacacggcacgactcaccccgctttttctgcttacgcctgtctggatcacctgatgactcactaccactttccggctcgcgtgggggcagtggaaagctacccggaaatcgctttgattattaagggactgaaagccgaaggcatccgtaaagttcacctgatgccgttgatgctggtggcaggggatcatgccataaatgatatggcttctgatgaaagcgactcctggaaatcacagttggagaaagccggtatgacggccatcccttggttgcagggattgggcgaaaatccgatgatccggcagatgtttgttgctcatcttacggatgccatgaatgaaaatagccgggaggatgcgtaatgagcggaaaactgtatgtcatgggggttggccccggagcgagtgatctgattaccgtacgtgctgcccgtattctggcacggctggatgtcatttatgccccttctggcaaaaaaggcgttcagagccttgctcactccatcgttgaagaatatctctcacctgaaactgaagtgtgcacgtaccattttttaatgaaatcagacaggggagaaaaagaagtcgtgtggaataacgtcgcacaagccttgcaagaagaagtggcgaaaggcagaaaagtcggctttatcacactgggcgatccgatgctgttcagtacgtggctatttctgctggagcggatcggcaatccgtcgtggctggaaatcgtaccgggcattacctcatttgcagcgattgcggcacgtagcgcaatgccgttggcgatggaaaatcaaaccttgtccgttatcgccggtacggcgtccgatgcggttttggagcaagccttgctcaatcatgactgcatcgtcctgatgaaagtttactcaaattttgaacggatacgcgagctgcttcagcgtcaccacctcctgcaacacgcgttgatgatggctgatgcgaccttgccgacagaacagtactggcgccatctcgacgcattggagagtggtcaggagctatcgtatttctcaacgattctggttaataaaaactggcaattaccgaggtgagttatgcaacagaaactaacgaagttttcgttatctggtgcggctatcgcactgcttttagctctggcaccgcaggaagcgttcgccatgcatatcatggaagggtttttgcccccgatgtgggcagttgcatggtggctggcttttctgccttttttggcggcaggcattatgaggctgcgtcagattgtgcaggaagacagtaaccagaaagtgttgctggcactgtgtggcgcatttattttcgtcttatctgcgttgaaaattccctctgtcaccggaagctgttctcatccgaccggggtcgcgctggcggtgatcttgtttggcccttctgtcgttgcggtactgggtgcgattgtcctgctgtttcaggcgttgctgctggcgcacggcggcgtcaccacgctgggggctaacggcatgtcgatggctgtgattggcccgctggtggggtatctggtatggcgtttctcctgcaaaatgggcgtacgcaaagatatcggtgtcttcttctgtgcttttatcgccgatattgtcacttattccgtcacctcgattcagttgggggtcgctttccccgatccacaacttggcatgggggcagccatcatcaaatttatgggcattttctgcataacccagctaccgattgcggttgctgaaggtttactgaccgtgctgatttacgatcagttggtgaaaagacaattaattcaggctcgcagtttttaaggagtgttgaagatgaaaaagacattaatattgctgtctctgctgattgctctgtgcgttattccatttttcattgatcacggcggggaatttggtggtgcggatggtcaggctgaagcgcaaatcatggaaattgcgcccaattataccccttggttcgaatccttgtatgaaccggccagcggtgaaattgaaagcctgttgttcacattacagggcagcctcggtactgccgtgattttctatatccttggttattatcgccgcagccgtaaagatcatgatcggcattgataaactgagcgaccagagccgttggcgcaataaagatcccaaggcgaaattcgccctgtatctgctgtttatggtgctggcgatggggctatctccagtatggcaggccgtactgttattcggccttgccctatttacctgctatctgctgcggatcagcctgctgcgttacctgaaatggctgttgatcccgctggggtttctcggcattggcctgattgctatcgtattgtctgccagtttgcagccggacagcctgttgtggggatttaaagtagggcaatattggctgggtattgattcacagggtgtaaacatggctaatcagactctctggcgcagccttgcaacgttggcggcaaccttctggttcatgctgaatatgccctttgagcagatgattaagttactgaaattctgccgtgttccccacctcttgattgaacagatcctgttgacatggcgctttatctttatctttgtggaggaagccgccgcgatccaccgcgcgcaatcactgcgttttggttatcgctccctgcgaacggactaccgctcactggcgatgctggtcggtatgctgtttacgcgggtgatgagccgttatcagcagatgagtgtggcgctgacactcaaactgtatcagggtgattttcatttataacatggggaattgcggcttatcagataaaggaggtgaacatgctggcgacgcaggcactgtatttcagttatcaggatgaacctatcttgcaaaacctgacacttgatttcagccatcatcaagttaccggaattatcggagcgaatggttgtggtaaatcgactttgctgatgaacctttccggcatcctgcgtccacaacaaggcgctgtctggtgggataatgcaccattggattacagtaaaaaaaggttgatggcgttgcgtcagcgggtcgtcacggtatttcaagatccggatcaacagatcttttataccgacattgacagcgatctggctttcagcctgcgtaatctgggtgtggaggaggccgaaattcagcgcaggatagaacgtgcactgacattggtggatgcccatgctttccgcaacaagccgattcaatacttgagttttggtcagaaaaagcgggtggcgattgcgggtgcattagtgatggaatttgattacctgttgctggatgagccgacagcggggcttgatccttccgggcgtcagcaaatgctggaaatcatcgccatgattgctgccgggggtaaacggatcattatttccagccatgatatagatttgatctatcagatttgtgatggtttatatgtactggcaaagggtcgggtgatcagttcaggtaaaccagaaaccgtcttcctgcaaaaagatctgctggaacaggcaggtttggtgcagccgtggctggtgaaagtacacagtgaagccggattgcctctgtgcaaaacagagcaggcgctttttgctatcctgcatgcaacaaaggagaaacgacaatgacactatctctgatgattcagggaacggcttctgatgtgggcaaaagtgtgctggtggccggattttgccggatctttttacaggacggctatcactgcattcctttcaaatcgcaaaatatggcgctcaattcgggtattactgccgatggcaaagaaatggggcgggcgcagatatttcaggcagaagcggcaggtattgagccggatgtgcgtatgaatccggttttactgaaacccaccagcgatcgtaaagcgcaggtgatttttatgggcaaagtagtatgcagcatgaatgccgtggaatatcacgaatataagccacggcttcaacagcagattctggctgcctatgacagcctcgcagcggaaaccgatattatggtactggaaggtgcggggagtccggctgaaatcaatttgcgtgatcgcgatatcgtcaacatgggcatggcagagttggcggatgttccggtcattctggtagcggatattgatcgtggcggcgtgtttgccgcgatctatggcacgctggcactcctcaggccagaggaaagagcacgggtcaaaggcgtgatcatcaataaattccgtggcgatccggctttactgcaatcaggcatcgatcagatcgaagagctgacacaagtgccgatattgggtgtgctgccgtggttggatctcgatttggaagatgaggacagcgtcgccttgcaggtcggcaaatatgctcactccggcaagcacacagaaaattggctggatatcgcggttatccagtttccgcatatcgccaatttcacggatttcaacgcgttggcggcacaacctgatgttcatctgcgttatgtctctgatccttcagcacttcacggatcagatctgatcgttttgccgggcagcaaaaatacgttgggtgacttattatggttaaagatccaagggcttgatcaggcaattatcgccgcgcaccagtcaggtatcccgattattgggatttgtggcggctttcagatgctgggaaaacagatcattgatgaagttgaatcaggcttaaaccggatggccggcctgggattactggatgctgatactcagtttgccaatgaaaaacacacggcacaggttaaaggcgttgtcatgcctgagctgacggggatgctgaattcatgcagcgagcagccgattgcgggctatgagattcatatgggaatgacacagcttggcgagcaggcatggccatttgccaaaatgcatctgcgtaatggagaggagacggtctggtttgatggcgcagttaatcagtcaggatcggtaatgggcagttacctgcatggcctgtttgatcagaatacgtttactcgcccattactgaaccagcttcgtcgccaaaaaggcctcgcaccattagaaaatgtgatgttcaattacgtccagcacaaagaaaaacagttcaatattctggctgccagtatgcgtgagcatctcgatattgatcgtatctatcagttaatgaaagagcatgaagagcatcactgattgcaaaaacaaggcgtatcgtgtgagcattgtgactttacggagtttgggatcacaaaatgattttggtgacgggaggtgcacggagcggtaaaagtgcctacacagaacggcggattgcggggcagtgtgagcaggtactttatattgctacggcgcaggttacggatgaagaaatggcggctcgcatcgagcggcatagacaggaacgcccttcacactggcggacttgggagggttatcaagacttggccagcgtgatccgccagcatcggcaacccgaagagggcgtgatacttgaatgtgtaacaacgttgactgccaacctgctgtttgacgaatcggcaggggcatcacctgatgaatgggattttccatcattggagggatttattcagcgtcagatagatgatctgatcgcggcttgcctgcattgtccggctccggtgtatttggtcacgaatgaagtgggcatgggcattatgcctgaaaatcggctggcgcgtcattttgtcgatatcgccgggcgcgttaaccaaaaactggcgcaggcggctaaagaggtctggctgatggtctcaggggttggagtcaaaatcaaatgaagctgaatctcttttgggcgacattgcaatttatgacacggcttcccgtgcctgtaaaatggacggagggggttgatttcagccagtattggcgcggcgtaccgaattttccggtgattggcctgattattggcggattggccgccctgatttcgctctcgattagtcaatccggcggcggtatgtatatcggtgccattggctatgtgctggcattggcactgttgacaggcgggttacatttagatggtttggccgatacctgtgatggccttttctctgcccgccggcgagaaacaatgctggcgatcatgcgcgatagccgtctcggtacatatggcggtctggggttaattttctgtcttttccttaaggttttcgccgtagcagagctttcttatcatccccctcttgagctatttgccttgctgacgtgcgcaccgattgtcgggcgtacggccgtcgtgctgctgatgtatgaacagcgttacgcccgtgaaggtgaaggcatgggaagcagttatattggccgaatgactccgcgatcgactgctctcacgcttttaggcggtgcggtattggttatcgcgctcggagactggcaaggattaatcgccatgatggtgacattgatcgtcatttatggattggccttctattttaattatcgtcttggtggtcagaccggcgatacgctgggtgcttcaattgaagcaggggaagtcatttttctgctggtcatgatctgggaatagattgggtgatcaatctggagaaaatcatccaatgcggctttttctcgttcgacacgggcaaacggaagccaatattaacaacgttttttgcggcagtacggatctgtcactgacggggacgggggcacgttggttgtctgactggcaaaatgccgacagaagccatgtggtcttttccctttcagcaaggtgcttatagcgtcgtcgataatcacattgcgtgtcttcaatggacgggcagaatatcggcctgaagaatagccaggatgatacacatgactcttcaatctttacttgatgcaatccagccgctgaatcaggcgaaaatagaaaccgcgacgcagcacattgacagcctggtcaaaccgctgggcagtttggggcgtcttgaagcactggcgatccagctttcaggcatgccggggatactggatcttcgcaatctgcaaaaagaaatcatcgtcatgtgtgccgatcatggggtatatgacgaaggtgtggcaatctcacccaagaatgtcacggcgatacaggcacggaatatgctgcaagggataaccggggtctgtgtactggcaaaaaacagcggtacccatgtcttgcccgtggatattgggatcgatggtgatccgattgacaatttactgtccctgaaattggctcgcggctgtggcaatattgcacagggggcagctatgcaatatacacaggctgaaactttgttgctggcgagtgcgcaactggtgcaacagcgtattgccgcaggggtgtccgtatttggtgtgggggagctgggtatcgccaataccacgccggccgcggcagtcatcagcgtgctgacgggcagtgatccccatgatgtggttgggcagggggctaatttgcccattgagtggctgatgcacaaaggctccgttgtgcatcagtcgattatcgtcaatcagccgaataagaatgatgcgcttgatgtattggcaaaagtaggcgggtttgaccttgtcggtatgacgggagtgattctcggagccgcggcgtcaggtgttcctgtcgttcttgatggttttctttcttatgcttctgcattggctgcctgccagatggcacctattgcacggaattactgtattccttcacatctgtcagcagaaaaaggctcagggctggcattacagcatttgcgtctgcaaccttatcttcatctgggtttgcgccttggtgaaggcagtggagcggcaattgcgatgtctttgattgatgccgcttgtgcgatttactgcaatatggggcaactggcgagcagtgggatcagtttgccggagcagagttcgaaagggatttgatatggctgcgcactcgggaaggtatggctattacccgggcaaaaggaaaactacgaggtaaacaaccaaaattcttggataagcaacagaaagagctatgccgcatgcacggaatggcggagtactcaacgatctggctgaactgttttcagtatcgataccaactgtctatcagactcttgtatgtacaaataatatttaagagtagattatgctcagtaataataaatccaactatgatcagtttctccggagtattcatgcttaaattttattctttagttagtctattatggttatctatttctgcgtttgctcactcatcctctgcggtcggttttaaagaaattgacctagtgctacagtcgtaatttatttgtaatcagagggttatctcggtgacgataatgacattgttgtgcatagtattggtgtcgccgccgccagtatgaccaatgtaaaatctgttcgactgtctcccccgttttttccatcaattctgacagcaacttacgcagttccgagacactgagggctatcagcccctttgccgtttttttctcccgtatccgcaaaatagtcacgagggcggatctggaaaaaatgcagggcggtgaccgcatcacggtgagcggtcagcaggaagtcaatcgtctgaccgtgggtatcgaccgcccggtaaaggtatttccactgaccttttactttgatataggtttcacccatccgccatcgcagccactgtgaaaccaccctgaccaactaccaccaaaccccttcctgtttacgcacggatccttaccgtccgccaataacgttgaagtaaccttggagaattgccattctaacaaaaactccgttctcagcctgagaaaaataagcacaatgtactgaattatctaactcataaggaagctcataacctcgaggaagaggatgcataattatggcgcggggatgtaagtgtgaaagtagatcaggagtgagcatcaaattggaattgggtaaatgatctgctgtttctctataacccgccatataaataacatccgcactacacaacccctctttgatgttatggagatattagtaggtgacacccgcttgacgaaggtacgcttcgtcttcttgaaaaagcttacaattttcttcagtgcaaagtaataattttatattgtgaaacagggcgatacagaagagaagagaacgcgctgatcgggaagaggggtggcagcataataataaagttaatgatttatgaagagggaaagattgatgaatggtaaaaatatcaagcaaagcctgcgttggatgctctgcatttaatccttcaccatttcccgcatttataactggaaggcgactttttatacaatagttatgcacaggctcaacttcggcgtggcgtataacggcaatatcggcatacgcattgatcatttgtgcagtatccgtaaatttttcattccagcttgaaccagaacggcttgactcaccatcagcaaaacctataactcttgcaccaagacggttggctgcgctttcaaaactgaggcgagttcttgtactggcctgaaaaaaaagtgaagcaacaaggatatcttcatttcttttttttatttttttatcaggttttgatactttaaaattctgagccagatctataatattcattatagtgtctaagtttaatgatttaatagagagaaggttatcctttagaaaaaaattttgcactgatatcataactcacctccggattttcatattaatgatatatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtatataccaatataagttaattagattactatttttgatttagtgggcctgattttaggcccactgattgtatgatcaaatatccgactgtgtaagttgttttatcaatgaaacaaattcaggcagaagttcaaccaataaccctatttgttgtaatacaagttgtattttgccgctgctatcagaagagattagattgatgctctcagccagacgctctgaaatatgttgcaggcgttcatcatcaacccgcccttgctgcaatgccgattcaacctgaaaaattgcatcattcagaatatccagaatgacctgattattgagcctgtcacgatgcgcacccaaagcagaaatataacttagcatcgtatggttaagacagaggaggcgaaaggcttcttcctgagaaacacggtaatttttgggctctgatgccatgtttgatattacggatgctaattcagcatcacaattatgggcatcacgacgggagatccgataattcaggctattactcttgccttgataatattgcccgacaatagcgtcaagataacggcaattggcgatcatggtccggttaatcactctcggtaactgacggaatttccaatctggccagataaaactgacggccagcaaagcaataccacagcctattaatgtgtctgtaattcttggcaaggcaacttcaaatccttcacccaataaattgaaactcagtaacaccagcagagtaatgaatagtgttgcatgtgcatattggatattacggaaggcgaaaaacaatacacctgaaatgataatcagtaccagttgcccttcgatggaaggaacaaaatagaggattggcaagccaatcaaaatcccagccagtgtaccgatgacgcgcagtgccagccgacgccgggtcgcgttgtagttaggctggcagacaaacaggctggtcagtaaaatccagtacccacgttgcagatcaaataattgaataatggcatagccggtacacagcaagaccgacatgcggatagcgtggcggaaaagagcagactttggcgtcagattactgcttatcctgaaccagacatcacgccagccagttaaggcttcatcggataattgagtatcctcttgcttaccactttgagacgtgttttggaaaagtggggattgctcagaattcagccctgacagttgagcatcaatcgcccgtaaatttctcagcaaattgtagaacgccataatttgggtgtcagcgccttgctgatttttcaagcgttcaagagaactttcaagatagttgaacgcattctcaaaacgtgagttatgctgatatggcttacgcagaattatcgattgcgagacttgttcacatgcacgagcctgcatggacagcaatcgctgacaacgaaacaaaatatcactatgccgaaaagtctcccgcaatttttgatactgaacatgagacgaactggctcgctcatgaatatcttgggcaacaaaataataatgcagtgtgtgacgcgtgccccgttgcccacgatcgcctttcagacggctcagtaaagaaattttggcttgattgagcgtggtaactaatgcgctgtttgccatggcaacatcaaacattgattgcttacattcttcagcttcggaatcagggtcaaacaggctggttttggcatagagatatgcagaaagctgttggtaacagcgtgccagattttcttgcaagggacgaatagggaacagtaaatgccccgttaatgtcagcaagttataccaaattgcacccgtgagtaataataaaggctgctgataccaaagaggaaatatcgacgtaccgagcatggtgtaaatagcaatcagtaaggcgccaaaggcgatggtagcatagcgctgtccaagggcaccgagcagaataaaactacaggtagataccgctagcccaaccatgaaaagccacgggtaaggaaaaagcagtgtgatggatgtagaagcggcaaagaaagaaactagggtaatcataaggttgcgcaggcggccaactaaacgatcatccagatccgttaatgccgcagcaacaacacctaatgtcagggggattgtcattttaggctcttcccccaataaccaagggacgagggtcgttcctgtcagtgcaataaatatacggatataatagaggacgtgactgttatacagaaaatgacgggagctggataaaactgttagcacaaaatactcctaacaacatttacgtgatcgagtagttcaacaatttttaggtacggtgccacgataatggaactcaaatcaacgcaaatgggccaacgccttgcccagcatccttataacagggtgcgtttacttaacgcgggtattgaagtcagcggtgataagcaccagtaccttattccatttaatcagttaatgagtattcagtgtaagcgagggattgtttggggggaactggaatttgaattgtatgacggaaaagttgttcggctgcatggcacgaaatggcagcaaacacagcacttttaccattatttattaaaagaatggcagcaatggagccttgatatgagtgatgtcagtgctgatgtgttggcggctcaactcaatgaaatcaataaaattacacagcaggatcgctggttcaaaactgcggacttgctctcattacagcagcaaattcaggaggcatttcaggcgctccctttgccattagcgcgaatcgaacaatttgagaactgtcgtgatgattatcgaatgtgtttggattggctgaatgagggaggaaaaacgattaaaactcttaaccagcaatggattgaacgcatattgcagcaatatgcagaatttttccaaactattgaaactacgccactcaatcgttctcaatgccaggcggtcgttaatggtgaaaaatctatattggttttggcaggagcgggcagcggaaaaacctccgttctaattgcgcgtgcagggtggctgttattacgtcaacaagcgcttcctgagcaggttttgctgctggcttttggccgtcaggccgctgatgaaatgaataaacgtattcaggaacgcttgggagcaaaagagatacaggcaaaaacattccatgctttggcattgcatattattcagcaaggtagccatacagcgcccaaaatgagtgaattggagacggatgcacagaagcgtcgtgattttctcatcaatgaatggcaaaaacagtgcagtgaaaaaaaagcacaggcgaaaggctggcgcgaatggttgaatcaagagctggattggcaattacctgagggggaatactggcatgataaacaactcacgattcgattatctgaccgtctggagcgttggctggagctgatgcgaatgcacggtggcagccaaaaagagatgattgaacaggcatctcctgcttatgctgacacattccaaaaacgtatacggcttatggcacccttgctgaaggcttggaaatcggcattaaaatctgagggtgctgtggacttttccggcctgatccatcaagccgtgaatattctggaaaaagggcgctttatcagcccatggaagcatattctggtggacgagtttcaggatctttcaccattgcgagcaaaattgttggcggcgttacgagtacaaaataaacaaagccatctatttgctgtgggagatgattggcaggcaatttatcgctttagtggtgcggaattaatgctaacaacagcattctcaacctattttggggaaggtgcggaaagtgcggaatgtactttggacaccacttatcgtttcaatgatcgcattggtgagattgctaaccgctttatccggcaaaatcccaatcaattgaacaaaccgctccatagcctgacaaaagggactaaaaaatcagttgtgattttgtcgcaggagcagttggaagcattgctgaataagatgagtggttatgtcacgaagcaggaaacgattctgttgttggggcgttatcaccatttcaaacctgaatttttgaaaaaagcctctacacgctggccgaatttgaatattgaatttatgacaattcacgcatccaaggggcagcaatcggactatgtcattatcttgggattgcagcagggacaagatggttttccagcgccggcaagggaatccgtgttggaacaggtattattgccgcaacctgaaaactttcccgatgcggaagaacgtcgccttttgtatgttgcactgacgcgggcgaaaaaacaggtatggttgatgcaggagccggacaatccgtcggtattcattcatcaattaacacaattgggtgtggcaatccaaagcaagctataaggtcatggaatattttcttaatcagggttaccacgtcattcctgtcagccctagattggcggattttgcacagtcggttgatatggttggcgtgtaatgaagaagcgaaatcactggcagaaaatacaggattaaatgttgtgatggattgttgcccaaaaattgagattcctcgtttggccatggaaaaatgaataaggcgatggttgtctactactcatcgccttactgggattgtttggataataacagggggtttaatttcgtaatcgtggagcctgtagttgactacgaatggattcagccaactcatctagagaagattgttctggatgatcatctgacgtttcataagccaattgagcttctgccagataggtatggactggctgcccatcatcatcttccattacaacgtgataccacggggctgaccgcaaggtagcattcgatgctatatcattttcctgtggctgttctaaagaatattcagcatcaatatctacaataacacctaaataacctagcagtttatgtcgtacttgctgaccgataccgaatttgctggcgatcatcatatagtcacctccaaagaaaccttgcaaagattcttatataagggcagtaaggtaaatttcaagtgcatacccggtaaacggaattttttgtaaccaaacaagatggcatgtgactgccacctcataatttcaggttagctgttgcatatataaaatacaatactaaaagtaggtttgacgtgccaacgttcgtattatcttgtcaggagggaggacgaaataatggctataaagggtatgactatttatgtttatgggcgggtacagggagtcggcttccgttatcaaacttattgttgggcaaagaaaaataaactagtgggatatgttcgcaatatgaatgatggtagtgtcaaaattgttgcttgtagtagtgatgagcaacttaaaaagctggcacattggctggagcagggagggccaccgggagctaaggttgagcactttaaatctcagctttgtggagtggaggaggagatgactgattttagcatccgtcattagcggcggatgctgataggtcagatacattttaccggttttgggaggcctgcaattttggttgcctgttttgcaggccccttaggaaacagacgatagagataacggctatttcctttttcctcaccatatttttgtgaaattgctttgactaacatacgaatagcgggagaagtattaaattcttcgtagaatttacgtacaaaacgtatgacttcccaatgctgttcggtcaaggtgatatcttcctgttcggcaagtagtgacgccatatcttcttgccagtcactgctgtttttcagataaccttgtgcatcagtttcgatcgcacgatctttaaataccaacataactctttaaccatccaataacgatgggagcaatttagcaaaaatcaccattattcccaagaaagatcgccaaatctgctgaagaaataagccaatggatagtaatgtgagtaatttgacggcagttgaacagataagtactttacattgagaacagtgatgtttatagtgctcgacatcgcggaggggtggccgagcggctgaaggcagcggtcttgaaaaccgccgatgggaaaccatccgagagttcgaatctctcctcctccgccacttctacttctcgcaacgtctcctaaagtcttctttcctcagtaaaatcaaagaaaacttcaatatctaactctcccaaggtctagcgtcgtcttcctaaatctatgcaatttgttgtatagttttttgtatagaaattccctctacaattttcctatacaatattggtgatttatgaagctgacagacatggcaatcaagcgagccaagccaaaagaaaaatcatatatgctggcggacggtaacgggctatctttgttagttgaaactaatgggtctaaaggttggcgctatcgttatcagttcacaggtaaaactaaaatgatatcgttaggtatctacccagttgtaactctcactgaggcaagagctaaaagagatgaggctagaaaacaggtagctaacggcatcaatccgagtgaggccagaaaagcggagaaagtcgcatcaattagccagtctgagaatacatttaaaaatatcgctctcgaatggtacgaaggtagaaaagatagatggtctgtcggttatcgtgacgacatgatggacgcattcgaaaaagatgtgtttccttatataggtgatcgcccgattgctgacattaaaccaatggaactactcgaagtgctttctgttatggaaaagcgcggcacaactgagaaattgaagaaagtccgtcagcgttgcggtgaagtttggaagtacgccattattacgggcagggcggagtataatccagcgccagatttagctagtgcctttgttcctcataagcgtgaacactacgcacatctttcagtaagcgagttaccagaattcctttcttctatagataaatatatgggaagccagattgttagagtggctttacggattcttatattaaccggagttcgaccaggtgaattaagaaaggctgagtggtcagaaattaattttgatattggtatatgggaaattccggccgaaaaaatgaaaatgcgccgccctcatatagtgccattgtctgaacaggttattgagttactgaaacagatacacccaatcagcggtagttatcaatatatttttcctagccgtactgattatagaaagcatatatctgatatggcattaaatacgatgattaggcgtatgggttatagcggtagagccacaggtcacggttttaggcacaccatgagcactatattgcacgaacaaggctacaacaccgcatggattgaagcacagcttgctcatgttgataagaacagcattcgaggaacctacaatcacgcccagtatttagatggtcgtagggaaatgctgcagtggtatgccgactacatggaaacactcgaacgaggtgaaaatgtgatacatggcaaatttgggaagagtatttaactggacaaatagacagttataattgtctttagtagactatccaagacattaaagaataaagctatgcctaggctgatctccgaaaactagtacacctctactagctggcatagctcctactaaaagagggcgagaggtgacgtatggatgttacatcgattgattttgatttaatcaattatcatgcaggagaaactcttcagttttactgggatataaggttgtgcatgttagcttctcgcacagtaagcagcgattccattgaggataaaatggaatcggcaaaaaaatgtgagaagattttagaaaagtttgcatttgatatgaaaattaatgagtcacataagattattaatgatttcatatccacaatatctattaatagagcacttgaattgcttggcatatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtatatttcaatgtttattcttaataaatataagcaattaaacataacgctttattatatcttttgaaaccataaagtcaattataagttattaataaaccttaatctttgaaaggagtaatataatggctggaaagatagatatacttcctgcaaccctctctaatattatcaaaggccaaccctttagggtgactgtaaccgtgagtggtgagacaaatattagtgcaaatacagaaattgatattgttagttcacaaggggtacatttaataaagaaattcccaggcaccgttgttaaaactaattttatccaacaaatgatatttcttgcagacgacactgacgctgattacaaaatctcgtttaccgcgaagtcagcaagcagtccaaaaggatcggtagactataaacctgtagaaaacccagaactgatccccgatagctgcgtgctaagaggttcatcatcttatctgtatgacccgagtcccgttggcttatcaggcactcctcctacatcaagcaatccattcattctggcgtcgatcaatccgatgggagtgagcggaggttcaatttcaaaatatgatattcagattcgtgccacaggtcctgtgcggatatttactgtagacgatgttgaaattttgccttatgaagttgatgatcaaaaacagtattatgactatttagtccagaaatcaacaaaatcggctgttaaccttaaaatatacgccactaccggtattgctcaattcatcgggtttgaaacaatattcagtcggagggtatacaatcaaaaacaagttatgtttattacgtcttctccaattgctgtttccgacgacttcgatccacccatcattgaggaaacatatcagtcctccactttaacaaggccagatcaacccgattatttccatttcatgatcccgcagaataatcatttacatcccggtgatttcatcatcggatttgtgacggatgatgataaacacatttataaaaaaaacctgatcttcggggaggtagcggttgccgaagatggatattttagatttaaagtggcttatagcgatatgtataacggaaccaattttatcagctatgctgctcttgatcagggaggcaacttagttgggtccgaaccgaattacatcagttatgatagtggcggcaataacaacccaagtcctaatgaccaaagccggactttagatgcaccagaggtacatgaccagttcggcttatttattggtatatatcagtcaatcaatatccacagtatcggtaacaaaggaattgaggtctggctgccagtagccgctaccgctaatgacctgaataaaatagccgagggtgattctattacgattaaagcctatatttcatactgcgtcgatacagaaacacccgcccgtcctctaccaattgtggtcactgaaaatcacattgtacaacagaaagaaattgatagtggttattataagcacaccatcgcggccgataaacttctcggttatgacacaatacagggggattttgaaggttcgatttcaatagactatagccgtcttgcccagaatcagaaatcgcaacttttcacccgaggattcgacacggttgcaccttaataacccaaatatttaacatgctgatagccactgttattagcatgtcccccttatcaataaaatggtttgttttgtgaagaggtcattgtatgcctataaagaaaaacagccttgttgcgccttttttaccacaaagttacgatggagccattgacttatcaaaattggatcaatccatactggtgataaaaataaatcactatgaggccgtccatattggtgatgttatcattgttcatctgaatcaatatctatcgtcaattctctattatattacaaatgcaaataaagattatcccgcttatgaaataaccatacctttttctacgattcctcttggtagctacaatattttctataccgtcaccgactgtgccggaaacacatcggattcggtaaccagcagcgtcacaattataaagtcagatccttcaccatttccggtaattgcctccctgaaaacggaagttttgacgaatgggatgccggccaatgattacacaccgaatgttgtactcatcacggccttagatgaaaaaaagaagtcggtatccggtgtgccaatacacattgtctccaacgataatatgagtattgcgccgtcttcctgtatcacagatcaggatggaaaagttgttttctgttcaacttcacgtgctgatggttttttctcaatccaagtatcatcaggctctacactcaatacgactgagttgtatttctcacctacaaatgaagcaatattagaaataacaggaaaagaacaaattagcgaagaatatgaaataattacaattcaggttcacgataaacagacacttaaacaaattaaaaatgcgaccgtctattataaaatagacttggctcataatatcaatgccgtactggacattggctataaccccgatacgatacaatccatgtctacagatgaatacggacaattcaaaataaacctaaaaggtaaaataggcgggtattgtattatatcagctacggccaataattatatcggcagcataaaatacaccaaataaaaattagggagatattaatcatggcaacgaaaaccctttcatttgttgcaataaaaagcgggtggtatgtctcatattactttatgaccgaagcgggttatgattatacaataacactaaccgataaaagcaccggaactatttacggtacatggacaaaaaatgaggatggcgatgcttcaatctataaatactccagctcatttgaatatacaggatcggatggagagcttatttgcgttgttgattgtccagaaagtcagaaacttgataattcctttagcgcaaatctgataacgccaagtgcgggatctccaacactgggatatacctattgtgcggcctttgaggattttggtggctcaattgattataatgacttttttgtctgtctggtgggatggacccatgaaggataaatacctgtcttaccatcagtgaaacccgctgaaatttccatcgtggggaattatccccacggtttttgttagtgacagtggcactgatttaatcaccatgctctcttgatgccaattttggccttcatatcgtagctatcagcaaaattattcaggctagaattggctgaaatttcaccatggatgagatatttgccattcccccaactgtaagagccgcctgtccccatgcctccccaagtgcggtcgttaccactgataaagccaacattggcaacgtcagtcaagtcactgcgccccaaaacttcctgatttatattgataaagccatataaatgggtggatttttcctctttactcagagagtcgtgccacttttgacggtaatctattgtcgtgccaacacggagtttcatacttttactttggttaaagtggattctggcaccaaacggatcatggaatccgttcatattaacagaagagaacataagctgtgcttgtggagtcagtgaccatctcggactcaaatcaaacgcttgtcctgcttccagactcaaggcatatcccagggcggacttattattgcccaaaggctggctggccgtctttgaattcaggtcattattaaagtaggtcacctgagccaacccatccaaatagaactgattcttgctgtaccacgtactggtcgccccgaccgtgtaaccctttgcccgaatgtcaccttcaccatgcacagagccgactttggcatcaatattcgaatattgtaggaaaacgccgccatccaaggagccttggttattttcataaaaacgtttgtccatacctatctgagcacggaacaggttataggtagtcgcatcagcacccgatgttgtcacacgtggcgacaatttaccgtgagaagcggtcagccgtccccataccccattgggcgtcgggtttgtactctcgtctgtactgtctttaccctcggcgcttctgaactcatctatgtcaggcaacggatattgacgtcctccaatccggtcacgcaaagattccggcgcattcagtgtctgcaaaatccggccataagtttcgtaaacgctaacccctgcctgataatgttgtgccggttctggattgggttttgcacgggttaacgacgatcgcaaataccagtttccatccgaattatcagtgccattcttatagagacggtaggcataggcacccgcgacaatggcggggtctccctgataatgatagtcagccactaaattgaaagttccgtccgatgaaccttgcacatcaatcaccttgataccttcctgcgtttttgcgcccgttccgccgacatttttgatcgcgagctgcgttgtacctgatgtactgccattcaccacaagtttgtcagtctttgagttatcagccgccaatgccgttgataaactcaccgtaccgttattgccactgtaatcacccgccactgtcaacatacgtcctacagtttgattatctccgccaaccagcactctgccattgttacttaacgcggaaattgttgtattaaatccccccatatcaagcgtaccattctgtccgattgtataggaagaaaccgtgctgaaagccgcctttgcgccttgacgaagggttcctttttgtatttctgtcgtgcctgtatagttattcccgcccgtcagaagagttgtaccgcccccgttctgaaccagatttcccttgcccgtgatatgaccgccaaatgtcactgtatttgaacggttaaaggcaagcgtacctttatctcctgtgacaacatccccagagatactccccgtagtgccgccgtcaccgagctgaagaataccctgtgtcactttcgtgccgcctgtgtaatcgttcttcccttttaaaaccagagtaccgtaatcagtggtttcaagtgtcgctgaacccgtcaggtttgactcaatcgtggctgtactgcccgccgctgactgattgccggtgccgacacggattttggcactgcctgtattgtcattttttaaaagcagcggggcgccggtgagggtataaccctcggtgccaaattgcataccattgacggtgacttggccaccgccattatcaacctgcacctttcctgcggtaccggagaagatggcaaactgatcggcattgctccaactggcatttggccaccctgtttttgacgtccagttattccttccaccgacctgccagacgccgcttcccccgtcaacaacaccattgctatgtttgccggcatctccgccatcccaatagttcagaagcatgccgcccgtattggtgaggtaaactttcttgtctctgctcgtatcgagagagagagttccgggttctccgccagtgagcgtcattcgattgtttgttaaggtgccgccataatggaagatatcgtattcacccgctgagaaaccaccaaggttggtgacgttaagcgtgcctgccaatgtcaggttgccacgcacattaaataacgcagacgtagaagtctccgccgctcccagtgaaataccgacatttgcaccgtggccaagaataagatcatgaccaaatgttaaggtatcaccctgcttgccgacaaggtggcccccgttttcaatcgttgcagtgccgcctattgtgccggaaccattaaccgtgcttccatttttcacattaaaggtcgaagcagctgtacccagtttcccgtcaacgataagggttccttcctcaacacccgttgaccctgtaaagtcagaggaattcgagctgagtgttgtggtgccagcaccaatcttcccgagatgaccattgccggaaatcacaccgtcaaaacggtttgttccattcaaattgagtgccagagtaccttcagacccgatggcaactaagcgagtgtccggcccattatttcgggtgttaaactgtaacgtgccagatttgatattagtttttccaacatacgtattctgaccactcagaatagtcattcctttaccaacatgctccacacccccagtaccagagatattattggaaaaggtaatattgttattatgatcaaaagccagcaccccagactgtccgattgccactctggaagttttatcaatacttcctgtcgttccgttatcaccgagttgcaacgtccccgagtcgatttttgtctcgccggtataggtattttctcccgtcaaaagggttgtgccactccccacttgatgaactgagcctgttccgcttatgatatggctataagttgttttatcgctgtggttgaaattaaggcggccttcattatttatgtcactgaagatgcttccggttgtgtgtccgtcacccagagttaacgcattttctgataatattctaaccgctccggcattcatgttgtgagtaaaggaaagattaagatttttggtcatagcatcttttgaccctatggtgacaaccgaatctttcgtcccagaaacattgcctttaaggattgcattcgggccagacatataaaggctggcgcttccaagctcaacatcgccgtcaatcgtgcccgcattatcaatgccgttgattaaggttcccttattatttatagaaaatttatccccttgtatcactccaccatctaaattcgttatagtatcaacagttcctttatcgtcgatagaaatgccattgtgctttccacgtatgaacgaagcgttggtgatttgtttaatgttggatgattttttttgggaatcagacgtgtcttgcccggtgacctgaatggcatcctgcccagtcatgatacctttactcccggcctgattattgacgttttcgagatagcctcctcctgtaattacaatgccatgattgggtccagtcactgatccatagttattaaaagtgccgacatgaccaccactatcaacaatgagcgttccgcccgtagagccggcaaaattcacctgagatgtcaacgtcccatgattatcaagcgtattaagttttgccattctgacagatattccatcaatcgatcccccctcccggttaaaaatggtatcaatacttccttgactgccattcttttggttcaacgcctgactgagcatgactgaatagagtgcggtatcaatattttcggctttgattacgccataattatctaacgtattcatatggccagaaacccacacacctcctgaagcgccacttatgacaccatgattaagcagctttccaacagaaccactataagttactgtaattccactgtctcctttcaaaatcccgtgattttcaatgtgatcgatagacgtcacaggagccacatcattgttaccaccaacattgaccgcactttttttcaggccgtatctatccgagttatctgtctgcccttgaggaatatcaatggatgcactttgattaatagtcagattttcgccatttgataaattacagggttctgcctcattatcagaaataatcgtcgttgtatttgaagaaccgcatgatgaagcggctattgcattaacacttactccaggaaaaaacaaagctaatttaatcgcgataggcattaaagcttgcttgcatatcttcataagtaacacctttagatagcctcaaggttaatgacattccagttgtcttgattgcaataacttaaccagaaaaagtagacaaatcagctttattattgttaacaagtcataaaaagtctaataacacatttttccacgaatgaggacagagttgaccaattcatcagaaccccagcaacggcagacgacggtgtagacaggtactggcaatattgatagcaaaatgaaaatggtcgtcagctcccgctaacattgcgtggcagcacctgttctttaccggtcggtacaacttcaaaaaagcgagatagtggtaaggccccattatgacctgatatactaagttgaaggagatgtattgacggttttacgtgtactggttctgtcgcattaataaacctgagatttgtttaagaagggaactaaagggcaatgtcgcgttaacggtgacaagttagcaaaagtggtgttgccggttatttaggcagccagtaaatagaattgttcgagagcataaaaatctatggttcccctcttttttgggtcgtgtattcaacctgttaattggccatcaataatagaactcacgctcgatgaatgtaccaatgatcttgtcatgcatttcaactgacttagaataacccagcgtcttgcgattgagtcgctttagcctgttacgcaggttcagattttctcgttcaatacgttgagtataaagtttaccggtgacatgtttctcatcagccaatatgtcatatgccccgaaattatcggtgcaccagaatgccacatcaaaagtggataacttttccagcaacgtcctgagtgtctgtttgctacgagcgccaaaagcgtgagcgacaatacgtttcaagcgaggctcccacgcgtaccacagccagcgttgccgttttttgttactgatgaatgaccccatttcatcgacttcacagataagctgaagctcaggggtatccagcggcagcgtggttacacatcgcggcgcgagttttttaaagtgcgtacaacagcgttaatgctgacatgaagtgcccgtgccgtatcacgaataccggcgttattcatggcaagcttgacgatttgctctttcatacccgaatggcaagcccggtaagtgtattcgagctggaaggttctacgacaggactggcaataatatcgttgatgcccaccttctcctttaccgtgttttttaacagacgtggtttggtcacaaaaccgacacttcacttcaactaatgccatcactatccctcacgtatttactctcattatacgtgagggatagtgatgaatacgtgactttatcaatttagtggtgtaattttggtaagatgttgaagttaggtttcaatgacttaatatactgtttttataatgaaaactactgaggtgacaaatgttgaatacctttccaaatcgagggaatatgcgatttttggcaaattttatttcaccattagctgctcgtattgtattaggtaggatgctgtcagaagggatcaacgctgaattgattgatgaaaatgtagtatggaacaactatatgtattcacaggcgttaggtggcgttaaattactggttcataattcagatattgaacgggcaaaaaacattattattcaaattgaacaaggttgttaccaattggatgattctaatgagaattcattagtgtcaaaaaataacgtaactaacaatatattaaatacttttttctccatcgcattatttttgattacaggtattgcgataccgtttaagccatcattgtagtacatatttatggataatttatgtcaaggaaaagggggcttattacaccactcatctttggttatttcccacagttcagaatcatatgtacctgacacatattgctttttactggtgctgatcaagcgcattccctgtgctaatgaaatttttctcgaattttcattaatactggctttgagtgttctgagaacggttcgatccaactcattaaaccagtaatcagtgacccttttgctggcttctcgcatcaatcctcggccgtgatattctggagaaagccagaaacctcgattgttgtccggtttgtcatataacccgatcacaccaattagctcatcaggattacttttcattctgattgaccatatccatgctttttcagtttgtatttcaggcatagcaatgtgattgacaaagtatcctgcaccattatccggatatggccaaggaactgcattgctgtctaaatacttcacgacctcccaatgagggaatttttgctgaatttgaggggcatcatcataagctaattttcttaatagcagtcgttcggtttccaagttgtcaaatcgcataatcattatttttgtaatcacaatgtttgttaaatgtaataaagacaataaatttagaactcggaatagtcaatccagtatcacccgtaatccgataaaaaatatgttatagtaagcctctaaatttccctattcatcggaatgttatgtcttatcaatgccctctatgtcattcaccattactgttcactcatcatcaatggcgctgtgaaaacaatcatcagtttgattgcgcgaaagagggttacgttaatttgctgccagttcaacataaacgctcaaaagaaccgggtgacagtgttgaaatgatgcaggcgagaagggcgtttttacattctggctactatcgggcattacaacagaaaactattcagttgcttgacaaatatttgccagagggcgccggaacgttattggatattggttgtggtgaaggctattatacggctgcggtacaggcacagttgaatctccatcgggatatgacggtatatggcctggatgtagcgaaaatagcggttcgttatggggctaaatgttatccaaaagtcaatttctgcgtagcatccagccatcgtctgccatttgctgatggctcgcttgacggaattctgcggatttatgctccttgcaaagcgactgaattagctcgtgttgtaaaaccgcatggcattgttttgacggttacacccggccctcgtcatttatatcagctgaaggaattgatttatcaggaagtgaatttacaccctgaaaacaaggaacaatgggagggatttgaattaatttcgacagaaatgctggcctatgcaatgccattgggtggtgagcaagcccataatttattgcagatgaccccttttgcctggcgggcatcagaacaggttaaaactaatttgatgactgaaaaactatttaattgtgaagctgattttacgctaaaagtttatcggcgtatttgataatgatagtttgattcggaatagatataggaagatatctattccggaaagataattatgctgcatacataaataatttaagatgctcaaataatatattgaatccaatgataattaatatcagaccaccaatcaattctgcccgtttgcctaataatggaccaatatagcgcccaattaacattcctaatgtagccataatcatggttattattccaattgtcatggcggtatgaaaaatatcgacctgtaagaaggcgagaccgacgccaattaccattgcatcgagactagttgctattgcagtgataattaatgtcattgaactatggcggcgaggagtagattcaacagtagtttgtgcatcaattttcaagctttcaataatcatccgacagccaagcatgaacagcagtgaaaatgcaatccagtgatcccattccataatatattggctggcataaagtcccagaaaccaaccgattaaaggcgtgcaggcttcaaccaaaccaaagataatacctgtgcggatcgcttcacggaaacgtgggcggtgaagaacagcaccttttcctactgcggcagcgaaagcgtccatagatagtgcgaatgcgagaatgagtgttgcgtagagattcatcaacatagcctcggctgggtgattccatatacacataacccacacccaaccaatggtggtgtcatgtgtctatggtcttgccaaccgattcagagcttatttttgttagactcttcaggcactcgtaccacgttttgttgaaaacgagtatgttgatacgaattttccaaaaatgttttggaacaggctactccccaatgactgaaagtgacaataccagatttaaaataaaaggcaaaaaatatttagttatatattaaaagttgttattgataatgcttatcattattcatcatgattgagaaatgaagctaatattaattattcgcctcatttaaaatatgggtatcgatgaggaataataatattatttattattgataaggaattgatagattttttctaaatcatctagtttacttacagtaatatagatattatttttttcaaagcttatcattaaaataccgtcttcagatagattcattgcgtttattttttcatattgaaggaaacggttggcgtaataaaatcctttatttttgaaaataagtttaggtgagcgaatataacctaaatatattgtaaacaagatgataaacaacagtaaataggtggttaattgattgccttgtacgataacattattataaatgacgatggaaatcagaacgataaatattaaggcgtcgatccgatgttttctttttaattttatatttaatagcgtttttcctttgagctgattaataataaattcatcataaatcgcaaaagcgaacattaataaaatcaatattatcaatatgatatcattgaagttcatttcaaatccttaatttttatatagctaatggtttttttagaatatgtttgttcttgcaataaagaaatgggggaggataacctccccaaatacgaaaataacgtagagaaatcaaacttagccaaggaaaccaaaacgaaagcccacgattcccagaatgaaaaagcccatgatgatccacagtggattgacttttttccgcagcagccacatacagccgaaagtcagcaatagcggcatcaaaccaggcattaattggtcaaggatagtttgaactgtggtgacttttattacgccagtggtaggatcgggtacttcagaaactaccagcggaatattgactttagtccatttattgactagcgcgcccatgacaaacaggccaagaattgacgctccttctgtcattttttgcaagaagccgccgcccatatctttaacgatatccaagccttttttatagccgtaagccacaccaaggtaacgggtgagcaatcgtactaagttatacaggaagaaaaatagaattggccccatcatgctaccactcatagcaattccggcaccaagggcggcgaaaactggacgcacggttccccagaaaatcgggtcgcccacgccagccagtggccccatcaagccgactttgatcccgttgatggcaccgtcatcaatattggcaccattggcacgctgttcttccattgccatggtgacaccaaggataggtgctgccacataaggatgggtgttgaagaattccaggtggcgttttatggcttgttttcgttcctcagtattttcaggatagaggcgacgaatggctggcaccattgagaagcaaaaacccaatgcctgcatacgttcaaagttccatgaaccctgaaatagattagaacggagaaaaacaccccggatatcactttgtgtcagctttttctgacctatgtttgttgtatctgacatgttgttcatcctcttaatctaattcgttatcaaggtcatttgaagtattgccggcagaagcggctgcttgtgattggttatatttagggctaagttggatatacaggatagccataacaacgccaatgacacctaatgcaacaaggttgaaatcagtaaaggccgctgtgacgaaaccaaggtagaaaaagggcatcaagtagccagcgcgcatcatattaatcaccatggcgtaaccgacaacgacgatcatgccccctgcgatattcaggccactggtgacaacctgtggaatcgcgttcagcatgctctgaacttcagacgtgccgactgataatgccacgactaatgcaggcagggcgatacgcattgcttgaagcgctaaagcaaaaatgtgaagggcgctgattgcacggaggttaccgttttctgcggctttgtccgccgcgtgctggaagccaacggtcagggtacggacgataatggtcaatacttgtcctgccgccgccagaggaatagccagtgcaatacctgcaccaacatcttgcccaccagcgataaccagaatggttgaaatgatggaagctaatgctgcatcgggggcgattgctgcaccgatattcatccagccaagggcaatcatctcgagtgtaccgccgatgatgatgccggttttcatatcacccagcactaagccgactaatgtacaggcaaccagcggacggtggaattgaaattcatcaagaatggaatccatgcctgcaatacaggcaacgatgaatatcaacaaaagttgaacaacggtaatttccattgtttttctcctgtaaccaaatggaatttggttagaatttcgttattgagtaatggttagtaaaatagcatctgtctttttttaagcttttttaagcttttttaagcagatcaatcatattcaagcgggtatcactggaaactttacgagcttcaagttctataccgcgggaatttaatttctcgaaagcttcaatgtcagcgctatcaaccgaaatggcgttattgatctgagttttgccctgacggaaagccataccaccgatattgatggattcaagcgaaacaccgccttcgacaatacgcagtacatctgtaggatttgtgaacaagagcatgacacgctcacccgcatatttagggttgttgtaaacacgaacacatttagcaacgtctatcacatgagcgctgacgccaggaggagcaacttgtttcagcaaagtagagcggatggtatcttgtgccacatcatcgctgaccacaatgatgcgtttaacattggtttcttttgtccagcgagttgcaacttgaccgtgaataaggcggtcgtctatgcgcgcaagggcaattttcatgtgcccgccacctgaaacggtaggtgatgaagcgggagcaatggttggtgctgcgggtttgactggttctggtttttgggtttcttcagcttgttctgttttaagggcccggataccttctcttcctgtttccagtgccacagaaaccagttcttccattgatggattatcgtcacggcacatgaaggcttcaaccagcatggggacgtttacgccagtgatgatttcgtagttgtttttatcaaccacgatacggttagcggcattgaatgggctaccaccccaggtatccacgaaaaataagacaccttgctctgtattaagtgattccagtttctggttgtatttgtcgaacaatgtatcggcattttcaccgggtacgaagtcaatataagaaacgttttcctgttctccaatcaacatctctgcggtatgaagcagttgctctgccgcagccccatgtgtgccaatcataatggctatactcacttgtttttcccctttctgtaacaattgaactcaggtctactgcaagcttactctcaatatttctaatgtattgcgcctcctattaatcaatatgatagttgcaaacatcatgtcctatcgaaaatctatctcaactatttcatttctcatggctttatattttgttacataagaaaatatatcgttagattatcatttgaagcatttaagaaaattgctatcagtcagaaaaattaagatgggctgttttgatagatgaaaacaagattttcattttattttttattaaataatgaattttagttctttttatttttgtttgaatggttcattgaactgttttcggtaacatttcattaatgtttgtataaaaaaaatgtgatgtttagtggagaatagagaaaataatgtacttaagtgatccgtttcagccaaaaaaatatccctgctatgcagcagggatatttttctaggtaaggtgtgtgcgctaataatggataggaagaccactcatcatggtgttgatgaacggcatctgtgattaatcacactgaactttaatcgccaaaccaccgcgtgatgtttcacggtatttcgcattcatgtctttacctgtttcgtacatagtttcaatgactttatctagcgaaacgcgtggttcgctggtacggcgaagtgccatgcgagacgcattgatggctttaactgaagcaatcgcattacgctcgatacatggaacctgcacctgacccgcaactgggtcacaagtcagaccgaggttatgctccataccaatttctgccgcaatgcaaacttgctcagggctcgcacccaacaattcagcaagacctgccgctgccattgagcaggcaaccccaacttcgccctgacagcctacttctgcaccagaaatagacgcgttcatcttatacaggatgccgattgcaccagaggcaaggaaatagcggatataaagatctggtgtaactggctcgatgcagtggttgtaataagccagtaccgctggcacgatcccacatgcaccattggttggcgctgttacaactcggccacccgccgcattttcttcattgaccgccaatgcaaacatattgatcaaatcaaccacgttcattgggtcattggaaaaattatttgatgatgtcagcatacggtgcagagctgcggcacggcgaggcacacgcagtgggcctggcaataggccttccgtgttcagacctcggtcaatacaggcttgcatggtattccatacatcggcaaagtattcgccgatttcttctttactatgcaaatccagctcgtttttcatcatcaagccagaaacagacagacctgttttgctgcaattcatcagcaggtcagcagcagagctgaatggataagaaactggtttggtatcttgagagggtttgccgaaatgttcttcatcaacaataaacccaccaccgatggagtagtaagttttgctgtaaattttttcgtcacctgcgaatgcatgaacctgcataccgttttcatgtagtgacagattatcgctgcggaagttcatacctccgtcacgaggaaaatcgacttcatgtaaaccatttgccagcggcaaacgttgagtttgctcaacatcacgaataaaaccaggaattgaatcaatatcaacagtcgcgggcatgttacctgccagccccatgatgatggcgatatccgtatggtgacctttcccagttaatgaaagtgagccgtaaacatcaacagctacacgcgtgatagaggacattactccttggtttacaagatcatcgacaaattgttttcctgctttcataggaccaacagtatgagagctggatgggccaatacccaccttaaacatgtcgaaaacgctaatcacgccagactcctttaagaagaaagagatatagttatttatattaaagcgcgctactttactgttatttagtagcgttgataaaggagtttacagtttttttttaattataatagcaattgatatgaatgtggctaaaaaacgcacattttggtgatgctttgcgattattgttagaccgatctttgaacttgttgtgccagccgataaataatagccgcagttaatccccaaatcatttgttcacgataccaataaaaatagacccggtgctgtcgattgcggatttttatatctaaatgttggtagtggggaagagtgagggcatcaaaaagtggaatttcaaaaattcttgccacttctgttggatttgtccgaaaagaaagagagggagagactaacccgacaacgggagtaacacgatagcctccactgctgtctaagggggctagctgccccaatacttgtactttgtgatgtggaatgctgacttcttcttctgcttcacgcaaagcggtggcaatcagagaatgatcttcgggatcggtggctccaccagggaaagcgatctggccggcatgtgaacgcaggtttttagcgcgctgggttaacaaaagtgttggctctggcttacagatgatcggtagcaatacagcagcatttcgctggttgctcgccaaatttgctggctgcgcaggaagttgcaattgaaaccgatgaatgaagtcagaaagcgatgtcatggtatatggagttctcctaattgaggtaaaatgcgccccagtttatcaaatgtttcctgatattctttttcagcaatgctatctgcgacgataccacctccagcccaacagtaaatttttcccttttctgtcagtaaggtacgtatggtgatattgctgtccattgtaccgcagaaactaatgtagccaatggcaccgcaatatccatgccgacgatgaggttctaattcttcaatgatttccatagcacgaattttgggtgcgccagtgattgaaccacctggaaaacaggctcggagtaaatcggtggcatgatattcatcaggtaatgtcgctgtaatggtactgaccagatgatgcacagcgggaaagggttcaacgacaaacaattcaggaactttgactgagcctggcgttgcaacccgtccgatgtcatttctcaataagtcaacaatcatcagattttcagcgcgatctttacgggagttagccaattttttggcttgtaaatgatcttcttccggatcttgcaatcgtggtaatgttcccttaattggacgcgtctggattttcttatcttccagtaataaaaaacgttcaggcgaaacgctgataatgcagttttcaggcaaacggataaaagcagaaaagggagcgcggttactatcattgagttgggtgaaggcctgccattcatcaccctgatagctggcatgaaagcgctgcgacagattgacttgatagcagtctccatcacgcagatagcgatgaatctgggcgattttttcgtggtattgctgagcagtcatattagattgccattgactgctcagggagaaatttgtttcccggttttttttctgcgattctagccatgccagacgattatcgagattgtgataacccagtaatgttgctttctgttggtgatgatcgatgatcagagcccagtcgtaaatcccaacggccatatccggaaaatccagttcattggcagcaatggcaggtaatttttcaatcttgcggccaagatcgtatccccatagacctaatgcacccccctgaaaagggtaatcaggatcgaattgcggagcaatattgcgaatatgcagatgctttttcaacaacaagaatggatcttcctgagagagcgaaacgtcaccattacagtttatttctgttgattcgtcccgtgtgataagcgttgttactggttcggcaactaaaatatcaaatcggttatggggatgttcagccgttccagaatgtaacaacattgcccaaggtgatactgagagaggagcaaaatatcgggtggcaagatcaggagaataaggtaaaagtcgtttttgtaatgcaatcttcatgatgtaaccagtgttggcgttgggtaattcgaataaataacttattaactggtggagattatcacagaatctcactcctgacttgagataaaagcgtctattaaaacctattgggtatataatcccgcttgtcgttaattgtgaacgtatatttgaggttatggtcatgttttcaggtatgccggcattatcccatgaagaacagcaagttgcagtagaaaggatccatcagctaatttcagaaggtatgagcagtggagaagctattgctattgttgctcaagagctgagggagaaacatcagggcaaggagcagattcatattttatttgaggatgacgagaaataaccgcaacgcatttttaacaaaactcacataattactttctattacatgttagtttaccccaacatttaatccatattctttgggtggtaataggaggtaatatgaagtcaaaccaatttattcatcgtattggtttattgggaacaggcattctgctttccgtttcattgactattgcgtcagccgctgaaaatgatcacatggcgaagtttgtttcttgcaaaaacttaaccaaagaccaaatagcagcacaggtcaaacaagatttcttacaaaatcgtattcatcactgggataaggacaggaaacaattaggaacgtcaaagcccattgcatgggtaaatgtcaatgatatgactggcgatagaaatgcgttacaggttccgcttattgttcgtggctcccaaagagacaaaagttacaatgtcacaattgattgtcaaaaagatacaatcaattatagtgaggtaaagtaaatagtttgtcatgatatttttaaatgtattcgggatactgggagtgtatcccgttttatttaaccagtgagaggtctttatggcggaactacgaaaactctatccggcttatgacgcgtaccaaacgggatatctggatactggagatggacatcaggtttactgggaactgtgcggcaatccaaaaggtaaacctgcggtattcattcatggaggccctggtggagggagcgcaaattatcatcgacagttatttgaccctgagtgctaccatgtcatgttgtttgatcaacgtggttgtgggcgctccaaaccccatgccagtcttgaaaacaatacaacatggcacttgattgatgatattgagcgcctgcgtaatttgatgggagttgatagctggctggtttttggcggttcatggggaacaactttgtctctggcttatgctcagaaacatccgagttgtgtatcagagctggtgttaaggggtatttttctacttcgtacccaagaattgcattggtattatcaggacggtgcttcccgttttttcccagataaatgggaacgcatgatatctatcctttccgaggaagaacgtgaagatgtaatggacgcttaccgtaaacgtctgatgagtgatgatccggaagtacagttggaagctgcccgtttatggagcctttgggaaggtgagacagtaacattattgccttctgaaaatgtagattcattctcagaagataaatttgctctggcatttgctcgtattgaaaatcactacttcgttaataacggctttatggataatacacagcagttattagaccatattgatcttatcaggcatgttcctgcggcgatcattcatggacgttatgatatggtatgtcagttacagaatgcatgggatctggcaaaagcatggccggaagcggagttgcatattgtagaaggtgctggtcattcctttgacgaagcaggtattttacaccaattgatcaaggcgactgataagtttgctggaaaatagcagagataaccacccacttaagtggtggttatcttctttgtcccatctctaacgacttctgggttcataaggtaagcgtgaaaagtaccttgattgctcgcggtaatgacttaatctctgccggaaatattctctcaagtgctgtggttgagattgttcaactgtgtcaggaatgacaggcatgttatagcgttctttaaatgcaactcctgatgcaactaaatcaacattgaccttatccatttcatctttagataacttggctaagttatgaaccatcatatcctctctaaaaattaacactcatttttacgagataaaattaatcgagacctctttatttagcaagttgtttaattgtggtaaaaatgaccaactaaacattaataatattaattatcatttctattgactatttattttttcaattagatatttaattaaataaaagtgattcttattttcttatatttaatgagatttattcttattatttattttaaataaactcttaattatcaatcgattgaatatttttattttatttttgttttatttatttttaataggcataatatgcggaatttaataagttactaggagtatgggttgatgttaaaacaagaaatggttaagaaattaaatgagcaattaaatctggagttttattctgccaacctatatttgcaaatgagtgcatggtgtagtgacaaaggatatgaaggcgcggctgcatttttgagagcccattcacaggaagaaatgcagcacatgcagcgtctgtttgattatttgggtgacacgggagcaatgcctgttctcggtgctattcaggcccctccggttgaatttaactccatctctgatgtattcaatcagacctataaacatgaaaaattgatcacagaagagattaacaagctggctcatgtagcgatgatgacacaggattactctacttttaatttcctacagtggtacgttgctgaacaacatgaagaagaaaaactgttcaaatccattctggataaattgggtatggtaggtgaaagtggcaactcgctgttcttactggataaagatctgaaaggattgtctgtaccagcacatgcctgatagataagcaaaataagttcatctggtttttttaccgtaatttccgctttttcgtttgtttttgtggcaggaattacggttcttttcatttttgtcctcatttttgcgtagtggttcacaggtcatgactttggccgcagattatcgcagattaaacctgttttttgatatagaatccctatttaggtatgaaaattcacctgtatattaaagggttatctattatgtccattcttagtctccgttcattctgggctaaattatctgctctagtggttctatttgtcggaatgtcttgtcaacaggctttggctcatgcgtatttgaaagaccagacgccagcagaaaacacaaccgttgaagcaattccacaagctataactttgagcttttcagagcgtattgagcttgggtttagtaaagtaaaactgattggcccagaaaagaaaaccgtcaaaacgggtaagctagaacttgatcctgacactaagactaaattaattctgccagttgaagataaacttgtcgcgggagaatatagcgtcgactggagtgtgctctctgtcgatggacataaaacaaaaggcgcttataactttactgtaaaataatgatttcgcttgaggcgttatacatactttgccgtttctttcattttgtggtagtcatgctgatgtttggcctcagtctgtttactgtcatgctcgcctcaggccgtttttcggtactgatgagagaacggttgagagtcggagtgtcaatcagcactgtgctggccttaataacttcaatagcctggtttatcatacagacaggattaatgggagatggctggcatgatgtttatcagttcgatatttggctagccgtgctgggaactgcttttggcaaagtgtggaaatggcagctgttggttgcagcacttgctgttgtgtgcttgttcttttttcatactaaaactagaaatttcttattgttggcctgctctgttattttgctgtcaagccatgctttcattggtcatgctgcaatgcatgaggggaatatcgggttgttacttcaggctaaccagattgttcatttactgagtgctggttattggtttggtggcctgtggccttttttactgtgtttgcaattcttgcggctgaagaatacattgtattttaacttatatcgcgatggtacatatagcggttatatagcagacaagctatctggtgaaagcgtagctgcaatgcggaaattttcgaattacgggcatcttgccgtttttatggtgatcaccacgggtattgtgagcagcatcattttaatcccagactggccagttttctgtaccaccatttctgagtatcaatcaatgctgtggttgaaaattgccttggttgctggcatggtgcttctggcgctgatcaatcgttatattttggtacccaggttaaatcagaaaagacgctatgaatggttgaccctgaatagctggttggagattattctgggaacatctgtactgttatgcatagccatctttgcaacggaaccccccgtatgattcctgagtgatggctatataaacacgaaagtgatcggtagaatcaggcgcatatgtctatcagaggaatgataatgaaacgagtatattgggttttagcttttttgtttttctcttttcagggcattgccgcatcaatacaaactgtcagcaaattgcagtttgggaaacaatgggcctttaaccgtgaagaagttatgcttgattgccgctcagatggggcgctatttgtgattaatcccagtacattaatgcagtacccgttgaatgatcgtgcaacacagcttatggtatccaataaagtcattgctacatcgttaaataagatccttttagatgatcctgagcattccaatcaaaaaatgagtattgagccattccaaaaagcggcactagctttatgtgacaatacacgtgacaaaaaatgactataagttgatactgctagtgtgaagcgcggcttagttacagtctgtgagagacaaaacttggtaaatcattgcatgtcaactatgctttaagtggtaggttgttctacgtctcaatggtagtttttagcgcaaggctttttgatagagccattttccataggccgagtagaggagtatactcggcctttttttattttcttaccatatagcgctggaaattttttcaataaattgttttttctcctgatatatattaagagaatggagatcaaacaaccctcagtatattgataaggtgttttatcataataatatgaacaaggacacggatctgactgcaagtcaggcgagtttttaatataaattgtgatatttacctgaattttataagtgagtactggtaaaaataattaaagaaaattctaattcaggaatacaaacggtattctagaaggatgcctgccttgatgataggctattgttcaaagtagtttatagatagcaggatgataacttttatgttaaaattttgtactaataacgttaaataatatggtctttataataggtgcgtatggataagcataaattttatcaggagctatcagatagtttgatggctctattgtcaggtgaatatgatttaatcgcttctcttgccaatacaagtgcattattaagtgattatttggatgatgttaattgggtcggcttttatttggtggatggtaatactctagttttaggaccatttcaaggtaagatcgcttgtgtccgtattcctataggaaaaggggtatgtggaactgctgtggcaaaaaatagtattcagcgcatttctgatgtacatgcttttcccggtcatatagcttgtgatactgccagtaacgctgaaattgtccttcctttggaaattaatgggcaaattattggcgtattggatatcgacagcactgtttttgaacggtttgatgaaaatgatgaacagggcttgaaagcgcttgttatcaggctttgtaagcatttggggcaatgcgttgtgccaaaatatctacaacagaacgtaacttaacatacgtataacgtggcatttatcagtaaggctattataatgtcgcctgttcatgcctgcgctggttggcaaaaccgttgtaatcaggaaatttcatggaaactgaacctaagttgaatagtagtaaagaagtcattgctttcttggcggagcgctttccgctctgtttcgcagcagaaggtgaagcacgtcctctaaagatcgggatctttcaggatatcgttgaacgtattcagagtgaagaatgtttaagtaaaacacaacttcgttctgctttgcgcttgtatacatccagttggcgctacctttatggtgttaaagaaggtgcccagcgtgttgaccttgatggtaatgcgtgtggtgagctggaagtggagcacattgaacatgcgcgtcagcaactggcagaagcgaaagcgcgagtacaggctcaacgggctgaacaacgtgccaagaaacgtgaaaccgaaaacgcatccgacaaaaaaagtgaacatcctgtgaataaaaagacggcacctcgtcgtcaagcatcaggtgatggtgaaaaacgttcatctcgttcgcaaaatcgtctgcaacagtcacgtaaaccagcagataacgttacaagaaaaattgcacaaccaagaatttcacaacctgagttaacctcagtcacagacgtatcctctttgaaagtcgggcagacaatcaaagtaaatgtaggtaaaagtttaatggatgcttctgtactcgaaattgcaaaagatggtgtaagagtgcaattacctactggtctggcaatgattgtacgcgcagaacacttaaagttctgatacggaggccaacttgggcatgaacaaactcattaatttggctttcgttttaggtctatcattttctggtatagggtatgcaaatactgctaatgtcatcggtagcagtaccgttaatgggaacaatgcgcctgttattgccctcagtcaattgccagatttaaaaccggaacaacaacattcaaccgtgagtaagcggattgtttctcgctttctgcgttctcactaccgccatttttatctggatgttgctttttcagggaaagtctttgatcgctacctgaacgcattagattatggccataatgtttttcttgcatcagatattgcacagtttgctgaacagaaagggcttttaggtaaagagcttgaaaatggtgatttaaggctgccttatgctctgtttaacttgatgcagaagcgccgtttcgaacgttatcaatatgttctttctcgcttggaacagcctgttaatttagatggcaatgatacgtttgaaaccgagcgtactaaggctccgtggccgaccagcgttgtggaattaaataaactctgggatgccaagattaaatctgattggataaatctcaaactgtctggtaaagatgataaagaaatcaaggaaatacttaccaaacgttatcgaactcatctaaaacgtcttaatcaaagtaagagtgaggacgtttttcaaattatcatgatggcttttgcgcgtgaaatagatcctcacactagctatctttcacctagcaatacagaacaattcaattcagaaatgagcctttctcttgaaggaattggcgctgtcttacaatatgatgatgaatatatcgctattcgttcactggttgggggaggccccgcagcgaaaagcaatttactgaaggatggggacaaaattattggggtcgggcaagccgggaagccaattgtagatgttgtcggatggcgtctggaagatgttgtgactctgataaaaggaccgaaaggaagtaaagttcgccttgaaatcatacccagcacgaaaggggctaaaaatcatatcgtcacgttaactcgtgagaatattcgccttgaagataatgcagttaagatgtcagtaaaaacggtaggaaaagaaaaaattggcgtccttgatataccgagtttctatgttggcctgactaacgatgtgaaaatacagctgcaaaaattgaccaaacagggcgtgtcctcaattgtaattgatttacggaccaatggtggtggagcgttaactgaagctgtatcgctgtctggtttgtttatttctactggtccgattgttcaaatccgggataataccggtagaataaaacaagactcggatactgatgaagcaatatattataaaggccctctagtcgttttagtggatggcaggagtgcttcagcatctgaaattttcgctgctgttatgcaagattacggccggggcttaattgttggtgatcctacttttggtaaaggcactgttcagaatcatcgttctctaaatcgtatttatgatcagatgttaaaacctgactggccagagattggttcagtgcaatatactgttcagaaattttaccgggtgaatggtggcagtactcagcttaaaggtgtaactcctgatatccttatgccaacagcggaagagcctgctgatataggtgaaagccaagaggacaatgcgttaccgtgggatagtattcagccggcatcttatcccttctcaaaggttatttcagcgtgggtgccgttactgactcaattgcataaccagcgtattgccaatgctcctgagtttaaatatatcaagcaagatattgcttattacaaattaataaaagctcgtaatggcgtttattctctgaattatgcgcagagagagaaagagaataaggagtatgaatcaatcaagttgaatcgtattaatgagcgatttaaacgagaggataaaaaaccactcaagtcacttgatgatttaccgaaagattacaaagggccagatccctacttagatgaatcggtacaaattgctctggatttggcacatcaaccagccgaaataactctgacgaagtgattttaaagttcgttacagataaaaggccgacttggtagtcggccttttttgtgacactgtaaagttatgttgattctatcgcttagcatcttaaaaaaattgaataatatggaatgaatctccatatttatggtttggctcttagttgaattgtttgataattaaaggaaataaatttatatgatgcgaatagccttgttccttctcactaacctcgcggtcatggtggtgtttgggataatactttcactcacaggagttcagcaaagtagtgtagctggtctcatgattatggctggtttgtttggttttggtggcgcgttcatttctctgttaatgtcgaaatggatggcattgcgtgctgttggtggtcaggtcattgaaaaaccttccaatgaaatggaattgtggttgatggaaactgttcgccgtcagtcagatcaggttagtattaccatgccacaggtagctatttacaatgctcctgatattaacgcatttgcgacaggcgcacgtcgtaacgcttcgttagttgctgtcagtactgggttgctgaataacatgagtcgtgatgaagcggaagctgttattgctcatgagatcagccatatcgctaatggtgacatggtaacgatgacgctgttgcaaggaattgtgaacacattcgttatttttatctcgcgtatcatcgcacaggcggcttcaagtttcctgtccagcaatgataatgagaatgaaagtagcagcaacggtaatccaattgtttatatggtgctttcgatggtactggagattgtattcggtattctggcaagcattattaccatgtggttctcccgttaccgtgaatttcacgccgatgcaggatcagcgaaactggttgggcgtgaaaaaatgattgctgcgttgcaacgtcttaaaaccagctatgagcctcaagaagagggtcgtatgatggcattctgtattaatggtaagtctaagagcttcagtgaattattcttatctcatcctccattagataagcgtattgaagcccttcgtagtggtgaatatataaagtaataccatagtgacctgctctattatggtctgaagtaaatattcagtgaaaaaagccggtattcatcatgaatgccggcttttttattgctcttgtgagcgaaatttagttttttgaggatattatgcaactaatatataggtagtatgaggggagatacagataaaaaatgctccctttgatcattgatatacacagggagcggaattttatctgatacagattaggactgacttaatcctaccgtttcatcttgctctaatatttctttgttagttgtacccatcaattgactagtgattgtaccagctgtcattgcaccattgacgtttaatgctgtgcggcccatatcgataataggttcaacagaaatcagtagtgcgactaaagtcacaggtagccccatagcaggtaaaacaatcagtgctgcgaatgttgcacctccaccaacaccagcgacacctgcagagctgatcgtcacaataccgacgagagtcgcaatccacaggggatcgaaagggtcaataccgacggttggggcaatcattaccgctaacatagctggataaataccggcacagccattttgaccgatagtcgcaccaaaagaagcagaaaaactggcaatggattctggtataccaaggcgacgtgtttgtgtttcaacattcaacggaatactggcagcacttgaacggctggtaaatgcaaacgtcagagcagggccggctttcttgaagaatttgatcgggttgatgccagtaagtgccaaaagtcctccatgtacgacaaacatcaacccaagggcaatataggaagcaacgacaaaattgcccaattgtgcaatatcgtgaatgttggagctggcaacgactttagtcatcagagccataacgccgtatggtgttaggcgcataaccagcctgacgagtttcattgcccatgcttgcagggtatcaatggcaataagagctcgctcaccacgttcatggtcatctttaagcatttgtaatgcagcgatacctagaaacacggcaaaaattacaacaccgataattgaagtagggcttgctccagtaaggtcagcaaatggatttttaggaataaaagagaggataagctgtggtacacccagatctgaaactttgccgatataacttgtttcaatagcagacaggcgcgccgtttcttgtgtgccttgaattaatcctgcagcagtcagaccaaacacattggcgataatgatgccgattaaagccgaaatagcagtggtgaacaacaaggttccaattgtcaggaaactaatttttcctaaagcggacgctttatgtaaacgtgcgactgcactcagaatagaagcgaaaactaatggcataatgaccatttgcagtaactgcacgtagccattgccgacgatattgaaccatttaattgattctttcacaatgatattgtgtgcaccataaatgacgttcaatgccagcccaaaaacaacacccatgattagggcaacaacaacttttttggacaggctccacttatttgagctcgcttttgctaatactataagtagtgctacaaaaaccagcacattaatgacgagtggtaaattcatccctagactccaaaatttctaactatatgattttttgtatggtatttaatcgtactaggttataacggaacgttataccatttaatagaataagaaaacatgttatcagcataagaaaagccttacttataattaaatggaattaaatataatgatttcttactacctagtaaaattgattataaatacttatattattatatttgattttcgtctgatatttgctgattattgatataatttgtggatttacacatagtgataaaagtgaaaaaaataaacattgtttatgtttttgagggtgaccccattgaggaaatggggtcatgaactaataagactatatttaatccgctacttatatagactctgtaacttgtcaatttgcaacttatcgatttgtaatttatcaaaatagtggtggataaacgaaaaatcaatttgatgtggaaggagaatggcaatgacgagcaccagcacagcaataaatcgctccgcttttttgcgttcctttcctctaagaatagggatacagaaacgtatcctcagtggccataagagtgggatgcctgcgggtgtaagcatatcagcaatcagatggctgatataacccacaatcattgcatgaaaaaagtcagttggaatgggccacccagacggtatttcagcctggaagagaataattcctactcccagggctagtaagctgtgagtaaatccacgatgcccacatagtcgggcaataggaattgatataaaacgaaataatctacctaacgttgaactgggatgatcaatatcaggtaacaatgaggccagaagcactccgggaagcatatgaagccagtctccctgtgctatttctggtgtaatttctagctggtgagccaatatgaggctggcaactgaaaaaaggagatgcccttctgctgtcataacgatttatattgattatttatgctgattgctgtttatacatacagtgaggcagtatagagggtttttcacaagtatgatagggggtaaataagataaatctgttatttattaatatagaacactaagatttaattgatttttacctagagcagctaggataaagtacattatgatgaatatttgcgctgccctgtagggaaaatacaaatcaaaaaatggcagcacagagcaactatcaagtaatgttttctatggttaactcttccagtgaatttaacttaatatcagccagtgaccagcgggggtcatcaaaatggtggaaggccggaatcacaatagagcgcattcttgctgctttggttgctaccataccgttgaaaaaatcttccagtataaggcaattaatagggttaacctcaagttggatagtgatagtagcttcctttcccactgttccacaatctcccacttttctttcaggtagtcgcgaagggggttgatatctcatcaatgtagtcggcaaacggatgggtggggtggagagatgattgataatttatcaacatagtcagatagtaactctgtgtgttaatatggattttgagttttagcaatgtacataggtagtttgatgaattgtgtacataacttacagagtgaagtaagagattgctaataacgaattgaaaataaacaaattttatttcatgcaagtgatctttcgtgtgggtcaccactgtagataaggattttaaatgcctgtaattactcttcctgacggtagtcaacgtcaattcgagcatgctgtttctgtaatggatgtggctcgcgatatcggtgtgggcttggcaaaagcgtgtattgctggccgtgttaatggcgaattggtggatgcatgtgaattaattgaaaccgatgctaaccttgcaattattaccagcaaggatgaaaacggtctggaaattattcgccactcatgtgcacatttattaggtcatgcagttaagcagctatggcctgatacgaaaatggcaatcggtcctgtgattgacaatggtttctattacgatgttgatttggatcgttctttgacgcaggaagatatcgagttgcttgagaaacgcatgctggagcttgccaagacagattatgacgtcatcaagaaaaaagtcagttggcaggaagcgcgtgaagcattcgcagctcgtggcgaagaatacaagatccagattctggatgagaatatcagccgtgatgattatccgggtctgtatcaccatgaagaatatatggatatgtgccgtgggccacacgtccctaatatgcgtttctgccatcacttcaaattgcagaaaatagcgggcgcatactggcgtggcaatagcgacaacaaaatgttgcagcgtatttacggtactgcatgggcagacaaaaaacaactcaatgcctatttgcaacgcttagaagaagcttcaaaacgcgatcaccgtaaaatcggcaaacagcttgatctgtaccacatgcaggaagaagcgccgggcatggcattctggcataatgatggctggacaattttccgtgagctggaaacatttgcccgagttaagctgaaagagtaccattatcaggaagtgaaaggcccattcatgatggatcgtatcctgtgggaaaaaacaggtcactgggaaaactacaaagaacatatgttcaccacatcatcggaaaaccgtgaatactgcgtgaagccgatgaactgcccaggacatgtccagatttttaatcagggtctgaaatcttatcgtgacctgccgttgcgtatggctgaatttggtagctgtcatcgtaatgaaccgtcaggggcattgcatggattgatgcgtgtacgcggctttactcaggatgatgcacacatcttctgtactgaagaccaaattcatcaagaagttagcaattgcatcaaaatgatttatgacgtgtataatacatttggtttcgagaaggttgttgtcaaattatcgactcgtccagaaaaacgtattggcactgaaaaacagtgggatgaagcagaagctgatcttgctgaagcactgaaacaaagcggtattgaatttgaatatcagccgggtgaaggtgctttttatggccctaagatcgaatttactctatatgattgtttggatcgtgcgtggcaatgtggtactgtgcagctcgatttttcattgccagcgcgtttgaatgcgtcatatgtcggtgaaaataacgaacgtaaggttcctgtaatgatccaccgtgctgttctaggctctctggaacggttcattggtatcctgactgaagaatatgctgggttcttcccaacatggttggcacctcaacaggttgtcgtcatgaatattactgacggtcaggcaggttattacagg

SEQ ID NO: 14963 - DNA, 45618 bp, Xenorhabdus bovienii
  Genomic contig Name=Xb4151_4152.C422
ctgtgcaacacgaaagtggacgtatacggtgtgacgcctgcccggtgctggaaggttaattgatggggttagcggcaacgcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaaccttgaaccttgatgtgtaggataggtgggaggctgtgaagtgcggacgccagtctgcacggagccatccttgaaataccacccttgaatgtttgatgttctaacgcaggcccgttatccgggtcgcggacagtgtctggtgggtagtttgactggggcggtctcctcccaaagcgtaacggaggagcacgaaggttagctaatcacggtcggacatcgtgaggttagtgcaatggcataagctagcttgactgcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacctgacaacaccgaaggtgttttggtgagagagagagacgcagtttcaaatgaaaaacagcagcttgttcgggattgaacacagaatttgtctggcggccatagcgcggtggtcccacctgatcccatgccgaactcagcagtgaaacgccgtagcgccgatggtagtgtggggtctccccatgtgagagtagggcactgccagacatctatttagccagagaagccaccccaccgggtggcttttttgcatttgatgaattttaaaaggacttttgaaaaataatttactactccgattggctaaacaaaattaatgtaccttcccctactcgataccaattccagtctgtgaacgaataaactgattgcgaaacattttcctttcctgctgaccttgttgtgatccatctgtgatggaaaataaccatgtacagatgaatgctacaaacatagaaaacagtgcagggtattcatacggataaattggcttttcatgaccgaggatgttgacccaaatagtaggcccaaggatcattaatacaaccgcactaattaatcctaaccacccgccaatgagtgcccctcgcgttgtcagcttgttccagtacatcgataataaaataatcggaaagttacagcttgcggcaattgagaatgccaaacccaccatgaaggcaatattttgtttttcaaacagaatacccaatccaatggcgacaaaaccgagaataatgacggtaatcttagaaactttcagttcatcccgctcattggcttgaccttgcttaattacattagcgtagagatcatgagaaactgctgaagcacctgctaaagttaaccctgccacaacagctaaaatagtggcaaaggccacggcagagatgaaaccaaggaagaagttaccgccaacggcatcggcaagatgaacagcggacatattcgttccaccaattaatgccccagttgcatctttgaacgcgggattgggactgactaataatattgcaccaaacccaatgataaacgtcaggatataaaaatagccgataaaccctgtggcatagaaaacacttttacgggcttctttagcatcactaacggtaaaaaatcgcatgataatatgtggcaatccggcagtgccaaacatcaatgccagtcctaaagagagtgctgatataggatcagacaccaatccgcctgggctcatgattgcctgaccacgggaatgcacagctatagcttctttaaacagagtattgaaattgaaatttacagctttcatgaccatcagcgccatgaatgttgctcctgccagtaataggattgccttgataatttgaacccatgtcgttgccagcattccaccaaacagcacatacagcaccatcaaaataccgaccaaaataactgcaatgtgataattcaacccaaatagcagctcaatgagttttcctgccccaaccatttgagcgatcaaatatagtgcaacgacaaccaaagagcctattgctgacaaagtacgaatgggacgctgtttcaatcgataagaggcgacatcagcaaacgtgtaacgccctagatttctcaaacgttcagcgatgaggaatagaataattggccagccaacgaggaagcctattgaatagatcaggccatcgtaaccagaggtatagactaacgcggaaattcccagaaaagaggcggctgacatatagtcaccagcgatggccattccgttttgaaaccctgtaatacgtccaccagcggtataataatctgaacgtgattgcgttcgttttgaagcccaataagtaatgcaaagagtgaacccaacgaataacagaaacataacaatagcttgaatattcaagggttgttcttcgaccttgcctgaaatggcatccgcttgtgctaagttgtgaaagagtgtggaaaatagcagcatcgctgacaatacgatttttttcatttttttacctcattgaggatagtcgaagtcaaacgatcaaattcaccattcgctctgacaacatagatccctgtcaatatgaaagaaataaatataatgccaacccccacaggaataccacgcgtcatgctggagccttcatagaggggagtaccaagccactcaggggaaaaagcgataagaaaaataaatccaacataaagtactaacatgatggcggataacaaccaggcaaagcgcccacgcttctgaaccaattccttaaagcggggattattttcaatctcttgataaatatcaggattcatcagagtgtctccttcttggattttgaacgatacaccttaattgcgttattgattgctaaacgcggggtacagaagtccgtgggagctcatgacgtatttgtcatgtccctgcacagttctctgtttttggtgatacgttattcaagccgccttccggcggcgtacttttttaagtcatattcatggattgtttttcttccagcagtttttcaacgacacccggatctgctagtgtggaggtatcacctaagttactggtatcgccggaagcaattttgcgcaagatacggcgcatgatcttccctgaacgcgttttgggcaaagaatccgtccagtgaagaatatcgggtgttgcaatcgggccgatttctttgcgaacccaatttctgacttcggtataaagatccggggaaggttcttcaccatgattcagtgtgacataggcataaatcgcctgccctttgatatggtgtggaatgccaacaacagcagcttcggcaatttttggatgtgaaaccagcgcagactcaatttctgcggttcccaaccgatgacctgaaatattcaggacatcatcgacacggccagtgatccagtaatagccgtcttcatcacgtcgagcgccatctccgctgaaatacatacctttgaaagtggaaaaataggtttgttcaaaacgctcatgatcaccaaataaagttcgcgcttgtcccggccaggaatccgtgatgacaagattaccctcacattcgccagttaatggctcacctgagttgcccaccaatgccggactgataccgaagaatggcaaagtagccgaacctggtttgaggtcgactgctccgggcaaaggcgtgatcatgaacccgcctgtttcggtttgccaccaagtatcgacaataggacatttactgttacctatcttccggtagtaccattcccatgcttcaggattaattggctcacctaccgagcccatgatacgtagtgacgtacgtttggttccttcaatcgccttatcgccttcagccattaatgcacgaatggcggttggtgcagtatagataatattaacctgatgtttatcaacgatctgacagaggcgattgacatcggggtagtttggtacaccttcaaacatcaatgatgttgcaccgcaggagagaggcccatacagaaggtagctgtggccggttacccagccaatatcggctgtacaccagtagatctccccagggcggtaatcaaacgtgtatttgaaagtcaaagaagcatagaccagataaccgccagtggtatgtagaacccctttaggtttgccggttgagccagaggtataaagtatgaaaagtggatcttcggcattcatttcttcggcagggcaatctgtgctgacattttcgatcaactcatgccaccacaaatcacgaccttcctgccagcttttggtgttaccagtacgcttgaagactaccacattaacaacgtcggttacggctggattactcagtgcttcatcgacattctttttcaatggaataacgcggcctgcacgtatcccttcatctgcggtaataatcagcttggcattggaatcgataaccctgccagcaatggcatcaggagaaaaaccaccaaaaatcacggaatggattgcaccaactcgggtacaggccagcatggcaacggcggcttcgggtaccattggcatataaatcgcaacgacatcaccttttttgacatcaagttttttcaatacattggcgaattggcagacatcatgatatagctcgcgatacgtaacatgcttggattctgcgggattgtctccttcccagatgatagcggtttgctcaccacgttcctgcaaatggcggtcaaggcagttggcacttaaattcagtgtgccatcttcaaaccagcggatactgacatgccctgggtcgaaagaggtgtttttaacctgagtataaggtttaatccaatccactatcttacctttctcactccagaacgcttcaggatcttgtagtgaccattggtaatcttgtagatattgttgtttgcttatcagggccgtttctgcaatgtcagcaggaataagatgcttgattatctgagtcatatttttatctccttgcgattgttaatactatgtcaaaacaacgttaactaaagtgtaaagagaagttttgtttcttttttgcgcggaagatcacgcattaaagagaatgcatttcatggaatgatcaattaatgcggcgtgtttgagagaaattaagttctgttgataatttaatctttggagagaacgactaacttatggattttatttagttattctatctaatgaagaaatgaaactgagaaatggaaaggaaaccctagttataatatggaattgataatcattttcattgctgtttaagtcattataataactatgttgttcacaagctgtgagccttatacattctaaactactggagatatgacatgagctattcactgcccgctctaccttactcttatgatgcgttggagcctcatttcgataagccgacgatggaaattcattataccaaacaccatcaaacctacgtgactaacacgaatacagcgttggaagctttccctgaattagctaaacttcatattgatgatctgatccagcagcttgataaaatccctgcggataagcgcacttttattcgcaataatgcgggcggtcactcaaaccatagtctgttctggaaaggattaaaattgggaacggtcttaggtggtgctttgaaaacggccattgagagggatttaggtagcattgagatctttaaggaaaaatttgagcaggcggctgcaacccgctttggctctggctgggcatggttggttctaaaagcagatggcaaacttgcggttgtttcaactgccaatcaggacagtccgttaatgggagaggaaattgccggtgcttcaggttacccgattctgggtctggatgtgtgggaacacgcttattacctgaaatatcaaaaccgccgtccagactatattaaggcgttttggcatgtagtggactgggatgaggcagcaaagcgttacgaagaaaaaattaagtaattagtgagatttatttctctcaataatgctggtcaatgctatggccagcattttgactattcgatattattgttatcatgcgtgggtaatactttaatagctatcaataatttattgagaggaaaaaatgtattacccgaaagtatatcgaacgattacggatgagcgagcaaacctaccgcatcgtagattttatccaaagtcgcctgagcacgggcttgtgccttggctgccccttctgccatgatttgatttagcaatgcttcatcattacggaaatgatgataacgttcttgcaaatcagttagcatttcggatacagcatctgcgacagcgcctttcaaatgaccgtacatttttccttcaaactcagcttccaattcagcaatggttttgccggtgacaccagaaagaatatccagcaggttggaaacacccggtttgttttccagatcatagcgtacacgaggtggatcttcagaatcggtaactgcacgtttgatttttttcgcgacagattttggatcttccagcagggcaataacgttattacagttatcatccgactttgacattttcttggctggatcttgcaaagacatcactttagcaccacccgttggaatgaatggttctggtacggtgaaaatatcaccgtaaatagcattaaagcgctgtgccagatcacggctcaattcaagatgctgtttctggtcaattcccacagggatttgattggcttgataaagcagaatatctgcggccatcagaaccggataactaaataaccctgcgttgatgttttccgcatgacgagctgatttatctttaaactgggtcatacggccgagttcaccaaaataggtgtaacagttaagtacccaacttaattgagaatgctgtggaacgtgtgactgaacgaagatcgtacttttcttggggtcaatgccacatgcgaggtaaagtgcaagcgtatcaagcgtgcgttttttcaattcatttgggtcttggcgcacggtaatagcatgctggttaacgatgcaatagatgcaatcatactcatcctgcattttaacccactgacgtaacgcccccatgtagttaccgatggtcaattcaccggaaggctgtgcgccgctgaatacaataggtttttgggagtttggtttcattacagtgggttcgttcattttgttacgcttcctgaagttttaacgtagataatccgatagccggtagtaaatccgggaaatggtccaatatataatctgggtggcttaatgctatcgattctccgtagttatatccataggttaagccaacacaagggcagccagctgcctgtgccgctaaaatatcattacgggaatcaccgacaaaaagcaattcttctttatggatgccaaacatgcccattgttagatatagcggggcaggatggggttttttctctttaacatcatcaccacccagcaccagtgaaaagtattcactgatccccaatgattccagcaatggcgcaataaaaggtgtgggtttattggttacgatggccattggcagattatgctgtgccagtgttgccagagtttcttttacatagggaaacagttggctgcctgttgtcacggttgtttcataaaacccatcaaacagtttacgggtttcacgatgcaattcaggggtggattctacgcctgcccatttcagtgcacgttcaaccatgacatccgcgccgttacctatccagatagcaactcgttctttgcctgccggaggtaaacctttggcaatcagagcctgatccagtgcttccgccagaccgctggcgctgtcgactaatgttccatccagatcaaatgcaatggcacgaagatttttcttaatacttgttaccattatgccacctttgataattcacggcgcatctcatcaatgaccgttttatagtcaggctggctgaaaatagcagaacctgcaacaaacatatctgcgcccgcctgagcggcttctctaatattattggccttgatgccaccatcaacttcaagacgaatatcgtatccgctttcgtcaatgattttgcgtacctgtcgtagcttgttcagggtttctggaatgaaggactgaccactgaaacccgggttaacggacatcagcagaatcacgtccagcttatccagaacataatcaaggtagctgagaggggttgctgggttgaaaaccagacctgccttacagccatgttctttgatgagttgcagggtacggtcaacatgctcgctcgcttcggggtggaaagtgatgtaggttgcacctgctttagcaaaatcagggataatgcgatctacaggttttaccatcagatgaacgtctatcggtgccgtaatgccataatcacacagcgcctgacagaccattggtccaatggtcaggtttggcacatagtgattatccataacgtcaaagtggacaacatcagcgcctgctgccagaacctttgcggtatcttcacctaatcgggcaaaatctgcagatagaatggatggggcaatcagaaaatctttcttcattatcatcttctccaattcattgttttatccccattatttcaggggtaagaaacctcagtcacttccggcagtataacgccaaaagctcatcaactttactccgagcaagaatatttctacttattgtccgacgggctttaacaatatgaagagtagcctgatgataccattcccgcgtcattagcgtgtcatggttggatatgagcacaggaatgccctgttgagaggaaagatgataggccatcctcgctagattttcttgatcgaggaggttaaaactatttgtatgataggccgtaaaattagccgttgccgaaagtggggcatacggaggatcacaataaattactgatccttgtggagcgttgtctaacgtgatttggtaatgctggcagacaaaagaggctttttgggctttttcagcgaaccagtaaagctcatcttcaggaaaataaggttttttatatcgcccaaaagggacgttaaattctcctcgagagttatagcggcaaaggccgttatagcagtgtcggttaaggtaaagaaacaatagactgcggtacagtggttcttggcttttgttgaactcttccctcaggcgatagaagtcttccgcagtgttgaactcctgagagaataatggacgggcatgattgataaattcttctggacgagattttaccgtgtcatacaggttgatcagatcactatttatgtctgacaagatgtaagaatcataatcggtattcaggaataccgagcctgcgccaacaaatggctcaattaagcgttctccctctggcagatgacgtctaatgtcatccaccaaagggtattttccaccggcccattttaagaaagcgcgtttttttttcatgccgtcaaattagctattcaataatttcagagccgcagattgtactctgtttaggacagcatatcagcgcctaatcaaaatagttttattttttcagatcttgctgaacctgttgtagttttctaacccaaggttttttggcctgaacttcagccgggagtgaggaaatggcacttttggcgtcagaaaccgaaccataactgccgtggatcaagataaaccatgccttaccttcacgtttagcttcataaaccgtatagtttgacaggttattgttctttgcgaaggcaattaaggtatccgagcggctggcgctactcaactggagtgtgaatctgttggcggaggctttcagtaaatcaccgcgagtatcagtcacactctttttactggcctgatggtggaatattgctggtttatcagttgatttggcatgcttttctgattttgccactttttccgttttttctattttcggcggtgcaactttttcagtcttattctgttcaactggcggtatcaccgtctgttgcatcgggttggactgtgatggcgtcaggtttttttgcaccgtattattgatgttaccttgctgttgattcaaggcatcagaaatatcaccgggcaattctatgcgctggttgtggttacttgcctcaggtgctggagaaagatctttgcttggtgtattgctaatgggtggcatactgatttcttgtgagccattgattgctgatgccaatggattttccggcgagctattctgattattggtagagagtgaagaagagccggatagatcgatgtttttctcagccgtattctgggattgctgtttctcatgctcagttggcgatttcaatgcagaactgatagcaataatcagcagtaaaagcaccagaattccaaccccaatcattaattgctggcgggatactgccagcttgggctggttggattggctgcgcgatcgcggagggtggcgatcggatgtatcgggtttaaattcgttttctgttttttgtttgttttctgattttaattcgtccatatgccctctcagcagagataatactgccaattgttattttagaggcttggcagcctgatctaactaaaaccaataatgttatatctgataatgtagctattttttagcataacagctagaaaatgattcattattcaagcttttattcccagaaggaatatttcgccatattcagataatcgtgtatttagctggtcgatggcaggcataggtggatggcgtccaatataacatcagacccgatatcagaacgaagctctgctttcccaatcgctgtaggcagtaccagatgcaattttcccgcagagacttttttatcgcgcatcatatgtggcaaatagatttctggagacatttccactgggccgttgactggaagttttgcccgttccagcaaactgataatgcgctgagtatcctgttttgagaacgtgcccataagttcagatgtccgtgctgccatcaccatacccgcagcaaccgcctgaccatgcagccagacaccataacccatttcagcttcaatagcatgcccaaaggtatggccgagatttaatagtgcccgcatcccattgcgttcttgttcatcagcagcgacaacccatgccttgagttcacagcagcgacgaatgcaataagctattacctgattatcgagagccagtaattgttcgatattgctttcgagccagttaaaaaattcaccatccagaatgatgccgtatttgataacttcagccagtcctgcatgcagttcttgagcaggtaatgttttcaggcaattgatatcaataataacggatgctggctgataaaaggcccctatcatgtttttgccgaggggatggttgacgccggtttttccaccgacggaagagtcaacctgagaaagtaatgtggtgggtatttggatgaagcgaatgccgcgttgatagcaagcggcggcaaaccctgtcatatcaccgattacaccaccaccgagagcgataagcgttgtgtcacgaccatgattattttccagtaaagcggaaaaaatgtcattgaccacaaaaagtgatttgtactgttcaccgtcaggtaagataacttcgtctacccgaaggcccatcccctgcaatgtggatttcacctgttcaagatacaggggagccagcgtctcgttggtcactatcatgacctgctgaccagcttgcagggacttgaatgcctcatcgctagaaaatagcccttgggctatggcaatcggatagcttctttcacctaacgtaacagttacttgttccatatcagctttcgccttatcgtttgctgctgtgcacaccagcgtaaatcagtttttttccagtaattcgatgatttggttagcaacaactttggcgctttgctcatctgtacggatagtcagatcagcaatttcctcgtagagagggttgcgctcatcagctaaattttctaaaacttcgcgtgctggtgcatccacttgaagtaaaggacgttttttatcacgctgagtacgagctaactgtttttcgatggttgtttctaaatagacaaccacaccacgggcagacagacgattacgggtttcttttgatttaacagaacccccacccgttgccagtacgatgccttgtttttcagtcaattcgttaattattttttcttcacgatcgcggaagccttcttcgccttccacatcaaatacccagcccacgtcagctccggtacgtcgctcaatttcttgatcagagtcgtaaaactccatattgagttgctgagctaactgacgaccaatagtgcttttgccggcacccataggcccaaccagaaagatattgcgtttctctgccatgtttttggtattactaagactatttgttaatgataacccgccccgccaatcagattagccacgggacctaaactgaaacctcatgagtgagaatgtgagatcagatgggaaaattatctcagtacatcaacctgtattgcaactatatatatctggcacgaaccgttgtagtctggtttatgctttgttggctgactgtgagcctactttatgtttattggggtagactcttacttgtgatgttagacccgctcactcaattagataatccttgtatgctaaattactcccagcgtcaaatccataaacaggtcagaccaagaaaaatagtagaaaatctggttaaaaagacgtaattattcctattaattgtttgatatttattgcatattttttgtattggtcaaatatcggtcagttgaggtgtgataaaaattacgagttcccttcggctgtgctgttctcctttttggttaaataatgcacccaatagtggaagatcagacaagtaagggactttttgcaggctagcgccttttttctgctgaaaaatgccaccaagaatcagggtttccccgtttctgacggtaacctgtgtcacgatttcctgtttatctatcgccagattttcatttcctccctgactaatgggcagtccaggagcattctggctgatttttagcgctaaacggattttcccttttctcaatatgtgtggagtcacttccatacctaataccgcctccttaaattgaatcgtcgttttgtccttgtcctgaacgagataagggatatcagaaccttgcttaatgctggctggctgttggtgtgaggctgtcagccttgggctggcaatgatatccagttggttttcctgctccagtgcactgagctccatttccagcaggcttgcatggatgcgggcagtgttcagtaccagtcggtggctttgattacctgcggattgatgcaaattcaaacggttgaggcctattgagcgatttagtggatcagcagccatgccccagtgaattcccaactcatgcagagcctctctgctgctggtaacaatatgagccgtaatttgtacttgttgttgtggcgtatccacttctttcagccaacctttgatgcgggtaatggcatcaaacttatcttccagtatcaggctgttggtcatggtatcgtgttcaacttttccccattttgtcagtagagccggagtatttttctgtaattgttcggcgatctgccctgcgtcagcgtattgcagagtaatcgactgatattcaatctcttgctcctgttcatctctttctgctgggaaaaattcgagttgttcatctaattcgttttttggtggctggaacggatttctcaccgctttttcgctctctgtttctttccatgtgttaatttcttcggcagaagcgaggattggcagtaacagaaacaggcaagccagcaaaataaaaaaatgactgttcatgattatccctcatggaggacatctgacagcaccatgcggacagtcagatcgttatcgacagggatgatggtgaggtgtttgatcagcaaaacaggttgtacttgttggatttcattgaggaaatggaggagttggtcatagctcagtgacagcatgatgtgccagaaaatctggttgccttccctatggcttttccactccatgagctgactgccagagctggttaagggctgatgaaggcgtttgagtacggtggcatttttttgcgggatattgttgggcaaaatattattgccttggctgagttctgccgtcaattgctgaatctgctgtcggatatcgggtaaattgggtaactcggcgatacgtttttcggataacgccgaattgtgtttctgctctgtgagattgagctggaggtcatggattgcgtactcattctcctgccagacccaaaaatagaaacccaatatgagtggaataactggcaattgctgcaacagaaacaactgccatgctggacgatgaaaccacacaagataattacttttcatcaggtgctcccattaaccaattggcatcgatagtaaatatcttgagatgttcttccgtggtgctcatttttttcagttggacattgttcagtgaggcattgtcggtcaggttatccagtaagtccgagacatcatcgtagttttgactgctggcggcaaaaaccaattggccggtgtcgtcactgaatgcagtaagccagcttttttccggcaacaaatgagggagttgacgaaataactgtaaatatctttggttctgttccatgaatgtctgttttttccttaattgttgtgtcaattgctgatgatgttgaatagcgtgttcgctttcttggatattttgctgtaactgcattaattggtggctaatttctgttaatttgtcgtgatgttgcgcaattttgtttttttgctgcacggaaataaacgttagtacagatatgcagagtattaattgcaggcaaagcaatagcccccatttccggcataggcgttttaatcttgcctgacgccacggtaaaaaattaacctgatacatcattgatcatccggcctcagtgccagccccgcagcgataatgaaggcatctgttttttcgggtaatgggagctggtaatggcgaaatgcggtctgcatgtgccagacatgaacgggttctgcgggtatagcatgctgttcgtcactgtaataaatctcagggctggccatgtctgataaaacaggtaactggctgatgatttgtgccagatgcggatgtgtctgtattgatatcaacccataaccaaaagggctactggcgggggtaacccatagccagtctgttatgcgtttgtggatcaaccagccgtcatcgggaacgcccgcgagtttggcaatatagcgcaatgcgcagggagaaatatcaatggcatcgggggataaatcgatgtctgcgagcagcttaagccagaggttgagatctttttgccgggtggcactgatacaaatttgctgacctcgtactcgataatccaacgcaagatcactgacagggaattgtttttcggcattggcatgaacaaaccagccgagttctggctcttgcaatagagtatgggtaggtagggcgatctgcttctgtaaggtttgttgaacaggtaatgttaatcgtaagctaatctttttaggtaattttcgccgccattgcattaaaatgtggcctaatttttcaggatgttgtagccgtcctcctgaaataatgtcgcttgataaacgatattgccagcaatggcgaagttgccagccatcacggcgtttaatggctgcgaaagcattaatgtaatgttcatggacatccagtccgatataccattttgataaatacatgtcgcgatctccatatctgctattaatgaaaggtcatatccatagtgctgtatagcctttatactacgtactaatcgtttataaactgcccgattaacatggcgtgagaaatttcaggtgaagttcataaaatattttttgatccttgtcgttgtttgcattttattgggaaccgcctcgatttttggtttgtacaaatatatcgagccgcagttaccagatgtcgcgactttaaaggatgtccgattgcagacaccaatgcaggtgtacagtgctgatggcgagttgatggcgcaatatggtgaaaaacgtcgtctgccgctaaccctttccgaaatgccgcctttgatggtaaaagcctttattgccactgaggacagccgtttttatgaacaccatggtgttgatcccattggcgttatccgtgcggtttcggtcatgatgacttctggtcacgcttcccaaggggcgagtaccattactcaacagttggcgagaaactttttcctcagcagagagaagacgctgatacgtaaggcgaaagaagcgtttctggcgattaagatcgaacaactgctgacgaaggatgaaattctggagctatacctcaacaaaatttaccttggtaatcgtgcttacggtgtaggggctgcggctaacgtctattttggtaagaatgccaatgagttgactttgagtgagatggcgatgattgccggactgccgaaagcaccttctactttaaacccgctctattcttatgatcgtgcagtcagccgtcgtaatgtggtgttggtgcgcatgctggaagaagggtacattacccagcagcagtacaatgaagccagaagtgagaaattggttgcccgttatcattcaccacagattgtcttctctgcgccttatctgactgaaatggtacggcaggaaatgattaaccgttatggtgaaaatgcctataccgatggatataaggtctataccaccattactcgtaaagtccaattggctgccgttgatgccgtccgtgcaaatgtaattgattatgatatgcgtcatggctatcgcggtgcacaggaagtgttatggactgtcagccagtcagcatggagccagagccaaattgttgataagctgaaaactctgtccaaatatggctcattgctgcctgcggtggtcacgaagtccagtgcgactcaggctgaagctatgctggtggatggcaataaagttgaactgactatggcgggcgttcgttgggcgcgtcaatttaaatctgacagtctgcaaggagcggcaccacgcagtgtcaatgaagtgattcgagccggtgaacaggtttgggtcagaaaagtcaatgatatctggtggctggcacaattacctcaagttaacgcggcgttggtatctctcaacccgatgaatggtgaggtagaagcgctggtcggtgggtttgatttcgagctaagcaagtttaaccgcgtgacccaatctctgcgtcaggtgggttctaacatcaagccattcctgtataccgctgcaatggacaaagggctgacgttggcatctatgtttaatgacgtgcctatcagccgttgggatgcgggagctggaacggattggcgtcctaaaaactcaccgccgtcttacgatggaccgattcgtctgcgtcaaggattggggcaatccaagaacgtggtcatggttcgagccatgcgtgcgatgggggtggattatgccgctgactatctgcgccggtttggcttgccgggggaaaatgtcgtgcggacggaatcgatggcgctgggttctccttctttcacaccaatgcaaatggtgcgtggctatgcagtgatggcgaatggcggttatttggttgatccttacttcatcactaaaattgaaaatgatgaaggaaaggtattgtttgaagctaaaccgaaactagcctgcccacagtgtgaaaatattccggtgatttatggtgatacagcgcattccattgagttgtccgaagattcgattgagaacgtgacccattccaatgttacgcaaaattcgactcagccacagtcagagttagagcgtgctccggttaatgtgaacaacgatgatcagcagtacgcgcctcatgtcatcagtacgccgctggcgttcctgattcatgatgccttgaataccaatgtctttggtgaaccgggttggatggcgacaggctggcgttcagcccgtgatttgaaacgccgggatatcgggggcaaaacaggaacgacaaacagctcgaaagatgcgtggttctctggttatggccctgatatggttgccacggtctggattggtttcgatgagcatagtagatctctggggcgtacacccgccctgaaaggtgaaggcggagcgaaaagtgctcaacctatttggaatgatttcatgaaagtggcgctggaaggtgtaccggtaaaagtgatggaaccaccagcaggcatcgtttctgttaccattgatcgtgcgacgggtaagctatccaatggtgggggcaatacccgtaaggaatatttcattgaaggtacacaaccaacggaatatgccgtcccagaagcaggaacgacagtcactgagaatggagagagtcaggaactgttctgattgactacaggaatcaaggaaaaaagccctgtcgggaaacggacggggctttttattattatcagcttatcaaaatctgttctctaagcgctcttttatcattaaaaagcgtcttatagcgggttgttgattccagaatattgactattaatcataccttttaaataagaagtgtgatgaattagagaacttattcttattaccaatccataacgcaggtttatgttttttggcagattggtatggttacactatggcctgtcaatgattgctatccagcgtaaaatatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgacccaatatttagcttcgagatagtcgataaggtgtgaccatattctcagctttaatgacagggatataagagttttaatttatcctaactgctagacttcaagaaaattttttcggagttcgtaatgagtaatttacccgtaattgttggtttgggtggtatcaatgcggccggaagaagttctggattccacagctataaacgcattgtgtcagacagtctcagcgacgagatcatgcaagatacatggctcgatttatgtcatcgaatgggcattgttaaaaatacagtatcggttacagatgcccatatcgagagtgccaaaaacggcacactgatcagaaaaataacgcacttcgatacgcaaaaagtatcttctgtaaccagtgcgggtcagttgccggaaggatttgaagttggtgatttatataacgcaaaccatcatccgcgcggtttacgtctgacagtctatggagcctcggatttactcagttcaattggcatttcatggccagatatcgccaaattggtggaacccgatcaaatttctgtttatgccagtagcgctctgggtcagatagaccgattttcattggcaggtttaattggcaacccacagaatggcacacgtattagttccaaaatgctagcgctttcccttgctgacatgccggcaaattttattaatagctatattatcaatagtatcggcaacacatcagctaatctaggtgcctgtgcaagctttctgtataacctcaaacagggcgtcaatgatatcaaacaaggtaaggcaaagatcagtttagtcggatgctctgaagcagctatcgtccctgaaattatcgaagggtttcgagttatgggcgctctcgcagaagaccatcaactatgtaaactggatggaaccgatattgttaacaaccgccgtgctacccgaccattttcaactaatgttggatttaccattgccgaatctgcgcaattcgtattactcatgagtgacgatcttgctttacagtgtggtgccaacatccttggcgctgtgcctgatgttttcgtcaatgcggatgccaataaaaaatcaatatcctcacccggaattggtaactacattaccatgatgaaagcagcctccctagctgaccatctactggatggcaaattacagtattcttacgttcaggcacatggtactggaacaccacagaaccgagtcactgaaagtcatatcattaatgaagttgccaaagtttttggactcaaatgctgggatgtcaccgccataaaatcgtatgtaggacattccatcgccgcctctgcgggcgatcaattagcctgtacattgggggtttggcagtacggatggatccctggtattaaaaccatcgatcacattgccgaggatgtacatgcaacaaatctgaatattttgatgcagaataagtttgcaggcgagcacggtgaggagatgcgtgccacaatcatcaataccaaaggattcggtggcaataacgccagtgcagttattttatctccacagcaaaccatgcagatgctgaacaaaaaacacggtagctccgctgtctacacatatcatcagcgtaatcaaattgttaaacgtataagtgaagatcaggatcgagcaatttgtcgtggtgaagaatcggttgtttacaatttcggcaacgcagtgatgcaatcatcagatataaaactttcacgtcaggaagtgaaattatcaggatataatcacaccataaagttgccgaatgcagaggaattcagtgcattcttgtgagaaagccatagggaatagccaagtacagtgcagtattcaagcgttattttatggctttactgcctgccatataaaactacgcctcaaatcataataaattaacgatgccctgtgttacagcaaattgccgctattcgtggtgccgtcaatggactaatggcgggtgtccttgaaagccatttacgtgaagaactgacaaataccgagcaaacaccagaagcacagaaagcctcgatcgaagatgccgtttctctgatccgaacttatcttcgctgataccccaattagctttattaatccatatccgcgaacatataacactgcctattcaaaaggagagtttatgaaatcacgagccgctgttgcattcgggccgggccagccccttgaaattgttgaaattgatgttgcaccgcctcaggccggagaggttctggttaaaatcagccataccggtgtgtgtcatacagatgccttcaccctgtcaggggatgatccggaaggcgtatttcccgtcatactcgggcatgaaggcgcaggcgtagtcgttgaggtgggcgcaggcgttaccagcgtcaaacccggtgatcatgttatccctctttataccgcagaatgtggagagtgcctgttctgcaaatccgggaaaaccaacctgtgtgtcgccgtgcgggcaactcagggaaaaggtgtcatgccggatggcacaactcgtttttcctataatggacagcctatttatcattatatgggatgctccacattcagcgaatacaccgttgtcgccgaagtctcactggcaaaaatcaatccggaagccaaccatgaagaaatatgcctgctgggttgtggtgtcactaccggcattggcgctgtgcacaatactgcgaaagtgcaatctggtgactctgttgctgtctttgggctcggcggtattggccttgccgtgatccaaggtgctcgtcaggcaaaagcaggcagaatatttgctattgataccaatccggcaaaatttgaactggccaaacagttcggtgcaaccgactgcctgaacccgaatgattacgataaacctattcagcaggtcattatcgaaatgacagaatggggggtggatcataccttcgagtgtattggtaatgtcaatgtcatgcgtgccgcactcgaaagtgcgcaccggggctgggggcaatctgtcattattggtgtagcgggtgccggacaggaaatctccacccggccattccaactggtcaccggccgttcatggcgcggaactgcttttggcggagtcaaaggccgcagtcagttgcctaaaatggtggaagaggcaatgaaaggtgaaattgagttaaaaccttttgtgacccacaccttaccacttgagcgcatcaatgaagcattcaacctgatgcatgagggaaaatccattcgtaccgtcattcattactaagtcgtattgcggaaattaaaaaccgcgctgtgaaaggagtgaacctgtatgttttacagagaggaaaaaatggagaggattgaacgccgcgcttgttttgggggatggcaggatgtttatcagcacgattcgaccgagcttggctgtaccatgagttttgctgtctatcttcctcctcaggctgaacatcagaaattaccggtgctgtactggctctcggggctaacatgcaatgaacagaatttcatcactaaagcgggcgctcaacgctatgctgccgaacagggtattatccttgtcgctccagataccagcccgcgtggtgagaacgttgcggatgatgatgcttatgatttgggtcagggagccgctttctatctcaatgcaacacaagaaccttgggcaccgcactatcgcatgtacgattatgtggtgtcagagttaccggcattgatcgaagcacattttccagtaacagaggatcgcgctattagcggccactctatgggaggtcatggcgcactgacaatcgcgctacgcaatccggatcgttatcacagtgtatcggcattctcgcccattgttgccccctctcaagttccctggggagagaaagcttttcgtgcttatctgggtgatgatcgtgacacatggaaagcctatgataccatcaggttgatcgccaatagtgctaaacccttacatttgttgattgatatcggtaatgatgatccgtttcttgcagaacagttacgccctgaattgctgaaagaggcatgcgaaaaggccggacagccttatacactgaatcttcgcacgggttatgatcatagctactactttgtcgccagttttatcggtgagcatatcgcatatcatgctgaggtattgaagggctgctgtgctgataattgatggattactgcaagttaagacaaaacgcctcgcaatttagcggggcgttagataataacatcatttaatattgcattaatacagcgatactttgccagccagcaccaatcgtccagaaaatcaggaaatcaccccggacaattttttttctttccagcgtttcataaagtgcaacaaatgggctattggttgcagtgtaaccatactcatcaccaataaataatgccttatcctgatccacaccaagttcttcacagagtcgtcgaatgttacttacagaaaattgtgaaaacataaatcccttaatatcagcaggaactaaattatgtcgtgaaagtaacaattggatagattcgaatgcggcggtaatacagatatcatcatcaaagggggtgaatttgacttgtgcagaaacatcatgccggtgaatatttgataatccacatgcagggaaaagtgaattatcgattactgaggtttgtatacgaaattctgagtctataaaaccattgccctgttcagttttatgaaggattaccgctacagccgactctgcaaaacatgagtggtagaccggtgcattactgctgtgagccccaagatagtcgctgcctacaaccagtgcaagctggcatgacggacttgccatcatcgccctggaaaccatttctaccgcaactaataaccccgcacaattggcattcatgtcaaatgccaaagccctttctccgcctccaatagcatgatgtattttgagcgccgttgaaggaatgagatattctggcgtttgagaagcaaacacgatgaagtctagatccttagcctgacatcccagccgctgaatagcattattagatgctgcaactgacatcgtgagtgttgtatcagatgaatcacggatcaggtaacgatttttatggccaagcgcattcagcaaaccactcatatcaatgccttgggcggcatagtgttctataaaccaattattattaaccgaagttggaggatgccaaattcctaacgatgcaatcgctactcttgtcataattgctcctatttataatcgtagtcattagaaatacctgatttatactaaatagtttcatcggcagggattaaagttataagaaacttacggacgttcctcatttttttaatgtcactctccgagaaaaatcgaacaattttgcttgccgaattaatgataattttcaaatcgtaaattctgcattttaaagttaatgggtatacatatataaagccatgttttaatacatactagcaccctataatcaagcatcaggctcatcccaatctcgactattaacacatagacatgatcagttttgcctgaatcaattaaatattttgagtcacaccactaggtaacattggattacttagctgtgtcttatgatcataataatatacattgcaaggaatattctgccatcgaaatagaacagcagtcgcagtggtcgaagggcccaatcccataacaatgacccaatcagagtcagtcaaatttttattatcctgcatttccataaaaccgaaaaagctctgtgctggccccaaacttccatatttgtgaaaaatagagataattttatctttccctacgcccaacgcttctgcagctgcactggcaacccaatcgctcgggtcataaacgtaaaaagcgctgacctcatttagactcattccgtttgattgacacactttattacagcactggtaaatcgtctccttcatattattaaatatatattcaccccccttcggtttatagtagacataacgttcaggtccttcattaaatttcaatacatcgtaatgtgcagtactcaaagtatgacaacccgtcactgtcataccttgttttcggctaagtactaagcatgcagcaccatcacttaacaaagtcctcgcgggatcgctcattgagaaccaatgcgaataattacaccccgcaataacagcgatgttatgaaattcagagttagcaaacatagcagtggcgatttccagtccagttgcaccaccacttgttccgacattaattgacaccaccggacaggatagctttagttctctggccagtcgtccggcctcatcgcccaaaatgttatcagaccatacttggctaagaatcagataatcaatatctgaaatatccatctgtacctgttttactgctgctaacaaactgactttcattaattcaattaaatcttttttatgctctaaacgccataaagtgcgtgatcgagataactgcacttcaccgggtgcgctgaattcattacgtatgttatcttctgggtgaataataatgtttcccggtggcaggatacctgccgccgaaataattgagatgttattttccatccagctcttcctttaatttcctgaaagtttcaactctatcaccgagaggagggatctcatatttatcaataaatgcattaattacggcaggtttcttttcttcaattgcatgaataagggcttcacgtaattcttttttattccttacgttataacctgtcgctccaatagactgtccaaatacagcaaagtcaacttgaggtatactgcagtcaagtggcggataacctaatagctcctgcccctgtctgcacatattgtaaccggaatcattcatcacaagccagatagcaggtaatccgaatctgactgccgtacttacttcattcgacatcagcattgcgccatcacctatgatacctactgcacagcgctcttttgatgcagccattcctaccaatccacaagcgtagtgccccatggcgccataagctgtacttacacgatatctcaatggattcgaaaacttcaggtagcgattagtccagacaaaggaatttcccgcttctgaagcaacataacaatcgaacatatcgatagctatttcctgaaccacactcatcacatcaagcgggtggatcacatcttttgctgcatctgaatagcatttatgactgtcatgtggtgctgaaatggccttaatgtgactggaaggtattactttctcagccaagcaggtatcaatagaagtgagaaatgtttcaatatcgctgtcaatgagaacagtatgcgagggcagattccctttaatttcctgtgcatttagacctatataataaactttaaccttcttaaggttattttgggcataggatgaactcagctcacccaatctgcttcccataatgataacagctgacaataacggacaatgtaatgttttattaatactttctgaatccgatcctaaaccactggttccggcataaagactatgtttttcatcaaagatccctttcccccgcggagtagatatgacccgtgaatttgtttttatagcaatctgtgtcaacaatgcagaagcatgccgagcaccaaatcctgcccaaaaaacagcattttcattgacgagcaaatcggctatttcccgtgaatgacgtttcgcattttcgtctaaatcatcatgagataaggaaagcgcctcatcattttcataatcgatgatttcctgctgcacttttgttgtcaaaaatataccaaccacgtaaccgtctttcttatttaatcctttccttaatttgctctcgacgtgagcgtaatcatccttttggtttatgatgatgatttcatcaaaataaccgtgtccatcagggatacacagtccatctatatcttgtactgtagtttcctgtaggctccactttcctgaagaggcaacagatgtgattgatgagataaaaatgacctttgcaccatctaactttgctgctcttaacccagttaatgcattacttattcccggacccgctgtagcaaaagcgacggctggaacctgatgacataaactgaattcagatgcagaaaaggctcctcccgactcatgtctacagtgaaatagttttattttttctgattccgttaattcctgccatataggtgcaataaaccccccggaaaccccaaatgccgctttaacctcacaatcctcaagcaatttaactaaagctttcgcaatattaactgacatgttatattttttccttttttaagaataaagcgtattagccatcctaataaaaataaatttatgatactaaccgctatcattaatgttcactcatagcatgtaataaaaatctaagtatgcacactaaaaaaagccgccatttaaattcataatgagatagttacataattataataataaaaaactccaatatattattaaatacataattcattcggatataattttcataaaagtcacttatatattatttattagtcatattacatttaactcaggaaaatacaaaattatcagtatatttatttttaagaataatttaaggtattttgtaaagcatagactattatctaaatcggcctattctattgtagttattattagatcatgatacacagacagggcataatttataacttacctattgcaaatatttatttttttcttctgatcccatgcaatccgttgacaatcaatacctctattttgatcaccacgatttgtccatgaatttaagaaagaagcagctcgacagatcaacaaatgagtttaatcactgagcgatctatcactcaggttcccactgatggcaataatttatcatagaaagtttcagtcagcgtccacatgacaccatctctacgcaggaggtggtattcagttaaataaaaaaacccagcatatttgctgggttatgaattaattcagctattaaaagcacttatatttgcacttttaatttatatgtatctgtcaaaaaggaatatcatcatcaaagtccattggcggctcgttgctctgtggagctggagactgtgccggacgagatggagatggctgctgaccaccaccactgaattgctgagaagcttgtggctgctgaggctgcccccaattaccgccttgtgctggtgcatcctgcgacgcgccgccgcgaccacccagcatctgcattgatccaccaatatttaccacaacttcagtagtgtaacgttcttgaccgccctgatcctgccatttgcgagtctgcaaagagccttcgatataaacctgagagcctttgcgcagatattcacctgcgacttctgccagtttgccgaagatcaccactcggtgccactcggttttttctctcatctcaccggtttgcttgtcacgccagctttcagacgttgctagagtaatgttggcgactgcaccgccattcggcatatagcgaacttccgggtcctgccccaaattacccactaaaataactttgtttacgcctctgctggccattgggaatactcctgatgaaatgaattttgctaaaaatggatttctctaattataagcaaagtagtttaccatgcgaggactaagtttaaacatagacccgttatattatactttgcgaagtttatcgtactttacactgtaatggttacagcatgaatatccacctaatactgtatatccactcagcaatatttgtgcaataataatgcgtttatttgttacacaccatcaattatctgggaagtcgtacatggataacatcgaagttcggggcgcccgcacccataatctcaagaatatcaatctgataattccccgtaacaaactgatagtcattacaggattatcaggctccggtaagtcgtccctagctttcgatacattatatgcggaaggtcaacgtcgttatgtggagtcactctctgcctatgcacgccagtttttgtctctcatggaaaaaccggatgttgatcatatcgaaggcctctctcccgccatttccattgaacagaaatcgacttcccataacccgcgttcaactgtcgggacgattaccgaaattcacgattatctccgcctgctgtttgcacgcgtaggggaaccccgttgccccgatcatgatattccgctggctgcccaaactatcagccaaatggtggataatgtgctggtattaccggaaggccagcgtctgatgctgctggctcctgtcgtcaaagaacgcaaaggggagcacaccaagctgctggataacctgtccgcacaaggctacatccgcgcccgtattgatggagaagtgtgtgacctgtctgacccaccaaaacttgaattacaaaaaaaacacactattgaagtggtcgtcgatcgcttcaaagtccgcgctgatctggctcaacgactggcagaatcattcgaaaccgcgttagaactttccggcggaacggctgttattgccaatatggatgacgagcaggctgaggaattaatcttctccgctaattttgcctgttccgtctgtggttacagtatgagtgaactggaaccacgcctgttttcctttaacaatcccgcaggtgcctgccctacttgtgacggtttgggcgtccagcaatttttcgatcctgagcgagttatccagaatggcgatatttctctcgcgggtggtgcgatccgaggttgggatcgccgtaatttctattatttccagatgcttaagtcattgtcagaccattataaatttgatatcgaaattccattcaatgacttagacccagccatcagaaaaacagttttatacggttcagacaaagaatccatcgagttcaaatacaccaatgatcggggcgataccacagttcgccatcatccgtttgaaggtgtgttgcacaatatggagcgccgctataaagagaccgaatccagcgcagtgcgggaagaactggcaaaatatatcagtaaccgttcctgcatctcctgtgatggaacccggctgcgcaaagaagcgcgttatgtctttatcgaaagcaccacgctgccgcaaatctccgagttcagtattggtcatgcgatggcgtttttccaaaatatcaaactgagtgggcagcgcgcccaaattgctgaaaaaatcctgaaagagatccgggaccgcctgaaatttctggtgaatgttggcttgaattacctgaccctttcccggtcagcggaaaccctttccggcggtgaagcacagcgtatccggctggccagccagattggcgcgggtctggttggcgtcatgtatgtactggatgagccatctattggcctgcatcaacgtgataatgaacgtttactggaaaccttgctgcatctgcgcaatttggggaataccgtcatcgtagttgaacacgatgaagatgccattcgggcggcggatcatgtcattgatatcgggccgggtgccggtgtgcatggcggcaaaattgttgccgaagggactattgaggatatcatgaccaacaaggagtctctcactgggaaattcctgagcggtaaatgtaaaattgcaatccctgaacagcgtgttcctgccaatcccgataaagtactggaattgattggtgccaagggcaataacctgaaaaaagtgacattaaaactgcctgtcggcttgttcacttgtgttacgggtgtttcaggttccggaaaatcgactctgatcaacgatacactattcccaattgcgcaacgtcagttaaatggagcgaccaatattaatccagcgccttaccttgatgttcaagggctggaacattttgataaggtcatcgatatcgaccaaagtccgatcggtagaacgccccgctccaaccctgccacttatactggcgtgtttacgccagtgagggagttattttctggcgtgcctgaatcccgcgcccgtggctatacaccggggcgtttcagtttcaacgtcaagggcgggcgctgtgaagcgtgtcagggtgatggcgtaattaaggttgaaatgcacttcctgcccgatgtttatgtgccttgcgatcactgtaagagtaagcgctataaccgcgaaaccttggaaatcaaatataagggcaaaaatatcaatgaagtgctgaatatgaccattgaagaagcccgtaagttttttgatgcggttcctgctctcgccagaaaactgcaaaccttgatggatgtcggtctttcctatattcgtctggggcaatcggcaaccacgctctcaggtggagaagcacaacgggtcaagctgtcacgtgaattatccaaacgtggtacaggccagacgctgtatattcttgatgaaccaacaactggcctgcatttcgccgatattcagcaattgctgtctgtcctgcatcaattacgtgatcagggaaatactatcgtggtgattgagcataatctggatgttatcaaaaccgctgactggattgtcgatcttggccctgaaggtggcaacggtggcggtgaaatattagtgtcaggaacaccagaagaagtggctcaatgtgaagaatcccatacggcacggtttttgaaaccgatacttgagcgtcaataatattctttagcatcccacataaacaaatattctccccactctgtggggagttatgcccatttgttgaccaatcttattttttccccatgcaataagggtatttcctacaatcatttctaataaaataaatttttgcttaatcaatgatcttttattgaactaatattattactgatcacattatcggtgcattaatgccataatgatataacatatgctttaaagtgataatggagattcaacatgtatatgtttttacctttcttaattgcgttagttatcattccaacagttattattggcaagaaaaagctgacctacactctttggtttgcattattaatcatcacggtattttggtttaaatatcatgcgactgatgcattgaacctttctttctaaccggagaccgtaatgaataatacaatgtcagcatcccgcagtcttaatcctgcaatggtcttaaatatccttggtctattcggcatcagtgtcgttttgataatcgcgttctattatcaattggcacgttttgaacttccctgcccattatgtctgttgcaacgtgcaggtatcatcatgattggcttaggttttctgttcaatatttatttcggtattaaaaatgctcactacagtctatctctgctaggctgcctcgtgaccggttttatcgctatgcgtcaagtctctctacatatcctgccgggagatacaggatatggctccaccttcttaggcttacatttttatacttgggccgcagtcttatctattcttaccattattgccatcgctgtcattatgcctctgaaagcaggcaactccgattcatcaagatacacaccgcccacattaggcaaaatagccatggggctgtttgcatttttgatcgcagctaatctggtttctactgtgctggagtgtggtagcgggcaatgtgatgataacccaacattttatcagctattgaaaaagtaaccctgtttcattggaatagctaagacaggaaggctgatatattccacagccttccacttctctacaaaaatattcagcgactatttatttaacgtcagctctgcttaagaaccggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgacccctttaaccacgtagtctaactgcgcatcaaatcctgccgaacccactgacagcggtaactttgttttgcgctttggataaatgctttcgacattgtcataacggcggctttctattgtgtgatggttcattggttcccctgcttgatataacccgttactgaatgcctgttttgctgcttcaatgccgtgttgttgtcgacaatcgtcccagtcagctttgatattatccggtggcaatgtgacccagccattcactgcgtaggcggctttttctgccgagatcttgccaacattctttttgggtttgccgtctttatccagctcgcccggtgtgtgccagtcattatctgctgcaataatgatttttgcgtccggccaacgttcccgaatggtttttgcagtaggaaataaatttccctcatccagcgcggccagaacaacaccttcgtatagctggttaaccgtgagtgccgtggcgtaaccttcggtaatgatgacggtatcagggttctcttccagcgttgataaaggaataaacgcaccttttttctggctgccggtgaggagttttttctcgccattcggtttgatgatctgcgcgcctgtgactatattgtccagtgttgcgagtcgcaacacagttgaattatcaggcaataaccgctgattagggcaatgcagcccctttgcagtcagatagggagattgtcccacaacagtttgcgccatcagtgccgcgactctgtcggcaatcggttgtgttggatagaggttttctttggctggtttgggttctggcaaaggcaatgccaacgagccagcaatgattttcgctgcttcagtaatcgaaatcttttgggttcttgccactaaatccagtccatcgccatagttcggggcatcacactggcggcaatgccagttaccatgatggtgatcatcaagaaagtgaaaacggtcagtaccaccgcaaataggacaagcgccatgtttaccctttgccggaacatcaataccacaggcagacagcagatttgcccatgaatacatggccgatgttttcacggtctggatcaggtcgagcggtttttgactgccggattttttttgaactgtaaattcagggcgagtttgggtatgctgtgtctcagccatcgtttttacctcaagtaacggttgttggtcagacgcctcagatgtgttggtcgcacactggggcgttgtgtttttatgttacatgtcttacgtcatactcttttctgtgttatgccgcccgtgattccgcgatgcgttgggcaatccagttatctatttctgattcaataaatgcgatggagcgggggccgattttgacctgcttcgggaattctccatcgctaattaatttgtagatccacgccttgctgtaacccgttcggcgctgaacttccggcaaacggataagatttaccttcaatgctgtcactgccatattcattctcctgttaccgagtccctgagcgctcatcgtggacgttgtttgatgacaggagaattatttaaaaagcacccttaaatgaacagcgttaattgtttctctcacaatgagaattaatggattaaagaatgaactatcggtttgctctgtcgcgcagcggtttggcgaagtcatagggtgtgattggtttttcccggttggcatccagataatccgcccaccactgcaccatcagccgccgttcgtccagatgcttggaggtgtgaatataggccgcccggacgttgtttcgttcgatatggcttaactggcgctcgatagcgtcatcgctccacaggccggattcccccattgcaccacgtgccattgtgcggaaaccatgcccgcagacttcggtttgagtatcgtaccccatcgcgcgtaatgccttgttaaccgtgttttcactcatgactttcgcggaattatgatcgctggggaacatcacgtcgcagttgccgctcagttcgtgtaacgcgttgataagaccaaccgcctgacggctcaacggtacaatgtgatccgttttcattttcatgccgcgctcagaaaagcgaacgcctttaatcggttgccttgtggcagggattttccatactgaattttcaaggtcgatttcctgccagcgggcaaatctcagctcactggagcggacaaacgtcagcagcgccagttctaccgcgattttggtcagtaagcgtcctcggtaagcagacaatcggttcaggaaatcaggtaaacattcatggggcaaggcggggtgatgacgggattttgcggtggtgagtgcgccggtcatatcgttagccgggttggactccagaatatcattctggacggcgtagcgcatgatggcggtgatacgctggcgcagccgctgggcgatatcgtgtttgtcctgctcatcaatggccttgacgggcgctaaaagctggctggtgcgtaatgtggtaatatctctggcgccgatatgggggaaaatatattgctcaaggctgcgcaggattttttgacggtggctgtcgctccagcgtttgttactggcgtgccatgcacgggcgacttgttcaaacgagttgactttggcaggcgttggtgtgcctttcttttcggctttgggatcgatgccctgtgccatcagttttttggcttcatcgcgtttagcgcgggcatcggctaaggatacagtcggataaacaccgaacgccagacggtcttcttttttatcggtcgggcggtaatacttcatgcgccagtatttcgagccgcgtgacgagacttctaaatagagaccgccgccatcggcgagtttgtaggttttttctttgggttttgcagtttcgatttgtcgtgcattaagtttcattgttaagggcattctcataatcgaacggtaagtgccccgaattatgcccttcgctgcatcttgattgcaacagacgaaactggacgttgagataggtaagaaggtttatttttctggatttgatgcgaattgtttgactgggctggacttcactggaagttgaagtggtgcccggactcggaatcgaaccaaggacacggggattttcaatcccctcctaagttgaaaaaatgttaatagtgtaattcttattactttgtgtaccgattctggtgcgcaaaatgataattcttcccataatttcccccaaagggggcgaaggtaaatcgactcacgcggctaatctggccggtttttttgccgatgccggtttatgcgttctcctgattgatgcggattactcgcaacccacgtccagcagtatttttcccctgagctatgaagcgcccgccggattgtatgagttgctgatgcagacggtggatctgaaccagtctgagcagatcatttcccgttcggttatcaaaaacctcgatattctgatctccaacgatccggatgaactcctgcccacggcaatgctgcacgcgcccgacgggcgtttgcgtctgcgcaatgtcctgcaacatcctctcttcagccagtacgatattattttcattgattccaaaggggcgaccggcgtgatgagcgagctggttgtactggcggccacgcagggcgtgctgggggttatcaagcctattttacccgacgtccgcgagttcctgcgcggcaccctgcggatgctgacccggctccggccttttgaacactacggtatccggctgccggctatccagatactggtcaacgggattgaaggaacgaatctcgaccgggatacgctgagtgaactggctgacattatcaataatcaacggtatgacgcttccgcactgggcggcaggcaggtttaccagctgctggaaacccggatagacctgctggatatctacaaactggggcatgtccgtgcccagcccgttcatcgccttgagtataaaaccacccgaaaaagcccggctgccgcgcaaaccatgcaccgcctcgcctgtgagttagtgcccttatgggcggaaaaattcgacgcggtattgactgtgcaaccgacaggagaggcgcaatgaatgttatctggcgggcggtctgctttcgttatgagcgcgttgaattactgttcagtgatgatgagaggtttgtgtttgtggatgcgccggatcgtgaaaccgcgcagacgaaacttcagatcctgttgccagctgttcccgatgtttctccggaaggggtagagcattattatccccgtatgcgcaggcaggccatgcgccccgatgcgtctctggatttggcgttgctggaatgtggctgggaaaatgaccagccgcagtatctgacccataacgaggtgctgttctgggtttcttcccctcatctgcaacagcgtttaatcgctgccctgaatgcgatcagcagggaggcagccgatggacatagcgcatgaacatttacagatcatcagtgaagaggcgcccagctatgcgtatgccgaagtgggggtgttgggggggctggtactggagaatgagcgctgggatagcgttgtccagctattggttgccgacgatttttattttccggcacaccggataatatttcaggccatcgctgaactgagcgaaaaaaactgtccgttcgacctgattaccctgaccgataggctgacccagcgtgggcaaattgatcgggcatgcggttttgcttatgtagcggaagtgtgtaaaaacacgcccagtgccgccaatattgaggagtatgcccgtattgtggcggaaaaaagccggttacgtcagttactggcactgggaaaatccctcagcgctgacgtttttcagccgaatattcagtcagataccctgatagagcaggcagaaagtcagttgtttaatctggctgaaaaaggttcgacccgccagcatcaggaaatgaccctgttgcagggcgcagacagcctgattgcccatctggagcgaatacaaggctcacagggaataaccggcacaccgaccggatttcaggatcttgatgaaaaaaccggcggcttgcaggccggtgatctcattttgctggctgcccgcccttcgatggggaaaaccgcgttgggactggcctgttgcttgggtgtcctgcggcaccgggatgatgccgtggtacagattttcagtctggaaatgccggctgcacaactgatgctgcgcctcactgccatggaaggcggggtttctctgagcaccctgcgcagcgggatgctggatgatgagcagtggggacgcataagccagagtctggatcagtttgcccgctgggatcagcgtctggttattgatgattgcagtcatcagacgcccgcactattacgcgcccgtgcccgccgctatacccgcaaatacggtcaacccgccctgattatggttgactacctccagctgatgtgcgcgcccgggcaggaaaaccggacgcaggaaattgccgatatctcccgtaacctgaaagcgttaggcaaagaactgggctgcccggtactggcgctgtcccagcttaaccggcaggtcgaaaaccgttccgataaacgtcctaacaatggtgacctgcgtgattccggctcactggagcaggacgccgacctgatactgcatctctatcgcgatgaagtctatcacccggacacacccgatacaggtactgctgaaatcattattggtaagcagcgtcaggggccaacgggcgtggttcgtgtgggatttgacggccaatatacgcggttttcggacttatccgcagacagtgatggttacggggagtaaatgatggcacggcaacctctcaatatgggcaatgccctgttacaacaagggcgccaggccgcggcgacactcagtgaacaaccccctgtgtcggaaatgccgatggtactgacactggatcaactccgccccaatccggataacccccgcaccagtcggaacccgcgttatgaggatatcaaggcctccatcaaagtacgcgggctggatacggtgccgaaagtcacccgcgatccggaaggtgaagatgtctatatcttcagtgacggcgggaatacccgttatcaggttttgtccgaactgtggcaggaaaccggcgatgagcgtttttatcgtgttcactgcctgtttaaaccgtggccgggcagattgcagtgtgtcatcgggcatctggcggaaaatgaactgcgcggtgaactcagttttattgaaaaagccctgggggtctgcaaggccagaaccctttttgaagtacagaaccagcagaaaatcacccaaagtgagttgtctgcactactgggggaagccggttttcctgtcagccgcagttatatcagccggatggaagataccgtgcaatatctctatccgtggatgccggatctgctgaactcggggctgaaggtaccccaaattcgtttgttactggcattacggcaggatgccgaggccgtctggctgcaacatgttgtcagtgcaatatcggagcctgcctgttcctttgatgcgatttttggtgcctgttgccgcaaatttgactccccggaatcctggtcaccggagatgttccgggatgaacttatcggcgatttattgcaggtattgccgcacccgcagctgaattatgaccgctgggtactggaactcgatccgaaggaaagtaaccgccggcaactctttggtgaacaggccaccccggttgaccttgtgccggaaaagccggatacgcctaaagcggatcgggttcgggcgccagacagggaaccgaaccggcgcataatgtctcaacccgtcacggatgcggagcaggcatcggagacaacatgcgctccggtcgataagacacccgtgcctgctccgtcttcccgaaacaatccggtgctcccgccttatcagccggatagtccgtctgaaccggcgctgtctgagcctgaagccgacgatctccactttgcccggaccgggctggagccggtcagctcagtctggcacatttccccgatgcaggacgatatcgagcatttgcaaaatatggcgtttcgcctggcgtttgaactggccgaagtgatgggctgtgaccgtgatttgctgccggtatcggatgaacggtcggcgggattttgcctgattgacgggccggatgttcatcctttttcgtgtttattgcactccctgaccggggaaatctcgactgaccgtcatgaactgacgctgactgccgttctgctcggcaccgccggacggaaggcggtaccattactggatgacagccagaccgtgaagtttttgcggctgctgcggattatccgccgcctgcgtgaacttcagcgtgaaatggtgccggagatgttggcgatgtagcgataccggtccggggtgcctgcttttcagtgtgttgctcattcattgtgttttgactggcctgataatggaggaagtgtatgaatcatttatcgcaagcgaccaacagcctgttgttgcagttggtgatggatttgaagaacggctatatccgccgttgcgaagcactggggctggcaccctcggagatgctgatgttacagagcctgacgattgaggatttgcattatctgggcaacagcccggtatcggtgctgagtgtgcaaattcatcacgccaatctggcccgcatcttacatcaggcgcgtatcgaacagcagcggatacaacgcattgaccgggctctggcactcagcggatcgattgatctgatgcactatttttttggcctgtccagtctggaggtggcggcgcgccggcgtattgccggtattgccgtgaagtcggggcgggtttcggtgctgacggaagcggaaaaccgtgacctgtggcagcgctggcaggcggcaaagatgagggatgcggacagtgccgacgggctggatatcatgatggacgtggcggagcatcatgatatttcgctgacgtccgtctggaatgccgtcaaagaatggcagcaacagggtgcatccggatcggtctctgtgaaaaaacagggataaaacgggtcatacaggaaacgatgtcaggaaaattaaccgaaatcatgcccggcctgcatgtgccggtaacggcaccgctgtcctttcgccgtaaggcgcaatatcaggtgaaatgttatcggcggggtcagcgtaattacgtccggctgaaggaaaaaggcaccgggtatctgaaaatcaacgtagggctgttctggcggctgttaagccgtgacagcgggcagtcgtgggagctgatgcaccacgaacgctacaacaatgaaattcgtaaatcgtaaatgtgactgaagtcgtgtcattctgcgccttgtgcaacgccacagggtgcagccctgacattatttttacagattaacaccggagagaagggatcatgataaacctgtcagcagacagcttaattgcccacactatggccaaaatgaaaagccgtctggaacaacgccccgacgatgacgtttcacagctgcgcagtggtctgctgtttatgggtaacattcaggatgcctatccccgtcgcctgttactggatgatcgcctgtcaccactggataaaacgggctggatgatgatccgtttgtatgcgcaacaaaatgaaggggcggttttccccagctacgatgaattgcagctgctgctggcctcgccctataaaggcaaagcctcccgtgaaaccgtcagccgggtattgctgatgctgcgaataaccggctggctgagtttatgcaagcgtatccgcgacgagcatgggcgggtgcggggcaatatctatgcgcaacacgatgaaccgctgacctgccgtgatgccgagattctcgatcctcactggctggatactgtggcagaagcctgtcgcagcaaaaaccgcactatcagccagacggcacgggaggtactgactgacattcaagaagatccactgatgcgtcatcgtcacagtcatatccgtttgctggaagcgcggctgaatgcggtgcagacgccacagcaaagggtcatgaggcaggcgcttcaacagggaaaacagcaaaccgaactcagggaaatgaaaccgggttcggaaaccgaatccggtcagttaaaagggcagaataagccgaattcggaaaccgaactcagcatgaaatcaatgacttgtcgtcaaaccactaaaccgaactgttatgtacgttctttcacacagagtgtgaataaaaaaacatacgtagatacaccgtccgctatttttctgccggaaaagttatgcaggcaactggagccggaagatggggggatgctgaacagccagttgcaggcactgcctgctgaacaggcgcaggctgtgttgacttgtctggataaggcgttacaggcaggtaaaatcggtaatccggtcggctggctgctggcgatgatgaaacgggcacgggagggaaaactgtatgtgcaggccgaaccggctgtcacgacgacggcggctgcgaagaaacccgttgaattcacacgggaaacggcgcgttctgttcccccctcttcacaagcccatgtcagcagtgtagtgaaagacattcgtcagcggctggcgcaggcaaaatatcaccgtgatgacatggggtaaaaaccgggttgtgttgcccggaacagccatgattaaaaattatactggtgtgcccggggcacaggcgactaaaaattgtgctgccttgtttgaggcaggcaagtctgaaaatctaccgtattgcctgagacagcagtggttgaaaatcatactggtgtgcccggggcacaggcgactaaaaattgcgctgccttgtttgaggcaggcaagtctgaaaatctaccgtattgcctgagacagcagtggttaaaaataatactggtgtgcccggggcacagacggctaaaaattgtactttattagccgggcgacaaagacgataaaaataatcttttctacgatcccgaaaaggggtcgttttttccttttttcataactgattatctattgagtcgcagacacctttcccctgatagtcccacagacataaaccgaccaaacaggagttgctctttatgtctgaacctgatgaaaaaaccgcaccgtcgcccccccgtcgtgccggtgcactgaaatccacgttaaccattgaactccatacccactacgccatccgcctctgggcagggcgtaaaaaagaagacgtcaccggccgccgtcaatacccggacattatcggcatgccgcaggtaattaaacgggcgggcaccatcagtgaggatgcggctgccgataacccgtatgccgacagctggctgatgaaactggaacaggccctggtggcggcctcggccagccttcagcagcgtattgccaccttgcaggaaacactgaacgccctgccggcacaggtgacgttatccgcggtttcctctgttgaaccgctgaatatcggggtctacagtcactccccgctgggttaccgctgtgtctggctgttggtcggtttcgaccagctggcgatgaaaacctttcaggcgtttcattacggttttatttctcgttcagagcgggatgcgttgctgcataacggcagtcgggtgatccgccagatttaggtctgtggttttcggatacgagctcgaattgctataaat

SEQ ID NO: 14964 - DNA, 57889 bp, Xenorhabdus bovienii
  Genomic contig Name=Xb4151_4152.C423
ccccggcttcaatctctttgagggcatagccgttaccgtcaatatcaaagaccactgtcgcctttgtctttacagccgccgcattctccccgacatcggcctgcaccttttccatcttctccgcaaaggcttcccggtcggtcacctgcgtggttttgacttccagtatttcggctcgcatattgccgtttacttgcaactgtcgctgaacaactgcccctgtcaatgcggcgttctccatgatggcttcggagttaaagtccatttgagactgcaaccgttgtcctgctttgttggaaagaaattccttaccggctgcatcaatgatccagttcgtatccgaagacgactccccacgaatgaacgccgtccacggggattgattgccggatttatccaccagacgcgcacggaaataaaatgcaacgcctgccgccagcccctgcatcgtgtgcattcgctggggatagggaatatcggccagcaacagtaaaccctcaccgtcattcgtcctgctgtactggatttcagttttcagtgtgtcgtcggtctggggcgcaaaaccccagtcaatctggataccgaagataattggggttgttctgaatcccagcggtgccggagggttgccttgttttccaacgatattgacctcttcagaggagataaataagctgggaatatcaaaggagttgatggctttgatacgggcctgatatctgccggagtacgcattaggtatttcaaaacccaatgacgcggtacggggaatagaaatccagttcccgctatcccggcgccactctcccacataggccgccgccccttccgctttctcccatgcaatccgcacggtagtggtggaaatgccttgctgaacaaacgaaaaactctcaatcctgattgaattcggcggctgctggacgcttgccggaataatggaaataggccgttcgtcgattctggcgcccgtgtcgatacggtcgtatttatcgggatcgtgatacaggccgttgatttcgaatgtaccatcattgttatctttgatgccgacaacgcgatattgctgaataaataaatcatgggcatccaccgcccagccagcaccggatacaggtgattcactataagtcgtcgtcacggtaacaatgtgaccattgacggcctgaaccgtccggccttctgattttcctgtcggtaaattaaccaatagacgatcacccgccttcacatcaggttttctgtccagtgtgatattgcgatcgttcaccgactgaatgcgaccaccgatagtgcgcccggctcggtttttatgtgccacgccaataatatgaccgggcatcgggatttgaccatccagccctacacgaaatgaaatcatgccatcgcgtgagttggtcaggattgcccattttccccggcgttgcgcctcactctgacgggtgcagccgatagcggaaatatcaatctggttgataccataacgtcggattaaattatcgtctgaaacaacttcaacttcatcattgtaatgattgtttggatttgaccagctcaccatggcaaccgtgctacggttacgttcgccgccgccgctgtaaacaaagtcgccattgataacgctggcctgagtgaagatatatttaatgtcatccggcatatccgccgctgccacgaactgattagccccccagtgaactgaaccccggaatatggcgccaatatcggtcagcactttatgtgcctcttcgcgtgattgtatgtaaacatcgcaggtaaagcgcggttccatgccaccaccgcctttgccatcagggaccagttgatcgcaatactgcgccacgcgatacagttcgatttcatcaatttgcgtgcggtcgattttgtcgccaaggccgcataaatcgtttagcagtatatcgtacagtacccacgccgggttattactgtgcgcccatttgaaggttaagttccagatgccactgtacgtgcggttaaccgggtcgtaattggcgggtacgcgaataatgcgccccttgggcttacaggaaatcagcggggtattgccattgaataaccgggcgtcaaattcaacgtacagcagcgcggtattcgggtagcgtaatttggcgtcgataatttcggtaaacgccatgatattcattttatcgttgatccgctcgctggtgctgtctggtgtttttctgacaacacgaaccgtccagcccgttttggtatcaggcagattaatgcggtatgagcgttcatacagggtggttgttttggcgtcaatatgggtatcaaacacagcctgatagctgccgccatcggtggataattcaatggcataatcaacgcgaaagcccaccgtgtcaccattttctttttgcattctcaacgtaggccagccgagacggacacggacggccgataacttggtgttggaaatgtattttgtccagggcacagcggtttttatttctgtacccagacggatttcattttcagccgcgctcatgcctttgatatagttctgatgctgggtaccggggcgaaattcccatttcacgcctgcaaaattcatggttccgttgtcgttctgcaagggtgtgccgtccagatagatatcttttgccgtcagatcattgacgaactcaccctcacccaaggccaccagaattttagccgtggccgtcgattgaatgttatcgggcatttcataaggtgtatgtccgccgcccccgccgcctttggcgccctcgataatatgcaatgtcattgttcgcctctgaaataaaaaatctatggtccccaccttttttgcaacactgatttttgattgatgttggcttgcttaaatctatccggcgtcactatgggcagggatgcccgcgcctcgatgagttccgcacctgataagcctaaaaaaccgcacggcttcagagagccattttttatgtcaggattccatcaggtcgataagccgttcatgtcatcaataatcagtcttcgcaaaaccagattgggaactgctttaattaacgattaacctgccagtcagactggcgtcgtcgttacctttcgaacacagtttgccgtgttgtgattgcccaggctatccgggctaatttgttggccagcgcacaggccacaacatttgagtgttttcgctcaagctgagcctttacccattcagccagccttcctgactgataatcgattctctggataaagactctggcgcactggacaagtaaccgtcgcagatttttgtctccgcgtttacttatccctaaaagcgtatttttgccacccgtgctgtactggcgtggtaccagaccggttgaagcagcaaaatcccggctacagccatactgcttaccatcgcccagctgcgatgataagacgctggcagttatcggacccacgcccggtattgtctgaagacgctgtcctgtttcatcacgtctcagctcctgctccagtgccgtctcaagctcggtgagctgttcgacaagataaagataatgggcatgtaagcgcatcagcaactgtgccagatagggaggaagttcgttctctgccaagacggttgaaagtctttttatcacggcggttccgatcggcatactgatgccaaattccagtaaaaaagcgtgcatctgattagtggttttaaccctgtctctgaccagtgattctctgacccgatgcagggcgcgcatagcttgttgcgcctctgttcgtggttgcacaaatcgcatggagggacgagatgcagcttcgcatatggcttcagcatccacaaaatcgttcttgttgctctttacaaaaggacgaacaaattgtggagaaatcagcttcgcttcgtgaccaaaagcagcgatccggcgagccataaagtgagcaccggcgcaggcttccattacaacagtcgctgatggcgatcccgctaaaaactccatcagtctggcgcgggtaaattttttacgcagcagggcctttcctgatttgtcctgacagtgaacgtggaaagaatgtttgccgagatcaataccaataagcgtaacgttttgcatgatggtcttctcctgaaagaaacaccctgccagcataccgctcacagggtggtggggaccatctcattaaccgccttgctaaaaatagtcttttttgtgatcgggcgcataaaataaacacaatcatgattttgtcaaagctgttacctatttttttatttttatctcatgatgttacgaaaaaaacaccttttatggataaacattaagtggttcgatacactaatcacatacgctatctaagaatattatttttcaaccgcaatcattttaattttttacgctgttattgtcggataccattttttatttcacttgatttaacttggcctttactccttctttatttattattgccttcattttatttatcacggatcagccgatatattcggacaacagagtcccttcaaattatcggaaaacaacctattgcgtccttaattaaccaatttgtcggagacaatgtgagtgagatttaaatcttgtacccgaatgttatggcctgtgttgttatcaggcgggatgcctatttcataacattccatcatcttagggagacacaccatgtcaataaagaagaacctcgataaattgaagaaagggcaagcccttgttcagcaggggcaagaggctgttcagaaagcgaaacaagttgcaggcaaattgggcagcggcatgtcaggaacagcaggtttaatcccgggtggtggttttgccggcggaataggcggccgttcaggcagcggcatgacaagcaccgcgggcttaatcccgggtggcggttttaccggtgggcaggggctggcagaacgctcagccgggggacagaatgccgccaccaaagcactggaaaaagtcggccagatgctgatgggcgggcgtgacccgagtggcctgcaatttaccctgaccgcaggcagcttaccgccacagacgtttgtggtgaccgatttcaccctgaacgaaagtttttcccagccgttcagcctgagtgtgggactggcgagtgccgacccggttattgactttccggccgtactggatcgcaccgccacgctgaccattctgcaaaacggtatcgaacaacgcagcatcacggggatcgtttcccgctttgagcagggtaacaccgggttgcaccagaccacctaccagatgactatccggccggatctgtggcgcacgaccctgagacagaactcacgtattttccagcagcaggatatcgccaccatcatcaccgccctcctgaaagaacacagcatccgcgatgtgatcttcagcctgcgccatcctcatcccgcgcgcgaattctgcgtgcagtatcaggaaagtgactttgccttcctgcaacggttaaccgcggaagagggtattttctacttcttcgaatgcagtaacgggcgcaacacgctggtctttgccgatgactgtggttctgtgccgccgggcatagtcatcccttatcagcccggtgaagtcaacaccgtgggtgaacctgccatcagcagcctgacatgcagcgcacaagtacggccggctcaggtacagcttaaggattacactttcaagaacccggcatggccggcggaatttcaccagcagatgcgggatgaaaatctgcaacaactgtactacgagcactacgactaccccggccgcttcaaagacgaggcgcatggcaaggattttacccgctaccggctggaggcgctgcgcagcgacgcagtgaccggacagggcagcggcaatgcgatagcgctacagccgggtaaactgtttatcctgaataatcatccacggatagacctgaaccagtcatggcagaccatctccaccagccacagcggcagccagccgggtgcactggagacagcaaccgacggcgcaggcaccacgctgcacagccacttctatttcatccgccagaatcagaactggcgcccggcaccgctgtccaaaccggtggttgatggcccacaaatcgctaaggtggtcggcccggccggcgaagaaatcttctgtgaccaatatggacgggtacgtctgcaattcccgtgggatcgctatggcaaatccaacgaccagagttcctgctggatacgggtgagccagccgtgggcgggccaaggctggggcatcctggccatcccacgtatcggacaggaagtggtggtggatttcctgcacggcgaccccgaccagccgatagtgaccgggcggacttaccatgccagcaacatcccgccgggggccttgccgggcagcaaaacccagatggcgttccgctccaaaactcacaagggacagggctacaacgaactgctgtttgaggatgccaagggcagcgaactgctgtcactgcacgcgcagaaagacatgtacaccaaggtgctcaataaccgggatacccatgtgctcgccaaccacagcgaaaccgtggagaaaaaccagaccatcacggtcaatgagaacaaagaagaaacggttacgctcaacagcacggaaaccgtgaaagaagtgcgcaaactgatcactggcaaggactacattatcgaggtcggtacccacaagatagaaaccatcaacaataccctttccatcacaactggcgatgtgatcgagctacgctgcggagcaagtgtgttacgtatggacagtgccggacgtatcacccttcagggcagtgagtttaagtttgaggccagcggcccggtgcaaatcacgggtaaagacatcgacctgaactaaaaaggacggattgagatggaatttcgtaacctgaccccctttgcggtgatgaactattcaatgctggatgttgaggatgtggagcaccacgtggcggtcataaaaatcggctaccagctattgcctgtcggacaaggggaatacagtgctgaattactgcccgcgccgcgcctgtgtttacaggatgaataccgtgaacagatgaatgcctcacaggtgttgcaggagagtgatcttgccccgtttaaaccacgctgtgacgtgattgtcaacggcacggcgtatgcgccggataaccgaccctgtactgagtttcctgtacggctgcgggtaaagagcaaacagggccagaccctgctcgacaaaaccctgaccataaccggtgaacgggaatttattcgtgatgctggcggtcagtggcaactgaccgacccgaaaccgttttcaacactgccgctggattatcgctatgcctttggcggtgaatgcaaaatccaagcagatgataaagcgagcgaacacctgaaagaacgtgaccggctgacaccggaacagcgccggcaacatccagacggggaaaacgctcctgttgctcatgccgtgtgtgaaagcaacccgctgggtatgggatttatcacgccgtggtatgcacaggccaaaccacttacccgttcccctgccctccgtattacccgaccggatgccccgttcaccgcgcagcattttaccactcaactggatggaacgttggcgcctgatacacccgcctgccagccacaaggcatgggctttatcggccgtccgtggctgccccgccgccagctggccggcacttacgatgccgactggctgacacatcgacatccttacctgccaaaagattttgactttggctactggaacggcgcccccactgaccagcaaattgactggccggacacggatattgccatcacgttaagcggcctgacgcctgatggtgaactgcacgtcaatctgccgggacaccgtccgtttattctgctgcgaatgcacaacggcatattactgcccgtgccgatgcgtatggatacgttaattatcaacagcgaggcaaggacgctgcacatgacctgccgactgagtttcaaagcctcactgcccgtgcgagtggctgaaacccggtttgaaatcaacccggatgcccccttgctcaatctggcaccactggaagaggagaaaacggatggctgataattacatcgcccgcactgcaggcgaatggctgatcatcggcatgttgcccgacgtgtgcaaaaccccgatgggcgcgtcaacaccgccgatcccgtatccggtcattgcgaaactggcaggcagtgacacccccgtgaaatcggtacgcgccaatggccaacccgtagtggtatttgcccagagctttgtgccgacaactctcggcgaccagccgggcgtggccaacgggattaagagtggcacggtgggggcgaaatgccatcccaaagcgcataccaacaccgtccgggccggcaataaactggtactgcgccacggggatgaattctggatgaatggcgcataaggaaggaaaccatgtcagaagataaagctaaccgagaggacgtctcgtcagaaacgggcgaacacattccgccacaacccaatacagccttaccatcaaaaccacgcagtgacagcccgactggtgagggcaacacgctgggtaaaatcatcggtcaggcaccacagggggcgagttcgccccatgaggcgaatccggtggtgataccggaaagcaaacccgaaatgagtgcatgggaaacgctgaaaacgatgggaaaagcgttaggaaacgctgccgtagacaaagccaaagaaacaaaacaagacctgtcaaccgtaagcggatgggatccgattgaacagcagaaaggcattgccaaaaccgtcagtaataccgccgtggggctgggcgaaatggccattaagggcggaatgctgaactcagctcgtgaagcggacgaatcggcccgttcattagctttctgggggaaagtatttggcaaccctgacaccgaaaaacaggctaaagtgataggcgaagtcgccgatgccggccgcacgaatgccaaacagtttaatcttgacgagtacaagatgacactggacacgcccggacaacgtattggcggcacagccgctgatattttcatgcttatcggcccgacaaaaggtgcgggtactgcaggctcagtgactaaagcacccgaaatcgcgaaagtggcagaagctggtgcactggcgacaaaatcccgtgaggcagcacaggtcgtagaagccagtacacaggcggctaaaaacgccaaccctgccgctggggctataatcaaagaaaaacccgcgacatccccgaaaacggaagtcaaacccacaacagaaaagcctgtcgataacgccacctcatccggcaaaaaaaagggcaatgacaacgaactgtccagtacaaagggcgatccggtcgatatggccaccggcgatttcctgcaagtctggccggttctcgccattccgggggtgttgccaataaacctcagccgaacctaccgctccacggcggatttacacggcctgtttggtgccaaatgggcggatgactggtcactgaaactggctatcagtcagggggaagtgcactatacccataccgatggcgttatctacgattatgccacaccggataaccgggtcttgtcccgtaaccgtaatcttccccattgcctgttgacgggcgaactgaccggcgaactgtgcctgaccgaccgccgcacccagttgacgtaccatttcagcccgatgtcaggcaacacacgaaaattgtctgctatcactgaccggcgtcagaaccggattgattttatctacgataagcagtcgcaactgacggccgtcactcgcaatgacggcctgcggttaagcctgcattatctggacggccggcttaacacgatcacgatgcaggaaaaccgcgaaggtcagcctgctgagcaatgtctgttgacctgtcaatatgactcacagggctatctgaacgagtgtgatgctttccagcacaaccacctgtggcatgaatatgatgtgcaggggcggatgatccgctggcatgataccgaccagactgacctgacgataacctatgacgagcgcggtcgggtactcagcaccacctctcccagcggctactggcatgaccgtttccgctatgatgacaacgcccgcattaccacctatctggatggcgaagggggtgaaacccactaccactacgacccgaacggattggtgatacgggaagtggatccactggggcgtattacccgccgtcagtggcgtcacagcctgctgatgtgggaaagcgacccgatggggcagatgactgcctttgattacaaccctgacggtgcattgaccgaagtgaaattgccaaccggcgatacctttgcttacggttataacgagcatggacagcttatcgaaagtgtactgccgaccggcgaacgttggcaacttcactatgatgagcagggcaacctgactgcgctgacccacccactgggtcatcaggaagaataccagtacggcacgcagggcgaattgcgccagcgtctgttaccggatggccgccagtggcactatgcctatgacgagaaacaacggctggccgccgtgatgacaccggatggcgaaactaccggcctgcaactggatgcactggggcgtttgcgccagttcaccgatgcgctcaaacagcagacgcactaccgctatagcgatgatcatgccagccttaacggcagcctgactgaagttgagttgccggatggggttacccagcaactgagatatgacagtgaacggcgcgtggtagccgccactgacggggaaggccgcacaacccgttatcaatacggcgcttttgatctgctcaatcaggttacccgaccggatggcactatcttgcgctttggctatgaccgtctgacccgtctgaattcagtcaccgcctccacgggagaaacttaccgctatgagcgggatgccgcgggtcagattatccgggaaaccgattttaccgggcgtaccctcgaatatcagtacgataaactgggacgccgtacactgactcaataccccgatggccagcaacttcgctggcactattccgccgcaggtttgctggtcaaacaggaaagctggcagccggaagaaaaccaacaggtgctaaaagacaccaccacttacgagtacaaccaacggtatcaattggtgaaagccaccaatgcggatgctactgtcgagtatgagtatgacaaaactaccgggttgccaacctgcgaacgtatcaacgggcgggaaatcacgcgcaaatgggataacctgaccgggcgtccggtcagtgaaagtgtggagggcaataccctgcacttcggttataacctgtcggggagtctgaatcactttcagcttaacgagcattcaccgctggccttccggcatgatgcgctgggtcgggaaacggtacgggaaagcgccaacggctttattcttgccagccgctataccgcaaccggattgctggcccatcagtcggcagggcaggccaccccatttttcagggaaacgctggcacaaaatgatccgcattttccgccgcaagcctctgccgttaaccgaagctggcaatatgaccgtgcccacaatgtgcgggtgattgacgacagccgctgggggcaaacccgttatcgttacaataccaacgaccagatcctgcataccctgttcgagggtgtgcgtccgcatgaagaacaatttagctatgatgccaacggcaatctaaaccaacatctgccgcccgatgcacaaggtgcgctggaacaaattacacaacgccagaaagccgggcgggtggtgcagcagggagatatccgctatcgctatgatgataatggccgtctggtggaaaaaaccgaacagcgggacgggttccgtccgcaaatctggcgctaccgttgggatacgcaaaaccagctcactcacgtcgaaacgccagatggctcacgctggcattatcgctacgatgcttttggccgacgagtccgtaaactgaaagttcacgatggtaaactcaccgcaactaatttacagttgtggctggcaggtaaagcggatttagcgccaagatccgatgctattataggacaggaatatctgtggagcggcgatcagcttatcgaagaagtgccgatttacgccgatggcacaccagtggaagatcagcgtgtccgttggttatatgaacccggttcattaacgccgtcagcccgctttgaaaaaggcaagctacactatattgtgagtgaccatcagggtacaccacgcgaaatgttgtccgaagaaggggtactggtctgggcacagcggctgacaacatgggggaaagcggagaaatcgcaggttatcgcctccaataatccggattatcatgttaactgtaatctgcggttctgcgggcaatatgaggatgaagagagcggattatattataatcgttttcgttattactcgccggacacggcgcagtatatttcggcagaccccattggcttattgggtggagtgaatccgtatggctatgtacataatccgtcaaaatggatagatccttacggtctggcaggcgggattggtaacaaaggcgattacatcataacttatcgtggagatacacggagcttcactgaaatttttgataagggatttgaaacgcttgggccaagtaaggatttgtataaacacgcattagataatagagcacctccgagcgatttcgtaagtactaccattgacccgacaaaaaccattagttttgcaacaaaatatggacaaaaaagtggctatatgtacaccatgaaaaccaatcacggtatagatgtaaacaaagcattaggcgcaagatcaccatttgctgctgaagcagagattgcaatgcctggaggggttagagctgaagatatattaggtgcaagagcagtcaatgccgatggagaaatgtgggactatactattctaaatccaaaaaggtatggaaaatgacagatgttgataaaagaaaaatcaaaataatactcaatggagaaatggaagaagctgaattacatatgattacttctccgaataggcattgctgtttaaaaatatttcataataataatcaattggcagaatcaaatgatactgattatttttcatgttttgcagatttaagaaaccaattaaaaaatatcatttttctttgcaaaggagcaaaaataaatgtgtatccgtctgccatgtcgagggatatgtcagatggtatagtcgcttatgaaactacattaggtcagccaggattacctgaaaatcaggttcatatatttgattttgaagataaatatgttgatattactccagaagagcaaagaaaatttcattctcaatggtttgaatcattgtaagaacaactgatttattagcttaaataatgccggaaagatccccgtgatcttccggctttgttttttgagagctgctcactccctgcccttagccgcttttataatccccaatcagctcccgcatcctcagcttaatttcactgatttgctcgcgctgacgctggtattgctgtttgaggcggtgggtctcgtcactgtcagggatcagcactaaacagccctccataatcttcaccgtgaccgagccgccaatctcaaagcccgcggccttaagccattgccctttaagatggatcgcgggcggggcgttggccttgtcattttgcggcacgtatcccacggtgtaataacgttctatttttgtagctttatttactgcacggttttgcttagaatgcgccttagccatcattcaactcctatctagttgcttgtggtgagcgagggtgaagtgttggtcgcacttcatccccgcgttaaatcaacgggtgctttttatctatcttgccagtgcctgtaactgtttcttggttaaaaaggcatccaacaacttcttaatcacttccttgtcttcctccggtaactgttccaccgcctgaaactgccgcagcagttccctgtcctcaaaccgggctttcgccgcgtcggtctctgccccttccagcagataatcactggtcacatccagcacgtccgccagacgttttaaggtgtcgctgcccggtcgtgaagtgccacgctcaaaacggccaatgtgggtgtaatggagttcagccagcttgcccagctctgactgggagaggcctttttgtctgcgcagttcccgcaagcgttgtgcaaatttcttctctgttgctgctgccatccattggggcacaaagaaaaataccaatacggcacacatggtaacttacgcctgtgccaactcaccgatgccctgaagcaacagactcactatcgttacagcaacgaccatgccagccttaacggcggcagcctgaccgatgttgaactgccggatggcaccacacaacaactggcctatgacagtgagcgccgtgtggtggcagtcactgacggtgaaggccgtaccacccgctacacttacggcgcgtttgacctgctcaatcaggttatcgactttccggccgtactggatcgcaccgccacgctgaccattctgcaaaacggtatcgaacaacgcagcatcacggggatcgtttcccgctttgagcagggtaataccgggttgcaccagaccacctaccagatgactatccggccggatctgtggcgcacgaccctgagacagaactcacgtattttccagcagcaggatatcgccaccatcatcaccgccctcctgaaagaacacagcatccgcgatgtgatcttcagcctgcgccatcctcatcccgcgcgcgaattctgcgtgcagtatcaggaaagtgactttgccttcctgcaacggttaaccgcggaagagggtattttctacttcttcgaatgcagtaacgggcgcaacacgctggtctttgccgatgactgtggttctgtgccgccgggcatagtcatcccttatcagcccggtgaagtcaacaccgtgggtgaacctgccatcagcagcctgacatgcagcgcacaagtacggccggctcaggtacagcttaaggattacactttcaagaacccggcatggccggcggaatttcaccagcagatgcgggatgaaaatctgcaacaactgtactacgagcactacgactaccccggccgcttcaaagacgaggcgcatggcaaggattttacccgctaccggctggaggcgctgcgcagcgacgcggtgaccggacagggcagcggcaatgcgatagcgctacagccgggtaaactgtttatcctgaataatcatccacggatagacctgaaccagtcatggcagaccatctccaccagccacagcggcagccagccgggtgcactggagacagcaaccgacggcgcaggcaccacgctgcacagccacttctatttcatccgccagaatcagaactggcgcccggcaccgctgtccaaaccggtggttgatggcccacaaatcgctaaggtggtcggcccggccggcgaagaaatcttctgtgaccaatatggacgggtacgtctgcaattcccgtgggatcgctatggcaaatccaacgaccagagttcctgctggatacgggtaactcaaccgtgggcagggcaaggctggggcatgctggccatcccacgtatcggacaggaagtggtggtggacttcctgcacggcgaccccgaccagccgatagtgaccgggcggacttaccatgccagcaacatcccgccgggggccttgccgggcagcaaaacccagatggcgttccgctccaaaactcacaagggacagggctacaacgaactgctgtttgaggatgccaagggcagcgaactgctgtcactgcatgcgcagaaagacatgtacaccaaggtgctcaataaccgggatacccatgtgctcgccaaccacagcgaaaccgtggagaaaaaccagaccatcacggtcaatgagaacaaagaagaaacggttacgctcaacagcacggaaacagtgaaggaagtgcgcaaactgatcactggcaaggactacattatcgaggtcggtacccacaagatagaaaccatcaacaataccctttccatcacaactggcgatgtgatcgagctacgctgcggagcaagtgtgttacgtatggacagtgccggacgtatcacccttcagggcagtgagtttaagtttgaggccagcggcccggtgcaaatcaccggcaaagacattgacctgaactagaaaggacggattgagatggaatttcgtaacctgaccccctttgcggtgatgaactattcaatgctggatgttgaggatgtggagcaccacgtggcggtcataaaaatcggctaccagctattgcctgtcggacaaggggaatacagtgctgaattactgcccgcgccgcgcctgtgtttacaggatgaataccgtgaacagatgaatgcctcacaggtgttgcaggagagtgatcttgccccgtttaaaccacgctgtgacgtgattgtcaacggcacggcgtatgcgccggataaccgaccctgtactgagtttcctgtacggctgcgggtaaagagcaaacagggccagaccctgctcgacaaaaccctgaccgtaaccggtgaacgggaatttattcgtgatgctggcggtcagtggcaactgaccgacccgaaaccgttttcaacactgccgctggattatcgctatgcctttggcggtgaatgcaaaatccaagcagatgataaagcgagcgaacacctgaaagaacgtgaccggctgacaccggaacagcgccggcaacatccagacggggaaaacgctcctgttgctcatgccgtgtgtgaaagcaacccgctggggatgggatttatcacgccgtggtatgcgcaggccaaacaactgacccgttaccctgccctccgtattacccgaccggatgccccgttcaccgcgcagcattttaccactcaactggatggagcgttggcgcctgatacacccgcctgccagccacaaggcatgggctttatcggccgtccgtggctaccccgccgccagcttgccggcacttatgatgccgactggctggcacatcgacatccttacctgccaaaagattttgactttggctactggaacggcgcaccaacagaccagcaaattgactggccggacacggatattgccatcacgttaagcggcctgacgcctgatggtgaactgcacgtcaatctgccgggacaccgtccgtttattctgctgcgaatgcacaacggcatattactgcccgtgccgatgcgtatggatacgttaattatcaacagcgaggcaaggacgctgcacatgacctgccgactgagtttcaaagcctcactgcccgtgcgagtggctgaaacccggtttgaaatcaacccggatgcccccttgctcaatctggcaccactggaagaggaaaaaacggatggctgataattacatcgcccgcaccgcaggtgaatggctgatcatcggcatgttgcccgacgtgtgcaaaaccccgatgggcgcgtcaacaccgccgatcccgtatccggtcattgcgaaactggcaggcagtgacgcccccgtgaaatcggtacgcgccaatggccaacccgtagtggtatttgcccagagctttgtgccgacaactctcggcgaccagccgggcgtggccaacgggattaagagtggcacggtgggggcgaaatgccatcccaaagcgcatacaaaaaccgtccgggccggcaataaactggtactgcgccacggagatgaattctggatgaatggcgcataaggaaggaaaccatgtcagaagataaagctaaccgagaggacgtctcgtcagaaacgggcgaatacgttccgccacaacccaatgcggccttaccatcaaaaccacgcagtgacagcccgactggtgagggcaacacgctgggtaaaatcatcggtcaggcaccacagggggcgagtccgccccatgaggcgaatccggtggtgataccggaaagcaaacccgaaatgagtgcatgggaaacgctgaaaacgatgggaaaagcgttaggaaacgctgccgtagacaaagccaaagaaacaaaacaagacctgtcaaccgtaagcggatgggatccgattgaacagcagaaaggcattgccaaaaccgtcagtaataccgccgtggggctgggcgaaatggccattaagggcggaatgctgaactcagctcgtgaagcggacgaatcggcccgttcgttagctttctgggggaaagtatttggcaaccctgacaccgaaaaacaggctaaagtgataggcgaagtcgccgatgccggccgcacgaatgccaaacagtttaatcttgacgagtacaagatgacactggacacacccggacaacgtactggcggcacaaccgctgatattgtcatgcttatcggcccgacaaaaggtgcgggtactgcaggctcagtgactaaagcaaccgaaatcgcgaaagtggcagaagctggtgcactggcgacaaaatcccgtgaggcagcacaggtcgtagaagccagtacacaggcggctaaaaacgccaaccctgccgctggggctataatcaaagaaaaacccgcgacatccccgaaaacggaagtcaaacccacaacagaaaagcctgtcgataacgccacctcatccggcaaaaaaaagggcaatgacaacgaactgtccagtacagagggcgatccggtcgatatggccaccggcgatttcctgcaagtctggccggttctcgccattccggggttgttgccaataaacctcagccgaacctaccgctccacggcggatttacacggcctgtttggtgccaaatgggcggatgactggtcactgaaactggttatcagtcagggggaagtgcactatacccataccgatggcgttatctacgactatgccacaccggataaccgggtcttgtcccgtaaccgtaatcttccccattgcctgctgacgggagaactgaccggcgaactgtgcctgaccgaccgccgcgcccagttgacgtaccatttcagcccgatttcaggcaacacacgaaaattgtctgctatcactgaccggcgtcagaaccggattgattttatctacgataagcagtcgcaactgacggccgtcacccgcaatgacggcctgcggttaagcctgcattatctggacggccggcttaacacgatcacgatgcaggaaaaccgcgaaggccagcctgctgagcaatgtctgttgacctgtcaatatgactcacagggctatctgaacgagtgtgatgctttccagcacaaccacctgtggcatgaatatgatgtgcaggggcggatgatccgctggcatgataccgaccagactgacctgacgataacctatgacgagcgcggtcgggtactcagcaccacctctcccagcggctactggcatgaccgtttccgctatgatgacaacgcccgcattaccacctatctggatggcgaagggggtgaaacccactaccactacgacccgaacggattggtgatacgggaagttgatccactggggcgtattacccgccgtcagtggcgtcacagcctgctgatgtgggaaagcgacccgctggggcagatgactgcctttgattacaaccctgacggtgcattgaccgaagtgaaattgccaaccggcgatacctttgcttacggttataacgagcatggacagcttatcgaaagtgtactgccgaccggcgaacgttggcaacttcactatgatgagcagggcaacctgactgcgctgacccacccactgggtcatcaggaagcataccagtatggcacgcagggcgaattgcgccagcgtctgttaccggatggccgccagtggcactatgcctatgacgagaaacaacggctggccgccgtgatgacaccggatggcgaaactaccggcctgcaactggatgcactggggcgtttgcgccagttcaccgatgcgctcaaacagcagacgcactaccgctatagcgatgatcatgccagccttaacggcagcctgactgaagttgaattgccggatggtgttacccagcaactgagatatgacagtgaacggcgcgtggtagccgccactgacggggaaggccgcacaacccgttatcaatacggcgcttttgatctgctcaatcaggttacccgaccggatggcactatcctgcactttggctatgaccgtctgacccgtctgaattcggtcaccacctccacgggggaaacttatcgttatgagcgggatgccgcgggtcagatcatccgggaaaccgattttaccggacgtaccctcgaatatcagtacgataaactgggacgccgtacactgactcaataccccgatggccagcaacttcgctggcactattccgccgcaggtttgctggtcaaacaggaaagctggcagccggaagaaaaccaacgggtgcttaaaaacaccaccacttacgagtacaacaaacggtatcaattagtgaaagccactaatgccgatgccatcgtcgagtatgagtatgagtatgacaaaaccaccgggttgccaacctgcgaacgtatcaacgggcgggaaatcacgagaaaatgggatgagctgaccgggcgtcccgtcagtgaaagtgtggagggcaataccctacattttggttacaaccagatgggtgcactgaaccactttcagctcaaccaacatgcaccactgaccttccagcatgatgttctggggcgggaaacggtgcgggaaagtgcccacggatttattcttgccagccgctataccgcgaccggattgctatcgcatcagtcagcagggcaggctacccaattcttcagggaaacgctggcacaaagtgacccgcattttccgccacaagcctctgcggtcaaccggagctggcaatatgaccgcgcccataatgtgcgggtgattgacgacagccgctgggggcaaacccgttaccgttacaataccaacgaccaaatactgcataccctgttcgagggtgcgcgaccgcatgaagagcagtttaactatgatgccaacggcaacctgagccagcatctgccggttgatgcctatggcgcgatggagcaaattacccagcaccagaaagccggacgagtggtacagcaggggaatatccattatcgttatgatgataatggacgtctggtggaaaagaccgaacaccgtgatggcttccgcccgcaaatctggcgctaccgttgggatacacaaaaccagctcacccattgtgaaactccggatggctcacgctggcattatcgctacgatgcttttgggcgacgaacccgtaaactgaaggttcacgatggtgaactgaccgccgctaatttgcagttgtggctggcaggtaaaccggatttagcgccaagatccgatgctattatggggcaggaatatctgtggagcggcgatcagcttatcgaagaagtgccgatttacgccgatggcacaccagtggaagatcaacgtatccgttggttatatgaacccggttcattaacgccgtcagcccgctttgaaaaaggcaagctacactatattatcagtgaccatcagggtacgccgcgcgaaatgttgtccgaagaaggggtactggtctgggcacagcggctgacaacatggggaaaagcggataaatcgcaggtcatcgcctccaataatccggattatcatgttaactgtaacctgcggttctgcgggcaatatgaggatgaagagagcgggttgtattataattttcatcgttattactcgccggagaccgcgcagtacatttcgcctgacccgatcgggttattgggcggggtaaatccgtatgggtatgtgcataatccctcaaaacttgtcgacccgtatgggctgagtgggacttcacaggttgcaagtaaacctgatttttatgtcggaccagatggacctagtgcaactatgccttcgactgcatatagatatatgaacagcgaagggccatatgctgctatgacaatagaaaaaaaatctgcgccgttaagttactttggatacacaaaatataaatcaggtcatgaagccagagatgcctatcaaatattttatgaaaaaggtaatcctgactcttggagtgatgctcggttgctaggcaaatttgatacattgcagctttataaaaatggtgttcctcaagtaaaggttcctcttgctaacggtgataaaggtccaggattggaactatttactagtgcatatcctcaatacggtaagggaggagctgtacagttgcttcctatagaaaaaaatcttcctgttactttcgataaagtaactatcattccggagtaactatatgacagaaacagaactgcgaaaaaaccttacatatctagtagataagtacatgccagataatgaaaaaaaagaagagctatacacttatatccaacgagaaaatgttccagtaaaaggaatattggcagatttcaacgaatataagacaaggacagtcgaacaagttgacggtaatctaatcagagagatatatttttactattgttaacaatagataattaagctgggaagatcacagggatcttcccagctttgttctttttaagatctgctcaacgaacaggggatgcaggtctggacacagtggctaacaacatgggggaaagcggataaatcgcaggttatcgcgtctaacaatccggatttccatgttaactgtaatctgcggttctgcgggcaatatgaggacgaagagagcggattatattataatcgttttcgttattactccccggacacggcgcagtatatattgcccgatcccctgaatttagcgggtggtgtgaatccatatggatatgtccacaatccttcgaaattcgtcgatccttacggattatcttcaacatctgaagtcaaagcagcatctattcagtcaccatcagaatttgctagaagttggcaagggcagggagagtaccccggtgttgatcgctttaaagatattacggtaaaaaaagatacaatattaatggctggagctccgggacaaggtaatttttatactacagttagtgctatagaaagaagtggattttctcaagaaggtgtatttaaaggcttacaagtaatgcctcatccacaatttggatatagacccggtatgacggcttatcgagttctagaagatacaccagctgcatttggcatagttagggctaatcctcaacatggagccggaggattacctcaaattgttattaaaaattatgagggaattctagaacctttatactcggtgaaattgataaaatgatatattttaatggtgatataagtctaaatggaataataataaatccattaattacattggatgactttctaaccctaacattagatcttaatcctaaaaaaatgtatgactttgaaggtagagtcagctactcaatagatgacattctctttttagataaaaattatattatcaacgttgttttccaagatgggattattgattttattaaattacttccatttaataaggaaaaagagaataaaatcaatgtatttaccaacgaaaaccagatgaggaacaaattgattaatgatgatttattaaaatcattatttggttcatcagagaaactatttttcctatggggaaatattgagtctgtggatgataataaatcgggtatgtcatacatcatcatttcatataaacaacaataattggttaaattaaacacgaaaagccggaaaaatccacatgatcttccggctttttataatagccccaatcagttcccatatactgagtttaaaccttggaaaatagatggtgtcaaagtattagaagattggcctttgaggtaatgtatggactctattgaacaatcaaaaaagttaagagtccttttcctttcactatgggaaattatgcgtgttaatggtggaggaaattggataaagggcattgagaacgttattacactgctgacgcccccaacatatgggggtacaaacgatgcacaatctgctattgaagatgctcgccgtgcatatggatctatgttcggaggttatggtggtttttctgaatactttatttggcgggatgattttaatgaacgacttaaagccaataaagcattagataaaataaaaaacgatatcaatgatacgtttaattaatacagaatcggaaagatctcagtgatcttccggctttgttctgttaggagctgctcactcccttgctcttagttgcttttatagtcaccaatcagctctcgcatccgcagcttaatttcactaatttgctcgcgctagcgctggtattgttgtttgaggctgttcgtctcgtcgctgccggggatgagtactaaacagccctccatgattttgactgtgaccgagtcgccaatggttaaagaacagtttaccaagtcaggaaccagattagacggtagggccgatcagatagtcttaccattaggttatccaataagttgggtaaaagatgtaaggtttttgaagtaaggggaatttgatatatgaataaagaacagttacttataaagatagtgaaagcaatagatttattggaggaagaaaaaagaaataataaaaatcagttgcaatcaataataaatttgttcataaaaacaaaagaaaaataatcaataatagcttaaagtacaatgacatacgaagttacgcaagaatgtatgtcgaaatgtataatgattatatgaatccaatgctcaattatcttgatgaagttggaaaagacgttgatgattatttaagaaaataattttggccggaaagatccccgtgatcttccggcttattgttatgtacccggcacagcgcttaatgttatagccataaagaaaacatcctcacctcaacaatcaaaataggaataacatgataacggtatatcaatatatttatgacaagatgatcaaaaaaagagaagagatgcgcagctatttactgggtccgttgagtgatgatttacccgaagaatataaaccgatacgtgaactttattatacgggttcagccaaaggaaaatcctatgtggagaaaatgatcatcaaaacagccgatgatctccttcttttacaacttgaaaagatggataaactacggtttttggaaaatggtcaggacatgttttcaatggagttaaaactcaatgaatacaatagcattgttcatgtaccccaaaacctcagtttctgctcaataatgaaagagttgattgaggaagaaaacaataaccatatttcgcgatttgtttattgaatgaccttgttaaaaaaagataaattacatctcaatgatgtaatttatcaataaagcacttatttatgttgaaaataggattgggttaagctcctgtgaaatgcagtttcaaacccagtacttttgatattttgtataccgtattaaacgaggggttgccttcaccggataacgccttgtatatcccttcacggcttattcctgattctttcgagagttgactgatattttttcttctggctatgttgcctaatgctttaaataaatattttgtatcattctcttcgatagccgcatttaagtaggcctgaatatcttcttccgtttctaaaaactccacaacatcaaatttttttggttctgttttcattttaaaatccccattctttcgcaagttgctttgctttctttatatctgcctgctggctgcttttatctccaccacagagtaataatatgatttcattatttttgttagcaaagtagacacgatagccttgcccgtaatgtattctaagttccaaaaccccggctcccacaggttcaacatcgccaaaattcccctcttccattctttcaattctgattaagattttggcttttgctatcctgtcttttaaggattttaaccatttttcaaaatcttgcgtcctttcaatggttatcatgctcacctctaaagctaagatcattattgtatgtcaataacacggtgtgtcaaccatggttaacacaccaacgccatccgcaataaacagtattacaccgctcagacgggtatcagatcagattctgtcatcaacataattttgccgtagccaaaagcaacttgaacgggattatccaacaaaccggtttccgttaaccagtcgccagccagatacagctcgccattatcacgcacccaatcgatgccttgatacggatcattttccgccgtgtgagacaggggaatcacatcaggctctgccaacgtcaacatcagcccgttattatattgctggatatgaaacaaagtattcggcataaagcccatctgttgcatatcgtcaccgcttaagacacattccggcagttcagcattatcagtagaaaaatgaagtttcatcggttccttccttgtttaatcggtaaaataaaatgcgagtggcttcgcaaaagaaaaattttgccctttaagcgcaaagcgccgctcacacaggcgtgttcaatatgatttttcattgatagaacagggtattatgcgtttatttcggcagcttcttagttaattttccgggaaattgccgcagccagtgtgccacagcgatatcatcccattcaccttcattcaggctttttaaacagtgccacagttcatagaaattttggctggtgatgatcagacagcccggcatcactctgatttttaatggatcattaatggaaaatcccgcttccagcagccattttccgcttaagttaatggcagggatcgtgcggttaactcccttaggacgataaaccactttctgataacgttcgggttgggaaattttgtaaatgcagatgcctgcagtagaatgcgcgtcagccataataactactccgatagttgttgcggttagcggttttatcgtgttgctgcacggtaaagccgcgtcgaattttcaccgccactctatctcccgtccaaataacataccactgacaaaaattgcctttgcaaagcggctcgcaagaagtcgagcaaaatttgcactattattcgtattgtagtaatgttcctatattgtgaattcaaacaggaggtgtagccatgaccatcacaaccctatccagtcgggagctcaaccaggatgttacccgcgcgaagaaagcgaccaaaaacggccccgtctttatcaccgatcgcggcaagcctgcttatgtgttattgagcatcgaggaataccggctgctgaccaaacagcatcgcaacatcgctgattcactggcaatgccgggagttgcggatattgagtttgagccacagcgcgtgactatcgaaacccgccctgcggatttctcataatgtatgtactcgataccaacgtagtgtccgagctacgaaaaattcgggccgggaaggccgatccaaacgtggcaaaatgggctgaaagtgtcgatgcagccgatctctttgtttccgccattaccataatggaattagagcttggcattctgttgattgaacgtaaggatgctacgcaaggaaccctgttgcgggcgtggctggaacaacatgtcctgccggaattcactgaacgcacgttacctgttgataccgccgtggcacaacgctgcgcacggttgcatgttcctgaccgcgccagcgagcgtgatgcactgattgcagcgacagcgcttgtgcatggaatggcggtagttacgcgtaacgtagccgattttcagccgacaggtgttacaatcctcaatccgtgggagccgaactcttaatgtgtattagctgcgacttaacctgatggtgtcctatggcagagcacagatacatctgactgtcggttaagagtaaggagcggaagttccctgtggccatcaatgtccaagttgcagagtagctaactaaaaggatgactaacaaagcagtggatattcagaattacgatggttagtttcttctatatcgcaattttcctgtggtgtttgcttgtttttatgatattcctgaaatatcttcttcaagttcttttgcggaattggctattttaaatttaaactttcgctctatttcactattgcttaacatttttgccttatctttacctatccacattgaaacaagttctcgcttctgagatatatctaggttgtcaaagttaggtatgtatttaaatgtgtccgcagttccacgacgaagttcatagaatgtttttatcaaagatttttgttttatttcagatgaaagactgaatcggcggataagatgacttacggtatgattaacggagcgaagttgggccgttgtggatatttgcgagaagtatgatacccatcccaggcgtttcccctcaaatacacaccctgtgattctaaggttgagtttccactgacagtacgctatggctcgctctttatcgcacttattcttagcctgcagtaccgcatgcttgtatgcagtgaaaatttttgctagtgaggattcgaatctgagaatactctcatgcttgattaataattctccttggcttatgtgataaccaagaaagtcaaaggattcatccagattaccaactttggattttgagttctcctcatttagtggatgaggatttaaattcaatagttggagcttcttaataacatgagatgccatcgtttcggcttggctatttggggtcagaataagaatgtcatcaacatagcgcatgaaccagatatctggaatttcattgatttccttatcgaaaatggataaagaaatctcagccaaaatgtttgaaattgctagcccctgaggtactcctctggggttcgctgaggcgcctttgctacctttaaattcacttactgtaggaacgaccaatgacgacattattaattttctaatctcgctctttctaaccttattttttattgcatcagctatcagtgtatgtttaattgaagggtagaaggttctgagatctatcttagcatattctgtatataggccgctattcaatgcaaccttcagtgaatcaattactttatgtggcagtctcaacctagagtcaggataaatttctgtaagacattcgcaaagagccctgagagtaatcctatctctggctgtgggtattgagatctgtctggggttagagttagctcccttagatattagcttttctttataggctgtgaatttgtaactaccagagttaactttttcagaaataaatttaatttcattttttatcgttgagtcgagtttagaagggcgaactcggtcgatgccaatagcaccggattcttttattttttccttatatactttgaggaggtttctttccgaaaaggattttttaaagattcgaccagcagtcataggctatccaaacaagcgggagtaggtaaaaggaataagtaaatatgaatcgctttattttccagcctagaactgttcgtttttctttcttggtagggatccttgttgtaagtcctacctgggctacacgtgcgatttgatcatctatatcaagatgattctcaacttcatcgagcaattcatgatatttttttctttgttcaagcgttaatggttgcccaattgtagtatcagaatagagccgctgtagtgcaagataattcctcctcatggatattgctctgccgcggaaatccaagtttgaaactacaagtgaaatacctagtaaagccaccgaaagtattgtcgcaagaatatcggtgttattccctaggacttttggaaagcgtaatgtcacgattgaaagcactgcacttaatatagcataccaaacgaggatgaactgagagtgtttttcaagccactccaggcgatgatgtgcattaatacgtgctttatatgtaaaccagatattgtcccgcatgaaaactcccttttattttttgggatatggaaggggcaggaaagattggaaccgttgaacaccctgctaagcaggatcagtgagcctaagcccaacagcaaaaaatcgctattcattatcagagccgcccttacaaaagcaagaggaagaacctgccccatccttttaaagtatgacaatttcataagattaaagtcaagaatatgccttatgaaacacagtaagtaaacttacgctaccgaaggacttgtccttttacagccaattagctgacaggtctgccccccattgataaacatagactgaagttagcaacgtctgctcctggctgtgagttcaactggctaataccaattaccgcatacgccgctgaatatcctccagaatgtcattaagcctctcaatggcctgcgcgttttccgcaatggactggctatgatgcgcatcgactctggcttgctcattgagttgattctgtaagcgccgcccgatttctgtgtccagaaaatgatcccgactggcctctactatccagccggtatcattggacgcgacaccgctgacccatgatgtccactcagaagcgttacccgatttgtccaccagccgagcccgaaaatagagcttctccccagccgccagcccctgcaaagtatgggttcgttgcggataggaaatatcggcgaactgcagcgtgtcatcatcttctccgtttttgttgtagcaaatttccgttttcagcagaacatccgttgggttggcaaagtcccaatccagccggataccaaaaagtagcgacgtggtttggagggactgcggtgccgacggaatctctttgcggctacctagcagggtatcctgtgtgttcatccagatactggatattgccgcggcattagtcgccctgacccgcgcctgatagcgcccgtcatcaacattcggtacctcaaggccccgtacagtagtctggggagccgttatccaattaccgttgtctttgcgccattcgacttcataggccacggcactgtcggcagcatcccatgtgatctgcaacgtgttggagatgatgccctgattcagtgaataataactgtcaatgagaacatccttcggtgccggctgaacactgggtggaataatggtcacggtgcgttcgtcaatgcggatatccttgtcgataagtgcgtacttgtcgggattgtgctcaaccgctgtgatgtcaaatgacacgccatcctcccccgctttgataccaataacccggaaaggttgctccggttcatagcgagattcaatgacccagattgaacctacttcaggttgttctgaataggcatagccacgatcccacacagaaacctcctgtccgttgatcgctgaaatgagatccctttctgccttacctgacggcaggttgataaccagccaatcccccacttttgccgacggcacccgatccaaggtgataatgtatcgcctcggcacggcctgaatacgaccgctccttcccacccctgacaacagattatccgacacaccgataaggtaacctggcaaaggaatgtagccctccagtccgacggtgaaattggctgtccggtcatgttcgttggtgtgcaacacccatttgccacgccggatcgcttcactttggctgatacaaccgatggcggtaatatcggcctgccgaataccatagcggcgtattaagcgatgttcaaacacaggttcgatagcatcctgatagccgttctgcggatcggaccaactcaccatggccgtggagtaatgggttttctcgctggcactggaataggtgaatttgccgtcacgcacattggcacaggtaaagaggtaatccatatcgcgcggcatgtccgccagcacgttcatgttattattggaccagaaagtcatcccccggaagatccccgcaatgtcacgtaacacggcccaggcatcttcttgtgactgaatatagacattgcaggtgaaacgcggctcttcaccgccttcaccatccgacaccatctggtcgcaatattgagcgatgcggtacagatcccattttgccagattcaggttttccgttttcacccgggtgccgatgctgaagcggtcattgatcatcaggtcatacagcacccatgcaggattgtcgctccatgaccatttgaaggtgccatcccagctgccatgataataacggcgacggggttccagataataattgcttggcactcggatgatgcgcatcttgggttcgcaggtgatttgtgggatattgcggaactgtttggcatcaaactgaacaaataacagagccgtttccgggtagcttaatttggcatcgatcacctcagtgatggcctccaccaccatggcatcagcgattcgattactgttctgttttggcgttaaccgccgaagacgcaattgccagcccgaatgagcttgaggtaaatccacccgatgagagcgttcgtatttagtggtgcttttgccatccacggcggttttcaggatttccttaaaagcgccgccatcggtggcgaggtcaatggcatattcaatgcgatagcccactgtatccccgttttctttttgcctctgcaactgaggccacgataaccgcaggcgaactgctgacagttgagtattggtcaccgtcgtcacccatgagctaaccagttccgcactaacggttcgggcattttcaaccgctggcataccggggatatacgcctgatagggcgtgccggggcggaattcccatttgatcccttcaaaattgggtctgccgtcagagccaataagcggcgtgttatccagaaaaatacgctgaccatccagatcgcccgcaaattctccctcaccaagcgcgaggataatcttggtataggaagtggattgcagggagtccggtgcttccactggggtgcgcggctgctgacggccgcctttattaccttgaattggctgcttttccatattttatattcagagagttattgttggtcttcagagtagatacccgctgaaatgatggcaccaccaatacggcgtctgccgtagccaatgggcacaggatttccctgtgccacggtgttcaccggaccaccgaaagcataggagggtttgttgtcgggatcttcacgtcgtgccagcccgcccggcataggtgagagcatctgcaccacgccacccaacatcattccaaccccggacatgaccattggcgcaccaaacggggtcgcccacaaaaatgcgccagcaaccaccatcaccgcgcccagaatggtctgaaaaacaccggcatttttgctaccaataatcatcggggcaatacgaatatcgtcctgcccgacaaataccaactcttctcggctgatattgtgttttccattaaacacagcaaaggtcagcccctgttctttggcagtcagcaggaagtgttcaaatcctttaatcagcacggataatgcccggattgcttcctgcggggtagagacagccagtttatgtactcgcccgaactgagtccccagtacaccgtaaagccgcacggttcgtaatgtgttcatgaagtgacttccctaaacaaaaaatccgctgaagcggatgagtaacgcaaagtgatgatggtacgttcctgccagtagccatgataaggttctcgcttgctgagctgtccatacagatggtgcagcatcaggctgtcccccagataaatagctgcatgattgggttcattggcctgcacctgcataatgatcacatcccctgtctgtaattcaccgcgacacgcgacaaatccggcagcggcatactgtttcatatacagattttcgccccgaacccaccagctatcggtacgttcaaaatcagggagttcaatagttcgttccagtctgaaccaatcacgcacgatggcataacaatcccagataccgtgcacgaacgggcggccaatgagtggtttaatgccttcaattggcatcagggtacggatatccccttctggccacgaaacaatcacccaaggaatttgtgacaggtcacactgggcgatatccaactggctcggctgtgtggtcgcgtcagggtggctgtgaacaatggcaataattgaacctttgtcttcggcagcggcataatcctcagggtgaatactgaactgttccgtgggtgacagtgcggtgttgcgacagggaagataatgctgccgacgatgctgttgaatgatcagcccgcaacattcatccggataggtggactgagcatgcgccatgatggcgcgggtcgtggattttcgcaggattgtcatggttatcgcctcagcaacgctgaaccggggaagccgccaaaaggcagctgttccgtgtcaccaaaacgttttttacaatcgctcatcagtcccccgcaggcatccgccgccggctcatcggtcggcttacctctttcagtaaaatattgggtgccggtgtagccacacggcgactggcggtactgtccacgcatacaccatgtacacaagctatgaatttgccgagtcgggattttaatgccttgtaaatcggctggggaggagagggaaaactgaatgttttcgttatcttcttgcgttttgctgtcgatgtagaaaacctcgattttctcctgtgtcggatcggcttgcgggttgccgccgggaaaattacgggcatccagataatgcgcaaaggtcatgcggatcgtgacacgcgcttgcaccatgttttggtaagccagacataacgcactgagcgagccgtccagattggccacattgagggtcggtgtcaccgcccgcccatcgccagtaacttccagtccttcaatgctgacgggccacggtttatattcgacgccctgccaccagagggatttagcgggtaagttatctgcactttccagttcggccccggtgtaaacgatagggtgattgtgaaaatacagctctggcccaccaaacgctgaaccgtcaactgcaaacaataagactttgctccccggctcaagttgctggagagtggcattgattgtcatggtaaaacctcttaagggtgataaatgcgggtaaatgtcacggaaagggtgaaataagtaccattggcctgaatagtgaattttcccgcctgatataacccaagttcagataacggattacgccatttgaatgagcgccagccctgatgttcacgcaaaaaatccatgataggctgtatgtctgactgtgccccgacaaaagacaagggccagctttctcgctgcgtgttgatcccatcgcctgacgtttgtttataaccatcaccaaactggacggtacgcacaataggctcaaactccccacttgtacctacccttgcagggaaatcaaaggtttttatcatcatcggcctcctttaatcgccgcactgagttcaccaccttgacttagacttttatgcagtaaaaatttgaatcgttgatcgacaaatttcgcgatatcctgccccgctgattccgcaccacgagatgtttttgtgtcatgggtgccatcggaatggatcacaatatggacggtgttgaaggtttggttgtccgtactgccggtggcctgcacacccagcttaccgtcagtaccgcgtttgagtggcaagatggcttcgggtcccgcttcccccatcactccgccccctttggcaaacttaaacaaggtcgggctactgacaatctgcccgctgtactgacttaaatccgcagattgataaacgccacctttcgcattcatgatgggactcttccagacatctggggtaatggttgttccagaaccgactgaagacaggccgcctcccgctgaagacaatgcgctggctcccatacctcccattgcgcccccaaagaaaccagagatagctttggttatcagtgcctgcatcgcaatacggatcagatcctgaatgatggattgtgccagtgatgccgacagttcccgcatggattccgaaaatgattttgtgcctgtcaacatgcctgttaacgagttacccgtgcgttgctcgaccatatccagcagatccatctgcattttctgaaaatcgccttgtgatgcatataaatcctttgcggcggcaaattgcgcgtctttggagcgattagccgctgctgttattaactgctcatgacgttctttgctgagaagtccgttccggtagtaggtgtcgtaaagcgcggtttgttctatgagctgattttgcagttgcacaacgggatcaacctcacccgtcatatccagatgcggggcggaaatttgcttcgcctgttctgctaatttgtcttttaccgaagtttgatacagtgttttactggcaaacaggtattcctgttcggtcaacaatcgttcgcggtacagggctttaagctctgcgctggcttctttttcctgccgaatcaacgcggctgccggagaatacttttctgccagttccagccgctgcttttggtgattttcggcattgagggtttttaagcgttgaagctcactttccgaagccatacccgatttgccaacttcatggattttacccagcatttctttctcgctgaaccgaatgcgatccaagctggtggcatgggtctgctcaatttccttacgtaactgctgataaaggttaagtgattgtttgccttgtttctcttctttgatgagatcttggcctgtccacggattacccgtgccgttcccctcgggttttggcggctccggcggtggttggtcaaagatacccgctaccgatgttgcctgtaggtttttctttcttgctgttttattttctatccctttgaggatatcttctcttcgactgagtaatacccgaccttgcttttcaacttctttcggatcttcataaagaaaactcaagaacccttttcgacgattttgtaatcgcttgattcgggtttgagaataccgttccagttggctatcaatctgcttgagttcttctttcaggtggttgatatcatcgtcagttttatcaagctcgacttccaccttaattctggaaagacgttgcagtccagccaccgtttcaacggtttcatcctttaagtgccgcaacccctctctggcttgaacgctatggtgatataatccatacaaggctgaacccaccaacatcgctgcaccaaatggcccaccaatcatggcaagtgcgccacgggcaactcccccggcggcagataatgcccgataggaataagaaagccggcggttagccgcttcaagttgcccggttgcctgtgtttgcaatttgagagcttccgtttcctgccggatcaggattcttttttcttttgcgtaattgacggaaagaccgtgcaagcgatttgtgctttccagatatttaatgtgcctgccctgtgcttccgttgaacgcagcgtggcattggcctgttcaattgtccgttttgcggtttctgcctgctgtttagcaacatcacgagcggctttttcggtggcgcgccatgccgtaatattttcacgtaatcccgcagtcagcttagtcgccatcacaggaattaacgtatgcaatgccacactggcaaccagattaaagttttcggacaacgcattgatcgcgctggtggcattttgtaccccgctacgcaacggaccatcggcgttctggccgattttaatcgccattccctcaaaggcactggctaacacatccagatcagcgctcaggttattcgcccgttcagatgcctgatcataggcgacccgggtatcggtcagtgactgcgttaacgcatccagcttgccacgacccaccaccaactgagacgcggcactgatattcgcccgcccgaacagcttcgcggcttccgctgtggacaggtttttgcttttaaggtgatccagtgctgatcccagccccaccaccgaaggcttgagtttcttgtcgttggatttctccagagccagaataatattgcggatcgcggtcccggcttctgcgccttttatcccgcctgccgccaatatctggatcacagcattcagtgcttcaaagcttatcgcggcctgtgccgcgaccgttccgccatttttaatcgcctgcgccgtttcgttaatttccgacgaaccgtattttgcgccggcggccagtacgttgatataacgatctgcctgcgcagcgctggccccaaactgatttaacgataacgccagtgctttggtggcttcaggtaattcgataccggacgcctgcgccagaatcaccgctttttccgtcgcctgcgtcagcgctgccgtgtttttcagcaattccggtttcgcggaggccattaatttcagggcattggcaataccggttgccccgaattcggtggttcggcctaactgctgggcggtttcatccagtttctttaactgcgcacccgtggcacccgtaatggcagacaggtcggacaatgcctgaccatattggcgggtatgggaaatcatactgctcagtgaaaaccccattcctgccagtaacgccagttgcccggacacagatttaatgtgtgatgccagagagctatagctctttttcaccttgttggcatctgccaccgatttatcgttaaaacgttcagactcccgtccggcataacgataggcatccatcatctgggacttaaatgcggtggcattgaccagcaagccgaccgttaatgtcgataaattagccataaattaacctaataatttcatcacagcctcacactggagctgaaccgtatcaaggggcggcgaaacagacggattgtctggctgtttgcggtttttcagtcggtaataggcctgccattcgttaagcgtggcggcgggcagagacaggatgcgatagggatcaatttcgccgagctgttcagctaacgtgaaagcaaaatgcagccacgacgagtgggtcagtttttttcggcctcctccagtgtaccgatggcgtgacgcttcacggtctgaatggcttcaatcagggtggcgttatcgtggatcgccattaactcatcggtggtgggcaagtcagccttatcaatgggttttcccttatcatccaccagacaatccagcaccatctggatattcaggcgggaggcctcgcgcccgtttccggcatcacttaacgtttccgctttttcttccagttccagtaattccagtgccgtcatccggcgcaggttgatttgggtgccaaatagcgccaccgctttaatctgtggacgcggggtaagtaaggcggctttcagtgttttcattgggtcactcctgttttggtgtcagcgataccccagacgaggttgttttgtttgcccttgacggtgatttgaatcacttcactcgccggggcgttaatgtcgttcatttcccagccggacagtgccagcaccattgtcgcggtgcgcttattcggcagggcgatgtaaaattgcaccgtgtcgcgcttttcagccgcgttcaggaaagaaacaaaatcggagttctccggatcatcaataaagccgagggatttttccggcccctccggcatatcggaaataaactgtttattggtatccatcagggtggtgcagtcgacaaaactgcccgttagcccagtggcacccaatgccttgcagttaatcagcggtttcatctgttccacgctgtcgccgggtttgccaaatttcacgagtgtacccgctggcagtacggcgtattcgggtgaagttgccatgatgtgttctcctattgactgtaccctgataaagcatcgcggatttcctgcgcgagcactttaataacagtggttttgttgtaatccagcgccggacggataaagggttttggcacctgcttaatcgtgcccatctcctgcgccaatgcttttatgcgatgggattttgtcgggccaaccttgataattactccgcctttgtattttttcgattttgtcgaacggatctggatggcatcccgcatatggggaccctcactttttcggtcatagccggcatgggcttccatatcttctttgacgatttccatggcaacttttccggttttgcgcaggatttgagtctggagatcactgtccagcgcctgcaatttgtgccccaattccgtccatcccgttgtttttgcggtgatcatgtcagatgctccgtgtaagtgatgataaagtcccgtgtgatacggtaacgcttgcgattttccgtcagttcttctgcattttggtacagtgcaccgcgcgtcacgacctgtaccggataatgaccgataaacccgtgttgcaccgactcccatgctgagcaaattttaccttccagcttaagtgcttttttatagtcatgcaggataagactgatttgaaagcgagcctcaatgagttgtgtcgccgccagtccagaattgaatttcgcgtcactgatacgctggtaggtcacgccctctaacacgctggacggcagtatcagcggatagacaggcagttcggttaatcgcgttaaatcggattgaagttcaggttctatcatgacgcacatccgcctccgtggtaataatggctcggtcggtgcggttgcggtctacggcgcgaacggtaaatagccgtccctgatgttcaaccaaccagttaggttcaacgtcctttcttggcctgaccgtaaattgttgcacttcgatcacgtgttgctgatccgccgtgcggattttgtggttggacatggcttccgcccgtgcccaagtttcagtgacatattcccgcccaatgatttcagcacccagatcatcacggtttttgacagggcgaaacagtttaatgcgatagcgaagtgagccggctttcatcggcattctcctatagcggaataaaacggtagggttccagcaacgctttaaatccagtgggtaaggtctgtgcctcccgattttcataccagtaacccaccgctagcataatcgccaatgtgacatcgtcggttgctaacaggccatccggatcaccctccggcacagcctgctcatacaggcggcggttcagataattttcgacccgtttaatggccgcacgcgcataattgtctaataaatcatcttcggtatggttatcactgtcgatacggcactgctgccggagcagctcaagtgtgggaaaaggcatgtcatctcctgataatacggtgactacgccttatcttctgctactttcagcagtttcacggcgttgctgtccaccagcagggaaccaacccgcctggtggtgtagaagtgaataaagggcttgtgggtgtaaggatcacgcagcatacgcacacccatgcgatctaaaatggtgtagcagcgtttaaagttaccgaacgccaccggcaccgcacccgcccccaaatccgcaaattgttcgttttccgcaataccgtagcccagcagcgcagagggttgccccagttgcagaccgggttgccacagataattgccctggctgtctttcagggtacgcacctgaaacaacatgttgttgttcatcataaacttcgctcctgtgcggtacggcttgcgcagggtgtagatcaactgcatgatgtcgtcggccgtgactgtggtcggctttttcagcaatcggtgctgcaacgtcccccatttgcgatccttatcttcctgcgcatcactgccataggccagcaagcctttcggtttatttttaccgtcaccgtgggtaaaagcattttcctcctgttcagcaaattcctgtgtcagttcagacgagataaaggcttccacatcgaaaaaggcatcatccagcatggtctgggtggcggcgggattaccgtaaatctcaccccatgttggttcgatgggcgtcagcttcggtgttttcgtttccgggcgttcatcggtttcgccgacccagccactgttggtgccaccctgattgatcaaccgcttaaagttgggattaccgacggacaccacatgacattcagcacgcatcaccacctcgtctttcagagcactgatgatgctgcgatccagttcttccggtacggcatagcccccttccggatcagccgtggtctgcatggctttttgttccagctcggccagtccgtcttcccgtcccttgcggataaactgggcaaacgccgttttatgctcattcacggctttgttattgctgccccccgccggacgtttcagcccggccagctcctcttccagtgcggttttcagggcatccagctcagacagcctgccgttcagggtttccacctgcccggccagtttgcctttttccgcctcaatcgcctcaatgcgctggtcgtttttctgccgaaattcgtcgaaacgctgctgaatttcctgcgcaacctgctgtacatctttgacttcaatagccataaaaaactccggttagttaaaatgtaatgatttcagtgcggttaatgcgttggcggcttctgcgtcctgcaaggagagcgcactgtaacccgctgacataaaagacttggcctgtgtacgggaaagaccgatatcgcgcagcacccgctcgatgcaatcagaggtgggaatatcaccacgcgccaaggctgatttgacgttgctgacccgggcatcatcgttggcaggaaaggtcaccagactcacttcccataaatcgagatctttcagtaaaaaagccgctttggtccggtcatactccccgtctttcagcacataaccgatagacaggccggagagtgaacccgctttcatatgggcatgtgcccgtcttgccagtgggtcatcctcaatcagcagccgtcctttgagatacagcccggtttcgtcttctttcatttcggtatagataccgatgggttcatccatccggtgctgccagagcaaggccggtaagctgcctttttcgccccattgtttcagcgtattggcaaacgcaccgggtaaaacgatatcgtcggtactgtctttcagtccgaatactgagccatacccttcaaactcgccggaatcactgacagatttaattttcaggggcatatcaagccgttgtttggtcatcatcggcatggcgttcttcctcttttttcgggacttgttcaggtttcgtggtcatgttcatcggtgtgagataaatatcaccgccctcgcgggggttgagttcttccagctcccggcattcgttcggcgcgtaaatcccccagttaatgccggtggcgtaggcttcaaagcgggatttcatatccccgcgcagcaacgcgccggtattaaatttggcgtagaaccgcccctgtttattggaattgaccagaccagcattaatccgctgttcaatccgggtgagataaggcaccagcgagtagttgataaagccgatccccagattttcgatattgttaaaggtggcacggtcggtgttctgtaccatatgcaacggcacccggaagatgcggcagatttcctcaagctgaaacttacgggtttccagaaactgcgcatcttcagcggacaggctgatttgatgccatttcagccccatttccaggatcatcggcttatgggcattaaccagcccctgatggcgggcttcaaaatccattttcaaccgctgatacgcctcgtctttcagtgcctgatctgtttgcaatacgccactggtgacagcaccgttgccaaataaccgtgaaccgtgctcttcggtcgccaatcccagcccgatggcttgccgggcataggtgatgggacttaacccggtcaggccatccagtgtaaaaattcgcacatgccagagttcatcctgcatcagcgtcctgctttctccattcgggaaggtgatttgatactcaggttgccagtcgtgattgagtttcgccgtcacactgcccggatcgaggggcagcagctccaccacttcccccaatgctttgactttgtaagcgtagaaattgccccgcaggcacaggcaggcaatcagcaactcccagaattcctgtggggtcatgtagtgattggggttgaccgacagcagcttatgcagccgctcgttaacggcgcgccgattgccacgttctaattgttcatacagcaaacagggcagcataccgacggattccgccagcacccgcacacaactgaacaccgcagttaactgcatggctaactgtgggctgactcgcctcccgctgtaggtgtcataagacaagccaatcagctcacttaactcacgggaagtcagcgggtcggcagatttacgaaacagtccgggaaaaaacatcaggcttccttatccagtgtttggctcaacatacgtgaaaccagatacgaccagccgaggcacaacacgccagacaccataaatccggccgccggtaacaacagccatgcgccgtaagacagcaaaacgccgcccgccagcccgattagcagggcagcaatcattaatcctttcatgaaaaaatctcagagtgagcgtacaccgtgggagatcaaatgatctgagagactgggggcttcatgcaaaatagcccgccccatcgccattatcagcgctaccgcgccatcaattttgctgtctttatgctctttgatggggcgcacaatgtcatcattgccagccagcgtttttccgacaacattgccgagacaccaggacattatcggatgaccgtcatgatggaaacgaccggactggatggcggcctccagctctttcatcggatcgctcatatgcgtgaaattctgggtaatgataatgggattaatcccttcgtccgccaatgcatgcgataagccggttgccccaaagggatcgatcggggcttcattgaccgggttcaggtgacaggcgagtttggcttcttcaaggatatagcggtaatccacttcagcaccttccgtcacggtcagcagatccatttccacccatttctgaaaacgttcggcactgcggcggttctcactctgctccacgctgtaaaccgtgtcatacggcacccagaaacgtggggcgatactgtaaaaatgacgcttgccgtcagtttcacgtgaaaaaagccgcgccatgctattcatatccagtttacgggcgaggtcaaaagccagaaaacaaggctgacctgcgaattgttccagcgtcagtgaagtgtcttcgcactgtttccagttcaccatattgaaataagcctcccgtgcagacacccagatattcaggtgtttggtcttgaatacgctggctaaacgcgggttattcagggcgcgttgttgctggctcagcaaaaaatcagcatagaccgagacgcccatattgggattggctttgcgcaatacgtccggtgaggtccagtcatccccctcgtccacggtatagatcacgccgaacagctcttcattgggcacattaccggacagcatttcaatcacttcgcgccgcttgtcatagcaaggcccttcaatgttgtaacctgccgtggtgatcgcccacatcagcggctgacgtcgtgctcccattcccgtgagcatggtggtatacaggtcatcggtatcatgttcatgatattcgtcgacaatggcacaactgggggactgaccgtcaccgggattgccaattaacggctcaaaccgcgccccgtctgccgggcggttcatattggcggcattcacttcaatgccgaacgcctcaagtagcagcggggtacgcttgcacatcagtcgcgcaggccggaatacctcccacgcctgtttctccgtggtcgcgccggaataaacctccgcaccgaattcgttatcacaggtaaaacaatagagtgccacaccggctgaaatcgccgatttgccatttttacggggaatttcggtatacacctcccgaaagcggcgtaaccggctgcctttatgcacccagccaaagaccgagcagacaataaacagttgccacggttccagcgtgatcggcatccgcttaaatgcccattcgcctttggtatgcggcaatagctggataaatttcgcggcgcgttctgccagatccttatcaaaccgatagttgaactgccggctcttttcctgatgcagattatccagatgccgctgacaggcctctctgacgtagcgaccaacgtcaattttgccacgcacgacatcacgggcatattggttcgccgtattgacattcagataagatttgcggctcatgatgagatcatcctcataaatggattgtccgttttggcctgacccgccgcacctatcaggcgctggcggctgcttggatctaaccccagcatcgcgccggtagtatccatttcagattgttgttcttttttggcagtcagttccgggtttttaatgggtcccccggtcgcaccggttaccgtattaccctgccgggcgatatttatcacagcattgcgccagaactggtaagccacacaccagcgttcgagcaccgcaagatccgtgacacagagtaacccttgggcgcacagctctttgctggtcagttcccacatcaccacagccagcagcatctcgttttcagcaaaccaatccgggggtgatactccggtcagtggcgtaaagctcggttcatcccggttcagcttgcgcttgcccggattgcccgccagttctttgcgtgccgttggcttgggacgacggcctgacttacccatcgttcccgccatacgcagcccctcccggcttaaaaatggtgaaagatcagtaaaaagcacccgatttaaatttcatttttcgcgggcataaaaaaagccccaagggggcggtccttgggggcgagaggggtagggattttacccgccctcctcttgtgactatgaaattcgaaatgattacttttgaaattaatattcactcaaccttcagcgtaatcgctccgtggctgtcttctgtcgatggcaggcttcacacaatagctgtagattgcttaacgcatcagtgccgccatgcgctttgggttggatatggtcaacggtggtgcctgtgaccactcgtccctgccgtaaacagtactgacacaggtggttattctgttgtttaacacgaacctttaacttatcccattggctgccatagccgcgttgatgtcggctcttgccctgctggtagcgttgccagccggtgtgctggtggtcaatacagtagccgctacggtcagtggtggtcttagggcagcctgatttgcgacaggctcttggaatacggggtggcatgtgctgcactccatatggcaaaaaaccaccaaacggtggttgaatgatgtactcaataaaaatgccaccagcgtcaacgggtaacaggggatatgctgtatttattgaaaatgttaacggttttttctactaaatactgccttctttctctattaccaatattcttgcttcacctattggataagctacatgctcagtgccaatagaagcgtaaaatatatctcctgtttttaatttggcgattttttcctgtcctttttctttatagtgcatatcaacatttccatccatgaccgcaaacacttcttcaccctcgttgatatgccatatataaggttggttagtccaatgaagttttacggtaacgccatcaagattcgagatcaaccgagaatcccatgctcgctcagatttaaaatctttactttttatatgctccataaaccaagattcacctctattaattacatattattaacatactatataatctatattaccgataccgcgtcctgacatattcccacaacctcagaattcatttgttctgattatggtgttggttttccgtgatttcctctgtatccagtactcacatattcctgtaaataccttaattttgctcggtcgttgatgatgccttcccggatatcgagaacagctgatccagtttctccagtgagttcgacggtggttgcatcgaccacgctgctggagggagtggtttcaggcacgggacaggctgcttggatgcgcaacttgcgacgaccagcggcaacatcagcccgaagagtatcgatttcaatcttggcattggcgagttcctgagtgtgtttgctatccaatccatgcagcatttcaatatgcgtattctgataatcaatggtgtcagtcagttgctggatttctgttatctgctcgttattaataccgagctgtttcttatattcagagcggtataagaaggttgcggctgaagcaatcatcaacgcaataaccgtacccttggtgaaattgagcttcatgataaaaacatctggcgttcagatgccctgcgattatccagcccacgcattgccttacctgctgctttattccagcgggaaaattctgccgctgcgcctttataatcaccttgattgagtttctttaataaagtagagccagaaaagttaccgctaccgcaattgaagataaacgagcacaaagcatcgaactggccttgattcaaaggaacgttaacccattgccttaatgtggtgtaaacaggctggagatcatcctgcaagaatgcttcagcctgctgctctgtaatcacatcaccttttttaacccctttggtatgaccgtaaccaattgtccacggaatgccgccagttgcgggatcggggtagactttcagtttcaggccttcatactgtttgatacactcaaggcctttattgctgatttccatcagaagatgctcccgtttttttctctgcggccttacgcagtaattgaccgataaaatccgtccctagatagccaatcatcacactgccgatataggctaaatcaggattcagaccaaacagatttaagacatcacgaataaaccacgcgaacatggcacacatgaaggcatcaattgacacctttaaccaacctccaccgttataacggccgcgaagaaaggccattgtcccggcgagtactgacctaacgccttgctcttttattgaaacaaaccagttaccaaggtgtacccatatatcaggattttctttcattttcatatttcccctgttaaagcaatgggtgtctgtagggtgagtaatgttagcccctgtgcgtgtatacggatgtgatgagagtgattgcggtggcaaagtcggttgacactgcacacacttaacgtatactgacgctatacagtatacggtggcgcacaatgattaagagttttaaacataaagggttagaaaaattctttaaaacaggctctacagcaggcattcaggcgaaccatgctgtaaaactgaatattcaattaaccgcgttaaacaccgccaaaaaacccgatgacatgaacgcgcccggctggaaattacccccgttaaaaggtgctgatttaaaaggccactgggctgtttctgtcaacgggaactggcggctgacatttcgctttgaaggcgaagatgccattttggttaattatcaagattatcactgagaaatcacacaatgagcagaatgcataatcccgcccatcccggcattgtcttacgcgaatatttaggcgacatttctgttacagaagcggcaaaagcgctgggcgtaacccgtgtggctttatcccgtattttaaatggcagcgcaggcatatccgcagatatggcacttcgtttagaagcggcattgggaaccagtgccgaaatgtggacaagtatgcagtcccagtatgagttatggcaggcttctcaacaacaacgccccgaaatcaggccgatatttgcacatctataatgatgaagtggttcggtattgccgaactacttcaactatccagtcataccgatgagttgagtcgtaaacgctaagttgacaactgcccgttgatctcctgaatagtctgcttaaaccgttcttcttccaactcaactcctaatacacggcgattgagtttcaacgcggttttcaatgtcgccccagaacccataaagaaatccgccaccagatccccttcccggctactggactggataatatgcgtcattaaatcagcgggtttttcacacggatgcttgcccgggtaatactgaacaggggcaaactgccagacatcggtatacggcacggcggctgtcaccgagaatgggcggcgcattaaaccatattcctgccgtaattcatcatactgacgcgacagggtgaaatgagaacccaccagctcagcataagggatgttcagttcgccacgctgatgcttttctttggcgatgcggtcaaacaaaccctgcaacttttgatagtcagtttcactgggtaactgccactggctatcgctgaaccagtgactggccatctgcttcccagtggcggcatgaatggcttttgccgtgacacctagcgcttttcgagaaccacgaaaataatcaaccagtggtttaaataccgactgttttagatcctggcattgcttgtaatagccatcccctttcgggtgatagggtccctggtaatgttcggcaaaaatgatgcgttcagtggccgggaaatacatgcgcaggctttctttattctgcctgcgccacgggccggacggtttcgcccagataatctggttcagcacgttaaaccgttcccgcaccagcagctcggtatcagcagccagacgcgaaccacaaaacatgtacaggctgccgttcggtttcagtactcgccaaaattcagcaagcagttcatccagccaggcaaggtaggccgtgacgtcctcccactggttatcccagctacacgcttttacccgaaagtacggcgggtcagtggcgattaaatcgatgcagttatccggcagagttttgataaatttcagagagtcatcgttgactaaggtgacagggcgtagatccatccgcttttttcctctcgacactggcgactttcaggaaaaccacaacacgaaaagccggcattcaccggctgcgctttcacgtcctgggaaatagccccatcagggagaacgtttgaaaaacgtgtcatcctcccggctttccattaaacccgccagacgaaattgtgttaacagtaattggcaacggggttcaggcagccccattaatttagacacttcagaaacagaaaaccacgtatgcaaaggcacggcgtctaaaacacaggcggctgtcattgtcatatcttcatgttttagcatgataaatttaacctcatggtcagtttttgtgcatagacacataggtaactctgacccgtcacaacagcaagtcttatgtttatttcaggcgtaaaaaaaccttgcacggggcaaggtttaagctgtctgatattaataagcctggtgactttgtcatcacggttatcacaatagcagcgtttttacgatcgtaaagatttatttttaaaaatcgctacataataggtgttgtgctaacgggatatctttatccatgtccagtgggatatccagcatcattaacatcccttcaatcacgccttaggccttttgtaaccgttttccgatatgcgtatcagaacagtggtgatcatgggccaattgcataaacgttttaccaaagacgtaataatcaaacaacaggtcatgggcatcactagactgctgattcagttttgccatgcaactggaaataaccatagcgtcatcatcacaacattgtacccgggacttcactctgttcgggattaatcctttgaaacctgccgcaatggaggaccagtaaaccccgtcgcgattatcagccacccatgcgccccagcgttccatgactaattgaatatcacgcattcgcacactcccctgtgattaaagtgccctgtcagcatagcggcgttctttttgtttggtttgtcgttgcatccggcaaacttcagcagccgatatctgatcggtcggcagataatggccgtgcctgaatgcctgataaaccgttccggtttgcccgtggcggtttttctccagaataatttccgcgtactggctggcggggctgagtgggttatacaccccatcccggtaagtaaagagaatgcgatccgcatcctgctccagcgagccggaatcacgtaagtcagccgctatcgggcgacgctgatacaaagggcgcttatccacttcccttgagagctggctcaaggccgtgaccggggtatgcagccgtttcgccaatcctttcagtgctttcgatatttctgccacggctaagtcgtgacggtcagcccggggttttctaatcaacccaaggtagtctacgaaaatgccctttaagttcgggtggcgacgcttatgggtttcactgatggcgcaaatttgttcgatactcagatcactggcatccagaacatgaatatcccgctcaatgagtgaaccgagtgcattgccaatgcgcccccagtcttcgtcatacagttcacagtttctgagtttagacaccggcatcgcagccgaattcgctaccattcgctcggcaatttgttgcgctgccatttccatggaaaacaacaaagccccgccaccgtcgcgggtcatgccgtcaatcatgcacaaagccagttccgtttttcccatgcccggacgtccgcccagtaaaatcagatcagtcgggttaaatccgcctgtcagttcgtccagcggctcaatacctgtcaggatcatgcctgtcttgccctgattgcgcgcttccagtgtttcaacgtatctatccagcaatgtaccgatgaccacgggttgtaagctactatcactccgggataatccattaaactgggatgcaaaagcctcgatcagtgcttcagcttgcgtatgattgccgcagacctgaatctctttctggtaacggttaatcagatcagtaacctgacgtacacgccagtaacgcatgactttttcagcataaccttttaaattggcctgccagaccggggtcttggccagttccagcaggttagccagaatgccgcgttcttcacccatcgcatccgcaatgaaaaagggatcgataatggtactgctcagggcctgctttttgatttccccgtacacccggcgcagatgaacggagctgaacgcctcatccggtaaaattgccaatacgtcgtaagcgtccggtgtcgccccgcccgataacaaaccactgatgacggccatttccaaatcatatacgttcatgcgatttcccttctgtagctttcccagtcaaaggccaataccgtgccaccctgaagtactctgtccagcgtccgatcacccaaaaactgcgccagctcagtcacaggcaaattactgatcagcatggtgggcaacaggtcttcatagcgattattcagcacctcaaacaaaatattgcgttcagactccgtgccgtattgcacaccaatttcgtcaatcaccagcaaatccagctcgctgtaaaatttcagtgtgtcaaattcactcatttcaccttcgctattccatgagcgacgaaacgcccggatgatgcgtgacgcggtggtaataaaaaccgcttcatcaccgcctgtggcgatttcacggcagagggcgacggcgaggtgggttttgcccgtgccctgacgcccgcacaggatcatgccttcccctgcccgcttgcgttcctcccacgtctggacataaccctgacaggttttcaggttggtttctgccctcaggctctgcggttggtaagtggcaaagctggcctgcgcaaagcggggaacaattttcaatatgcccagatcgattgtttccatcgcgtcttctgctccttaaagattttttgtccaattcgcgccgtgtgattcataacgcttgtgcttaaatccagtatgggtgttggtttgtggtggacgcccggatctcggtttgtcaggaaataacccttgccagctgttggcaatggaggtgcaaatcacctcatcaggattggtacatcctgccaattgcttagcctgctggcggcaactggtttccgtcaggggtttcctgatttcctgcctgaacgtcacccaatccgcccacgtttcggcactgacgttttccggtttggccgtcaggggatcgaattgcccggcccctttgggttttataggttctttgacgggttccttgacaggttcaaaagagtgactggttctggtgccatctgatggcataggggggatgtcatctggcggcatgggggtgccagcagatgacacagagctgccagcaggtggcacagggggtatgctttttggtgacacagggtcagcggataaattcaggtaatagacattcgaggcattccctttcccgttgtgattgccgagccggttttccttgataagcaagcccatcttaatcagggcatcaatgtggcttcgcactgcgcttttgctgcattcacagtgatctgcaatatgctgatatgagggccagcactcccctttatcatttgcattgtcggccagcttaatcagcaccagttttctcaggggattacccactcggatactcattgccttcgccattagactcatactcatgccgttcccccctagttaccgtacgctaaccaccatccacatgttcatatcgggctaagccaaaacgtcctgcataatcagccaccgaccggaattgactcatgggctttggcttcaggtggtgggaaaacggtaggcagatcaggacgcagttcatgggcttggactgccccgttcgacaaaaccacgatatcgggtaccaacgacaccgaaacccgtttttttccgtataaccatgcgctgatgagcgattgtgcacatcccagaacctgagccagcttggcctggctgcctgcgatatctatcactttttttatcacactgtttttcattagttcctttctccaacaccacggcaataacaatatcactaacagtcaatataaatcactattggagtgtttgtaaagatatcactctagagatagaataagaaaaaatgttccaagacagcggttcttgggtttatcccctgtattccacgtcaatgcgggaaccactcatgaggcacttatgactcttgctgatagattaaaagaagccatggcagataaggggctgacccaatctgctctggcaaaaaaagccggcatggcacaatccatgatatggaaattactttccgggaacgccgtcaaaacaggccggctcgttgatttggccaaggcgcttgacgtgcgcccggaatggctcagtgatggcagtggtcataaatcgcagtctggtgatactgattttgctgtcagacataacaaccgttatgtcccggtaaaaatttatgaagcagaacaagaaaccccggagttcttcatggtgccggccttttttgaacagcaggcccctgttgaatcctgccgggcttatcgcatcacccaaaataccggctgcactgaagcgccggaagggacggtgattgtggtggatacacaggaaaatatcgccaatgatgatttagtctatgcacgcatcggagagcactattcagtttatcgttataaacaagggggggctgtcagctatttgtctgttgacgatacgcgtatccccttgatacctctctcttctgacatggaaatcgtcggtgtgattgtttatttattccggaacatgaagcgaaaacgataacattcctctccctactctaaacaccgccaaaccctgcctctatttgcgacaagatactgtttttaatgcagtatctttagttccattgaaattattatcaccctaaagatccaaaatcattcagatgatatcaaattaaaattattttatatcaataagataattaaaaaaactgatttatatcactataggtatggatttgatgaaatttaagtgataatgttagccgcatcaaagtgataggaataatcactacaatagtcagcgagaggatttatgcgtacctttatttctgccatcatcaataaaccagcaacaaaacaaaaaaaggctatcaacattaatggcattgttgccaatatcgcacaaaaaaacagcctgcatacaggaacaacacctatcacctttttggcagaccaatatcatcagggcaaaaaccagaatcacggcatgggcataaaaaataaagatgaatttaaacatcatatattaacgacgtatcgggtcagcccaaaacatacagaacctgttccttgctataatttagaaccgattgtcgattacggttatgcgctctataagcggagaggacgatatatgcatttaattgatatcattcctctgattaaagcagacaaaaaacactgtcagttataaaaatagccacacaataaaacgactataaataaaatctatcaatttcaatcaatattaaaacttaatgacagcgcctgcgctggggaatgtttcactctaaattcagaacggttacacacaggaagagaacacgaaagaagtctgttatatggaaactgcaaataaaatggctcaaatggagccagaaaaaatatcatcttacatctttatattgggaacaaacaaaatacggagcaatgcctatcagtaatcaaaacaacaagagatacgccctgctggtactgccgatagcccgatcacaagcaagggagttttgaaaaatggctatcagagagggaggcaagccatggcgataagatacattaagcgtgaagagatgcaacgactcacaggaaaaagcaaaacaaccctttggagaatgtacgcaaaaagaaatgagtttcctaaaccagataagactgcgggtggaacatttttaggatggactgaagaggtctatgaggcttgggtgagagagaagaagtagcgataacttgacccattacctgacccgttattttgacgggtttttcatttttcactgtaactttttgattttatggtacgccctacaggattcgaacctgtgacctacggcttagaagtgagtagagtcactatctaaatcaaccaattaccgcatttatcggcgctcacacgtcccaccttacccaaacttaccccttgttactcctccttgcttttcaatgcctgtcccagatctgtcccaaccaattcacccagacaaccccacccaccagtttaccgcccacaatttccccaatccacccaactacccgctaatctcccctattggctatttattgacggctgacgtgacgccgtactcctgctgaggatcagatgccaatacctgtttctggttccagatagaatcctccggcatctggacgcggacgtctaatcgggtgccggctggtaaatcacagggttcatcatccgtgtaataagccggctcatccactgacttcatgcgcctgttctgtaatcgggcaggcatatgcgcgttctgtctgtgtgtgactttgatttcaatagccccatccggcagcactttatcatcaacatacactaactcattgccattgacgtcacggggaacgctgataccgccatgaacaccccatgcaccgtctgagttatagccaaggatgccggatagtttgtagtgaccgaggccgagtctggtgactgtcgccccttcggattcgtcgttagtggtaaaggtgccatcggggtagatttggatgatgggggaggctttcttgagataaccgctaccgtcaaaggtcgtgtttttggtcgtaataaactcaattttatcatcccatttgccatagcgtcttcgcctataatacagggggacggagcctaaatcgccaccaataatgatattgaattcatcatcactgaataaagatactgctatctgtgtatacgaatctgtccatgaaacagatgaattggcattgctgttaaaaaatcgggtaccgagctcgaattgatatc

SEQ ID NO: 14965 - DNA, 69352 bp, Xenorhabdus bovienii
  Genomic contig Name=Xb4151_4152.C424
tggacagtatccaacccgttttctgcattaatatgccttttttcccttgcaccacagtttctttgctgctgtgggaactgagttccccttcgatactcaaaggccttgtatcgctggtaatgacacattttcctgcttcgtcccagacagcaattccccaatccgggacaggctggggataaaccagagtgaacagataaatctcacacaagatcgaagtctcagtgccactctcgccccgggttatctcaataccccattccgaaccgcccccgaacatgaccccataaggtgcataccagacattgctggtgtgagcacacataaacgccatgcagggttgtttcgtgctgatacccgtttctatccgcttcacgtatctgtcagtccagaccgattcttttctcacaaaagaaaggggggtcgttttgggtgtccaccacggaacaccgttacccgttgttaaaaatgcaccccaatccatatatcacctcacgcagtgtagtaagcaatcagccatccctcaacggcgtcgtcgttgccatccgaaatgatgatttgattatcctttaccaaaaattgacgttttttatctacccggtcagtacaaagaaagacataagaaagccgcaatccttcattcatcggctcccgggggacagtgagcgcacctgtcgtctgcccgctctccagcttcataaagccagcataaagaaaggggcgaatgccggtattacgctgccgcccctgttcatcccagaccccaaacccgtaatcactcatcgtcgaaattgtcctatatagcccatggccgcccgaacccgtccgctggggtcatagcaggctatcgccccgtttgcccaacgcaatcccgcccgaacccgcatgtcgttaaattcaaaagcgccggtcgccgcattaatcaaaaagcccgcctgatactgcacgtaatttttagatctgatggcatcagacaggatagcctcccgcattaaggcctgatcaataaacgcctgccgaataaaaagctgcccgttcttagccgccataaagggttccatcttgccgctggccggattgaaccagacgaagttgttagcgttaaagccgatattggtatgcacttcgccattcttcacctcagcccctatcaccatcccggctttatagagctggcctttgtacttcaccccggcttcaatctctttgagggcatagccgttaccgtcaatatcaaagaccactgtcgcctttgtctttacagccgccgcattctccccgacatcggcctgcaccttttccatcttctccgcaaaggcttcccggtcggtcacctgcgtggttttgacttccagtatttcggctcgcatattgccgtttacttgcaactgtcgctgaacaactgcccctgtcaatgcggcgttctccatgatggcttcggagttaaagtccatttgggactgtagatgctggcctgctttgttggaaagaaactgttcgccaacaacctctaaaatatccttagcattgtcatttggctggccttccgcttcgacaaaatgagacttgccaaattcattgatactgcgaacataaaaccaatatggtgtacccgctttcaattggccctttatccaaaattttgcaatgcccagaaaatcggcttttgcttcaatttcattgatattagaaatgcggttctcggaaaaccagaattcaaattgagtatccaaagtctttggggcgctgatatgaggaatggctttcaactcaaaaaatccggactcaatattgacagtagaaggggcggcgggagtgccaattaccatctgaaccttagactcatcccccagcattccgttatcatcacgagcacggacgccaaccatatagataccagcatccagaccattaaaataatattccagttccttagtattgccgcgagataccactttattgtcacgatatacggccacatcaaaggtgatatttcggtttattgttgtggtcgcccacatagcgcgagcctgcacctgagaactgtcttgaatataagcgacacttaatcgctcaatattgggaatacgaataacattttgtgtggctggactcccctgaaaatcaacgccgttatcaacaatcgcttctttctgtggctcgtgttgaatgcaggtataattgtagttacccgtcttattgtcttcggcaatgctcatcaccctgaataggcgagtcaccagcgactttttagatatggaaaatacaccccattgccgcaatccgacaggttcttctttcagtgtaatcatatccccgctgacggattcgatatccacccggacgaacttcccttcgctgcccatgtaggagaaatagcctgactcgcctttcgaaaattcggctggcgcatcaagtcgaacctctttgcctgagaaggagagaacacgtccaccaatacgtgccgctgcgaagctgttatcggcaatttcaacaatgtcaccaggaatacagttaattccctcccggcctgtactgaacgtgaccgaatccgtttcgagtttctcagtttcaatgatccatttaccgacacggtgagcctgtccccggctagtacagccgaatgctgtcactttcttaatattgataccaagacgagctgccaactcatcatcctgaatcatttcccgctcatctttccagccgttatctgggttagtccaagtcacctcgatagccgtatgccgggctttctttgctgctgcactgtagttaaattttccttcggccacgttggcattggtaaatgtccagaccggatcggatggcctgtcctgaaagcaggtcagttgcagcccgttccagacctgcatgccccgaaagaccgaagccagatcatccagtacgtcccgcgccttgcgttgagtagctatatacgcattgcaggtaaaacgcggttcagttcctccaaatccatcagggacgggctgatcacaatattgagcaatggcatacagcgcgaatttgtcacagccaaatgaccccatcaatttgccaatgccatagcgtgtattagtcaccaaatcgtagaatatccacgcagggttatttgtgtatgcgggtttaaatcgccccgtccaaacgccggaataatggcggctctcaggatcataattatcgggaacctgaacaatcattcctttgatgtggtaggttcgtttgggtgtatctgcaaacaatgaccgatcaatacgcataccgaccacggcactattagggtaactcatcagagtgtcggtaatttcggtatagctggcccatacagtaccgttgcggagctggtccgttttgctgtcatcggttaagcgggagacgcggatttggaacggttttttctggggtgcattaatggtgtgtgattcaagatattgtccgctaattttaccggggcctatctgaacggtcttaacatgctgccagccagaaccatcattcacgtcaatagccagttgcaccgaactattgctctgattacctttactgtctgtctgaaccagttgactaacgcccagagtgaacctgacgcgatccacatctttatttgaaaccatcctgagaataggagtatcttttttcacctcaacactaacaggaatctcgctttcaacaaatggataatcgcttaatggctcttgggattgagtacccgcccgccactgtacagtgacaccgttaatattgggattgccatttttatcaacgacaggagttccattaaccctgaacccatgtagtccacccacaggcccttctatttgcccctcaccaatcaaatcaacaacccgtaaaaattgtttattctttagattgtcatcgactaatgttggtgtgctgccacccccgccacctttacccattattctgtctccaagccttgagaaataacattagaacccacaaccatctcaccgtatgcaataggaatcggataaccctgtccaattcggttctccagtgagttgaaatactggtttccatccgttttgcttgaacccatttcggggcctttaggcattttggttaacatggaggccagccctgcactgatcagggcaacacccgcaattgctaagcctgtagcagctgtagctgctgcaccagacgcacttgcccatgcagctaatgatcccccacccgtatagaatgccgccgcaacagctaccacgcctagaatagccatgccaacgccattaccaccagcaccgccaacaaccggaacgatagtgatcgtatcgccatcattaagggggtgattcataccagcaggaatacttttttctgtcatgtcacgcccagcaatgcgaacacgaataaggccatcagaaatcgcttgctgaaagcctttcaactggtagcacaagcacctgacggcttccgctgcatcacgaacctctaattcgtagcgacggccaaatcttctaagatggcctccaagctgtagcttgaccattgtttatgtctccatattgaatgtgtgtacttgagccaataaccgtcatagatatcgcgtttgctgatgcgatctggccgatggtgtagaatttgctgattgccgagataaatagccccgtgacagggcgtctggctacccagacaaatcaaaatgatgtcgccggactgaatgtcatcgacctgttcaaatccctgactgagactattatcgagatacaggttttggcctttgttccaccattcatcgtcacgtggaatgtccgctaactcgatgcccgcgagatggtaggcgtcacgaattagcgaatagcaatcctgtgtgccatgtatgaactctcgacccaataaacgaggaacagggcggaatttatgtaccctatcaccgcaggccaaccaccacggcaacccggttttgatttgttgttctctgtcccctgcgctcaatcgggtttttccatttggatgactgtgcacaatggcgtcaatatccgcaaagcactctgcggttatccagtcatcgggattaatctcgaagtagttctcaggatctggcgaaatattgcggcatgggaaatagcggccacctgaaatcaagccgcacgattccctcaccccttccgctttcgcgttcgcgtgggcgataatgtctcgttcaatcatggtattaacctaatttattggcacccaaaaaaccgccaaaaggcagggatagggggcggggaaagcggcaaatgcagccactgtatttctttgaacatcgatctttcagcgggtcagtggttggctgatccttctcgtctgccactggtgggccatcatagccacaatcagcagaacggtattgccaacaacagatatccgcctgaatcactcttgccggaatcaaggcaccatcggtttcactgggtaacgccagcacataggtaacaaaatcagcgtttgaatcctgcttctgctctatcaggtacttactcacggcttctctggttgggtctgcctgtgggttgccattgggaaaattgaccgcatcaagataaatttccggcacttggtggcgtgtcacaaccgctcccaaagcatcattgaaatcttggtttatcgcagtaatgaacccatcgacgttggcaaatatcattttaggtctggcgctgggacccttaccgttcatctcaaagcccgacgcttcaacagggtaagcctcatagcgcacaccttgccagatgaccggctccaactttccattcataccgtcatgaaagcggtaaatatcacccccgaaagcggttaaatcaatttcatagagattaagcgtggcattctggctcagttcagtaaccgcaatccgcatctcttttggaatgtctctcacgctactacctcctcaaaggtgcaactgatagaccagatcacctgttgcctgtttaccgtccaagaacgacaaacgaaagtacgcaattggttatcgtcactagtgagccatgtaaaagactccaccgcacctctggctcgcagaaacccgtcaatggctcgccctgtatccactttctcaataaaactgagttgatagcgcttcaactggttgttaatgccgtctttgactctctgctcataaccatcaccgaatttcacgaccctgacacgcggctcatgtgtgacctcatagttatcttgaggccgccatttgaattctgtttttgtcatatttaacccataaaaaaagcctcgcagggaggcttttttagctttcagaataaattaaaaaatcaatttagatacggcaattgcaatactcgctgtggctatgagggtcgcagctatccatttagtttggtttgcaatagctttttgtacttcaactctcaccgatgcaatatcttcttttgttgcatagtttgatttgatgacagcgagatctactttgatggaatgtacatattcttctaactttttaactcttgtttccatctctccacctccaccattccctccagagtgactggtttcattttctggcaagggagtatctttaaatatagggattacattctctaaatgcttagccattcttaccttccgtactctgcttgccaccattttctagccagttaataacatgataggcattgaaatacatttcatgactacaattttgacaaatgcccctatatttatatttggctatattatatttacttttaatggatacctcgttaacttctatcggaatgagatagaactcttcatctgtcccgtcagccattgaaggaaatctaacatccttattgccacacattacgcatgatatagcgggtatccctctacttcttaagaattgagaaaaacttaaagcagtaaccaacttaaatttctcccaaagtttcctctctttactttcgattctcttcggttcagtatccatcacccactccaataacagaaattttattacacaatttaagcatcagttattggattcgtgttactgattttatttacagcgttttcatacaagctagttactgattaagtaaaccaccgtcacgctgcgtctcattagccaagacatcatagacttcgcgcctaacaaaaccagataacatcctagcattttcggctgtaaattgaccattattactgacattgaaattattgacctgattaataactataccaccactaccacctttccccatatccctattactaatcacctgccccctgtcacccggtatcatgtattgatgaccgttattcgctttgaatatttcaggcttattgtcttcaccaatgcgataagcaccgttcggactgactggcccaccatttttacgagcgcccattaatgcgatcattgcaggtattgccaccgccattgcagttagaccgaaagtcgccgcagttcccattgttgctacactggtagccgcagcagcaggagccattgccgtagtaatcgtcgcgcctgttgctacagccgatgccgcagccgcagtgttaacagctttaccgatgaccatgttcttgatttgctgcatccccatttgaaccaaagcagacaccgcctcgttagtgatggttaacgcgaggtttcgcatggcatcgttggcgctttgagtgccggttagcagccctgttatggaattggcagagcgttgtcccaatgactccatagcatcacccagaaattgatacatctcattctggcctttccattgttcccattgggcgttagcaaggtcttcttgatacttcttttcgatagcggctctggctgcctcggcctgttctttcaactcggtatgcctctgctcgaaatctgtgatagctgctatttttctatcatgttcattaatgaggttttgtactgggtcgaattccccaagggttttcatggcaggcgatacggcttcattgactttgcgttgtcgttcctcttcttcggccttgtccttaattgctttcatctgctcttggaacgttttttcgtcgatgaggtgcttatcgtacatcctcgtgaggtcatcttcttctttcttccgaagctttgcggaatgggctgcaacatcgagttcagaggctttaattttgtcatcttttgcttggttagccagccaaattcttgcagcaagatcttccgctgcttttatctggagttcactagaaccctccggcatcgcctttcgagcatcatatttagccatctcaaggctgttttcttcgtagccagtgttgaggcgttcaagttcttcgcgttgatctttaagtgagtttgcaatctgtttagaacgactttcagcctcatcttgagctttcttagctgctgattcagcctcctgagcggccttttttcgtttctcggctgcttcatcaacttcttgttttttaacaaccagattaacgtacttttcagtatctcctgagtttgcacccgcatccttagcttcaaactcagcttcttttatcagtttgcctttttcatcaggtatcgatgctatttccaagtccctttcggcattcttaatcatgccttccattttcttattaacttcttttgtatcttcgcctacggatttaattgcgataccaaggctactaagtttaacttttattaaatccactacctccccgtatgttttccctgcattctcccattccttaacgttattagggatttcctttttaccttgctcataaattaacttatttgtttccgctatttttttgtttccgatatcggacattttcgccgaatttgccttggcgttgttcagctctcttgttatgcgtacatgatctgctttagcttgcgttagagcctcttgcgcttgtttctcatcatcagtaacagcttgctcggcaaaatcgctatcaagcccgttactcgtgtaataggctatttttatcgctctttttttagggtctttgaatttatcgagttccttctgcaattcatcaattttttgctctgcgtttttggcgtctattcccatctgcttgattgatttattcatcttatcaatttcagcagcaacctcttccacactcaaatccttgagtttttctttaacatcgcctaaatttttcgcatattccctcgcaccgtctgatgcctgtttggttttttcatacatatagtaaaaaacccctgctgcgatggtgataaggccgaaccatccccccacaaaagcgaatgcagatcccagcaatctcaagcccacagatgcctctttagcggcaacaccaacagcagcagtagctaccgctgctactttgccagtagttgccacttctaggttgactattgctaacctagacttagcaatgacgagattatcagtcgctatcctctcagcattagtaccagccgctgctttaagttccgcttctgcaaccatataggccaaaatagcctgttctctatccgcaagtgctttacgattagcagcaatagctgcatgttctgttgctaatgcgttggcgtgtgatgccctagcatcagccagagaagcttgcgtggatgtgtgcatagctctcactttacctgccagtgcgccattaaatttagcgacagccgctagtgctaccatgccgatagcggtagcaaatacatccagatttccgctcaaattcaccaatgatttattgaatatgttcgctgctgtacttaccttactagactcaccaacgaacttggtgacgttattgttagcgaccacgaacgcctgttctatcgtggaggtagttttagcaaattctttggcgattttatctgcacttgctttcattgcagcgacaactattttggaggttaatttaccttgcgctgccattgcctttaattgaccgatatctttaccaagatagtcagcaatggcttgcattatccttatgccgttctcgctaacggagttgaattcctcgccacgtaatgcacctgctgctaaagcttgcgataactgaacaagtacactggatgattctgccgctgtcgcacctgacacaataagcgctttatttattgtttcagtcatatcacctaagtctctagcgcccatatttaatgagcgagtagctttctcaagacgaccatacagtgtagctgtggcttctaggctagttcttgacctttgagcgatatcgaatacacgcgcagtcacttcaccaagctcttcatgtgcctttttggaattaactaatttgttgtttacagtagtccagctatctgcatatttggcaatttgttggatatagagcgctgaaataagacttgatgctaccatagataatgatgacattgacttccctagacttcttgtagccatgtctgccctacccattccgcgttctaaaccatccaatctatcatttacttggcgctgggcagtgagcaattgcgctacatccattgatacttggtaaacaatattacctacctgatgatctgccattttgtcggttccttaaaaaagaaaaccccgccatgtggcagggttatttggtacatataagggaatataatttcaaagcgtgacggattgataattttattgtcttgctataaatcgttttcccattttacccaaaagcaacgaaaataaaattgccaacgagccaataatggtgattcccactccagccgtcatataaagctgccgatctgcaactaatccagcattaataaccttgtcataatacccaactgaaatattcattgtgcaagcataaaagcaaacaaataggccaataaatgttaatagaaaacctattacttttggtatagaaccaccgccaatattaagctcacattctttggctttcatttcttctgccagcacgctacgcatagctatctttgcatcgtcaggctcattaagaatgaaaacatcaaaagcatcataataatcttgatgcatttgaataaccgtatcagaatcaccattctcttgatacttttccgtagctccatttataactttcattatttctcttattgtgcgcctgttggcctgataacattcgctatcgtcactttttatgagaattttataataatctcttggttcgccctgtattgaaatatctgacatatttacctcggttatttaccattatcagccaagcacttctctaaaatttctcttctattctgttcaactggaacagcccctcattatcaagcaatttcacactatttaaccgtaaacagcataaagcccgtgaatggagctttagcctaaaaatgatatgtatagtcgatagatgacaaacaataggccaggcagacctaaaatccagaggattaaacttaaacgtgcatctttcaacttaccatcaaaagataatgcatttttctcaagagatgactcaattcgagatattgcattatcaagtttattgtccatctctttgaatttagagttaaatctgttctctacttctgtgagcttagagtcaaatctgttctctgtctttgttaatctagcatcaagctgatcttcgcttggtttcttagatagagcgctgtcgattgcgtctaatttttgcttaataacagcaacgtcagtcttcattgtgccgacatcaccggtaactgttttcaggtcagacttcatatcgttcatggtagttttgatatgttcaacgtctgattcaagtcttgctactcgtgattccataccgccacctccaccactgccaccaattttagattgctgtgattcataatcatctgagttttcatgaggcttaaccaccttgaatcggtttcttgattctaatctagcatcaactgtaattttattcatttacaagactcactttaaagtaggcctcattgccatcaatttcctcgttattgactagaatgccagtcctaacgaaatacgtgccctcatatgaaaacatggacttgagaaaactgagcctgatagatgcagcgatatcatctggcttcccctgcgtatcttctgttttcatccaaaagccttttttatcacacacttctgtttggttcgaatctgtaaccctaaacaactggctttgtatgtaatacggctcatcatgttttaaattaatcatgaaaaccttgaaatgaaaatcaacaataaatggtaattcttcgcactcaaaaacaagcaatggctgttcatcgctatcaggattatacgggtgaataaacgctattctttcattattcattgtctttcccttcatacatccgcttgattgttttcataaacaactctttgaacttctcagactctaactgcacaagttcgtctatgttctttggttttgattcttcgtctacagcagtttgtaagatcatgaccatttcagaattaagggagcgcccgttcttcctcgctctatcggtcagcttttcctttaattcgtcaggcatccttatgctgtacggactgatatctctaactttcttcattgaacttagccattaatcacattaacttcattgatccctttagttttccttctctaagctcaatacactcttctgcacttgtttgccgccagttaccaaatgaatcccttattgcaaactgatcatcaaatccaagatgcactgaacattgacaaaattcatcataataatcaatggttaatgtgtcttcagtaaataaacaaattccttcatactcttgggctatatccaatacccattgtagttttgagatctgttcaaatacttctttgttgtactttttcataattgcgctcttacttttatttgactatttgcagtgttactcagtaaagatgcaagttaaagcaaaacaaatatattatatgatgttgcatgcacttaacgctatattagttgacagagtacaagtttacttataaatttaccgccaagaggcgtcgaaacctcagcaaaagcggtcagagccaaccccgtcagtgttggattttttatgcctaaattttaatggttgattgatcaaccatatctccgattcaaagtcgggagggcgacgaatacaacacccgaaaggggaataagtccgcggtctcttttgcaccgtttcgaacctcctgacaccactctttgttagtggtaactcaatatcgaaataaagcaaaaggagtcatctcatgattactaatcaattaaccatctctagcacatcaattcatcaagataaagatggacgctactcactgaatgatctacatcaagcatctggcggtgagcaaaaaaataaaccagtgcattggttatctactcagcaagctaaagatttgattgaagaaatttcaaaggtagaaaatcctacctttaaatctgtattcataaaaaaggggcgctatggcggaacttacgtttgcaaagaattagtttattcctatgcaatgtggatcagcgccgcattcgccctaaaagttatcagagcatatgatgacttggttaatggtcgtattagtacagtagaaagtaagaccacagttcagcaacggaacccattaaagaacgccgttaaccttctggtcagcaagaaaggtatcatgtacccagaggcttactcactggttcaccagcggttcaatgtagagcatatagacgaattgacagccgatcagttaccacaggctatcgaatatgttcacaagatggcaatggaaggtgagtatcttggcaaagaagaattacctgttctgcgtggttattctggattcagcggaaagttactaatggaactggaaaacggcgaagttgtttactcctcagcactaacaccaaatcaccatgtagcgaccataaatgattttatggaaattgcacaacgtgctggatacctgctgatacgtaaagaagatatgcaacccatgatgaaggcattggaaagctataaattcaacgcctaaccccaagccacggatggcttattccatcattataacctcacagggggtggaaaaccctcagtaggccatcgaatacgctcagtctgtacttgtctgggagtggacacctcttgagatatatggggaaacctacgagaaattttgcgtaacatttcagaccctagagattgagggtgtcgtttgggtttttgatcaccttgattattttttaaatcagtattatccatcattgaaatcctctgtttgataataaggcggaataaccgcctttatttatgtaaaacaaagcacacagttaaaaagcatgtaattagaaattaaaaaaaaccgcagttaagcggcgttagatgtgaaaaacccgccgaagcgggttagtaagttattcttttggcattggtaattcacttttagaaatgatagccagtctgttttgatgatgctcgggatcaccccatagccacatctcttgtcggctaacatcatcttgagtcagaatcttgcgcagttcgcaggttatcatgtcataggcgtaaacatgcagattatacatcagggcgtcatacatgcgatcctgccaaaaagccatgccatcattagtttgattcatgtcagatactattacgttatagcgctccagcagataatcaaagaacaccttaccagctaaatcacgtagagctgcccgatgctgaggagttctaatgcgccaaacgagaatttgggttacaggacggcaatttaactcaacgtcaggctgtataaccactcggttataataagcgacctcttttgatatgtcgtttatcagagccagctcaaaatgagactgactaatcttattagtcaatcgattatcaatacgaaccatgcgatagccaggagaaaggggtaatccttttatttgtcctgtgatatctgctccacccattaaagaggcgtagagggtgtgattatctgagctttcgttcaaatgagcgaaaacttcattaatcttttcaggacttaccaatctttgtggcatatatccccctcaatcccagtacctaaaatggatagctaaaatttagctcattgataaatattccttgaggtgatattagtctacttgaacctaaggttcaatagcattggctatattgctattgtttcgttgatgattaaaatgtgtcagtttttagccatccgtaacccgaagttaagcatgaatccatgccatttcatcgctgcatactcaccagtctgcgtttgccgctcatcagctcattggtgcgcttatcatcagcatcgataacagcgtcatactcttcacgcgtaaagcctttctcatcagggaacttggctttcagcatcatctgaaactcggtcatggttaaccgttcagcttcctctcgtgtcatattgaagtgcgtgcgggcagcactgatatactcgatagctttaaactggtcggaatacgcttccgtaccttcatgtcgttggagcctcctgatttcaaccttaccaataactccatgtgttatcagttcagtagcaaccacaatgatgtcattcacgggcattcgtcccggtcgatataccagaccccttcgccccggtcgccactccccgatgagctcgtctgcatcttcatcacaacaagcctgtataaccattatggcagtagataaaatcttccgtccaatgggcttacgcatcagcttaatcagccagtctggaagagtgccataggctatcactgctcggttaatgagttcctgcgtctccgcgccattgagcaacgtgtacgcccccacaatttgttgaggcgttccaattctcgtcattgaagagaatgaggggtaaagtaaaaaatcgcgtttatcagtggagataactatctcgccgatttcaaaaataggtgtcataattcctcctgaacattatcaagggcgctcgcaagcaccctttgtaatgttaagcagttaccgttaccgcacatttggcggctttactgccatcctcggaagtgacggtgacatttgccgagccttctgcaacccctttcactgtcaccacgctacctatcttgctcactgtagcaacgctggttttatcagatgtcacggtatagtttttattggtcgcatcagcaggattgaaattaaccacaaaagaaccggtttttcctacggctacagtcaatgacgaaggattagcggtgattgactgtaccgcgacttcttcgatcaaccattcaaccgtatcggcatcggatatttttaactcaccggaatacgtagccacttcgttagcaccgaacttagatgaccacgacgtgaagaccatgtagccttgcagaacgaaggcattctcgcctgtaaaatccatctgtacccaatacgagggctgacggccagcctgaacctctctcggtatttcctgcaacaatcgcaatggaccgaaatcatctttcttgtcccgcttacgatactcaccatcaaatgagatggttaagttcatgctggtgacgacactttccaccagcccctttgaatcatccgcctctgaggtcagtgtgttaggtgacagatcaaatgatttggtggtcaatgcaccaatccgaaaaaacgctgattgatcgggtactgcatcaggacaaccatgtgcaatacggataatggcattacggccaataagtttattggtttctaccgggcaatttgccatgtgaataacctctattaatagaaataaaaaaggccgcgttacgcgacctgattatgatgtacaacggaatagtaaccggatgatgtatcggttctcttgtgtcgggatgggggttggcataccgcccagattgaaaacagcattcaggcaatcatcatcgggatgagcagccacatagtcgagtatttcctgcgctcgctggataacgggctgtgggtcgttctgtccactgaccagtatcacctgcacattgtcatccgcactgagatcatccagtcgtcctgttccacccgatggctgaaagaccatgtactgcgctttcccgccatcgcctttctgttcaatccaagtgaccatctgtaccgtgaaaccatcaatcagccttgccgttgccagataatgccggaattgttcaaatatactcatagcgatttcaattcctccatgacagccttatcgatctgcgcccgcacttcattaaatccgcgcttcaagaactcttttttcgcggttgccctgcggaagttttgcttaaccttggggtcatgaacataaacggcgtagtttgcagaatatcccacccgccccgttaaccgtgttccctgaaagcgaacatcacggaactgagagttaatgagggtggcagtatcaatcggcgtataaagagcagcctgagcgctcccgatatacagcgccttatgcatggcacgaaccaccttacgccctctaatatcgccgatgagtgcattaagtctggtttgcgcctcacgaatgccggtgactttcacgcccatatcacacccccgtcactaatgcgtaatcatccgccatgcgttcaaatgtgtcggcatagcgcacgatgtgcttgagttcgtcagcccctgccgcgataggattcagattagatgactcgccaatcaggatataatcccctatagaggcatcagcaaactcagtccagaatgtgtttttggcaacaagttcagcaccaaccccagatattttgctggacaatccaccttgataatcacacaagatgatttgtggctcagcataaccaagaggtttaccatactcatcattttctagccgcttccagaaggtacaaggggcggtataagcccagttagcaacactgctcatgttcaccccactacatcaaagaagccgactgatttactttccagcggcaaaccggacaggcagccttgtttatcccagatcctgatttgtttcagcaaataatccgtgccggctgaatcgtaattgaatgaacgcgaaccaccggagggcgaaccctgtgaggcaatttttctcgcaccggacagggaagccagacggacagcggcatagataagcaggagtttttgcaggttgtcctcataaccctgagccgtcatacactccgaggttacattcacctgctccaagagcaattccagtacagaatcaggcaatgtgaaacccaactcggcgatcatcggcttaatgtcactcagtgttatcaccatcttttttcgcctttctggccgcttccgcaagagctttctctgcatcatcagctcgttttttttcagccgccaatacttctgtgagttccgtttcttttgccttagcggcctcaatcatggctagcatcttagcgttagcgtcatccagttcagcttgtagttctgaatcttcagaaaaattcatggttgcaggtgtcgctacttcaaatactaatttctccccctttttatctttagaagcttctgctttgccagcgtcaatccacttaacagcaatactgtcattaatctcataggtgtggccaacctccaacttctgaaggttggcaccggcaaaaagatttgttaccaaaatttttacgagtgccatatatcccccttacttgcctttggcgtggatgactgagaagtgtccgttaatatcctgcttaaccatcagaccagcagccccccatgtgcgccatacatagtcggagttatagaactggcgtggatccgcaaccgtgccgaaagcctgtccaacaatcggtgcgataacacctgcgcccagtggaatgatcatcatttcattgcctttcagctcaaagtcttctttgatgccagcaatgcccgtgattttcttaatttcctcaagaacagtgcgggtctggttaacgtcgtagtacagtttttcccagttagacaggacgtcacctgatacataccaagtctgtgccccgtactggtagttttgtaatttcagcacgtcacgcactttcataacttcactacgcattgcttgaccatctgtgctcgtggtgtgatcgacgtttagcgtgacttgtgcgatacgctcatcagcgcgtaagcctttccacgttttatcatcaaacttaatgaaattaccttcactgtcgcggaaaccattccagataaagtcgagatacttacgacgaacaacttttacagagtcggcctgtgcatcagacaatgaagccagcgcagagcctttgttaaataccggatcgcgccaattgaacttaaagcccgtatcgtgaattggcaccatcgtaccgtcaaagctgtaagaacgtgcatccagagctgcaccaatctgaccagacattgacgtatgtgcccaaccagtgccgccagtacgagcatattcatacactgattcttctaaacgcactgagcgagataatcccaccagatcatttaacagagtgaattcagtgttaggctcaaactctgccagcacagtctggtcatacgcacgatacaggcgcttgatatcatcgatagcattaaccgcatcaaggcgcggagcatcctcaccacggaagcgagcgcgagaaataaaagccgctaccgcctgagcagatgaattacgggctaacgtcagctcgccaaactgagcttgattagcctcaaggttgccggtttcggttgcccgtttagttgaaaaataaaacattcagttctccttacttaaacaccacgcgaaccagatcacccgcttttgctgtgatactgtcttcttcgacataggcaaatgcagcaacaccatcaccagccgccgcaatctgaccgttagcagccgtcacaggctgaccctttttatacgttccctcagttgcacgaacgtttaggaatacccccgccatagggtgaatacagatgaccactgaacccgccgtgatagcgtcatccactgtctggcagcggagatagtcgatattggcaacatacaaaatggctgattctttgccgtccacggaggctttgaatttgcctgcctcaaaatacccaatggtgccgggcttcgtatctaccgccgccgcaccttcgcgattcagcatcggattggtaaatacaccacccgcatgaattacatgttttccgtctttagccatttccattactccggcatagatgtgaatgattcagaattgttgtttgtgaatgatgaattcagccctgctgatgtctggcactgggcataaaagccatccagtgctgcaccatccagcgcattaaccgcgatatcgtccagaccaaacttcgcttttaccgcagcacgtttgtcggatttctccttgtctgcgttcgcggtcaactgagattccagcgtggtgattttgtcagtcactggtttcatggctgcatttattgctgcggtaatcgcatcagtatttgttacggcctctttctcttttttcgcgcgcgcggctttttcttccagcgtttctttgtcttttgcttcgtcagcattcatctggttgtatgcatcaagcaattcagcttcggtcttgccgtcagtcgacttacctttcgctttcagggcgttaacaatcatgtctttcatcgggttattagctccgttggttttaatttcgtattcagttggcttacgcacaacttcgacagactctccgacgagttcggctgtaccgtcatcgttcatgagatatttttgctgataggttttaccggatcggtagtagataaatttgtcaggccagacggtttcagggtaaggccagtcatcatttgggtatgcaacttttaactttgctctgagcgctgagtaaatgtcatcgaatgagaagttagaggcattggtgaaaaagaatttcgttttatcaaccactccctcttttgtgcaatttgatgcatcagacagattaacctgctcgacattcagcttttcaccatcagagttgacaaaaatccccaccccctcttttggtgttgcggctcccggttcttcgggtgggagaatggccacatggtcgaactgcatatttcgtgcaatccatgtgtactttttccctcgtgacttcccgccgttctgctcacgctgtagcaatagcccagtggaaatgtgtataggctcagcgcctttgttagcgatcatgtcatccagacgctgtagtaaaacctgccccttttccgtagactccgcataccgacggttaatcttcatgtccatgacaacccgatcaccgtcttttcgtacattctcagcccatgcaccaacatgaaactgattgaccgcacggggaacatccgcagagacatactggccgtcaatgctgggatgtcccaaaggcatctgcttgccttctattgatttgtagctcttgttaatctcaccagccggataaagaccgccgttcatcacaacatcatcaacaacgggtacaacgccacgaatgacaatatgtgcatcaccatcgatagtttcagttgagatattggaggagtttagggctagggatttaacatgaacgctggatagcttcatgtcgtgacctctttgaagtgttactcgatttgttccggttctggtttttgccacgcctgacgttcttctgtcagacgtttagtcagcccggtgttatacagttttccgctatcgtccagaacaacaggctgttgtgcgcagtagcagcgatagcgattaccgttcttggaatagaattcctcagcttcctgttttgtgtagagtttcccatgcctgactgcatgccattgccgtgttgtaggtttcagagcggataaccaaagcaatttggtatttaatcccagccgttctttagcccattcagattcattccaattagcctctcgcaatgcacctacttgctcagtctgggcgatgttcttggcggttcctattgacacattcaagcgtttactgatgatagcggcaatctctctcggattgacgccgcgagcaatagcctcagctatcacatgagaaagatcagcccgtgccgcatcagaaacgcccttccaatcgctgtaggttgatataaaagctgccgccacctgattttgataggctggcgttgataacaaggctgagagtgtggttttctgtgcgtagatttctgactgtgcggatagattggtataggcgtttaatgttcctcgctgatactcatccgctacataactaaaagcccatagctgatctttcccaccagcaagcaaaaaatcatccagaattatttgcactatctccagcagatcagccagttgctgggctgtcatgtcatagatatacgttccggcattgactcggtaaagcgtgtcaggctttaccgcattttgggtgagtatgtatccatagagtgaattaacactacgctctcggccaaccaatctttcattaaatagttgtttcagcgccaccttgatgccgtaataccgctgttcgatatcacgaaacatcttgttaacggggcggtatgattgcgtggggtcacgcttattccttggtattatcggggttccaattttggtctgggtcatcagttaacggatctccggttgcgccctgtggctctggctcttcttccaacggctccatctcgcctacagtacggacttcattaggagtaaacgcgggtgtcccaaaagcctgttgtgtcttaagtgcagcctcagccatcttaatcatattgtcgatcttctcctgctcactggcggcgagcatgtcagaccatgcaatagtgacctcaccggaagaaggtggttcgataatgccgatttcccacaaccgcgttatcaattgcgtcacatattgggttagaaaaccccatcggcgaccattcaaccgaaccttccaagtggcatcatctttatcaccggctaactttccggtctgagtgccgaacagcacagtaaacggcacttgcacggaggcgcaaaactcacgggctgtcacttcccatgtgggtgttgggtctcccggagcaacagacaggacattcaaccgccccgcttgcatcactgccgctgagtcagtccctctgttgagcttgctgattttatcttccagtgccgcgccgaggtctttgtagccagcttgaattgccgccgtggtgatactattcatatcagtttctttttcaaactccaccccgatctgacgagaagcgtttttcaaaaaaccctcggaactaccaccagataccttttcgatatccagcaatttgttataccccgccctgagcaacggcgtgccggagaaaatatccccactttcggcaccttcgcacaaagtaatcacccgtgatggatgaatgagaagttgtttcgctgggccttgcatctcaacctgacccacgggacgttcatcaaaattgaacatctttggctgcccataggtatctgaatgaatatcctgatcccactcggcaacagtcaattgaggctcccagacggggattaggttaactactgcatcaacttttagtcgtgataccacagtaacatcaacaggctcactccagtttttgctatccctaacctgaataagcagcgctgagtagttaccaatcatattgcggcgatcagcatctttgattttcgcccagaacggctttagcagctttgtaactttcgtttcccatgcgctggttacgtctgactctttcttttcctcgccatcaataatggtcggattgtcctgccaacacccgtccagcaaacgatgcacggcggcatgagctacagcattacgctcatagacgttatagtactctttgaatctgagctgctcgggataaccgaactcagaataaatattggttcgttttgtattgccgctaatcccacccgacgcatagagcatccgcttggcgatcgtgtcaaccagactattaacgagcaattcttgtttttcactcacagcctctccttaaaagaaaaatgcgcccacagccttacggttgttcttggcaacagcaaaatacctgaacccgtccgcaccatgtgatgtgaagtcatgaagtggcttatctttccagcaaccgcgcttgtcatcccattccttgcggtagctttccagatgagatatcccctcactacactcttcatcaaatacacaactggacaggatttcacgcaccgattctatgccagtatccacgccaacctttggcacaaccttgaagatcattgagtatttctgaccgtcgatttcgtacccttcgcgcgccagttctcgtcgagacttggcatcagcgccaaactcacggttatcgatatcatgtggcccccaatgatcaccatagatatagcctttatccttcaataccttcatgtaatgccgtaaaccctcaccggagttttcgtaatagtcgatgacgtggaactcttcccccacttcacgtacgaaccagatcgccgtcgaatcacccaccccgatatcccagaaggtatgtactggtaggtgtgaattatccggtaattttccgatgcgtttgttctcatatagccagcggaactgcttggcgtagtacgcaccttctactgattgctggaatgcctcggacgggatggatggatattcccgcttcatgtcatcgccgagtgtcttctctttggcgagataccatgccttttgacgttcatttaactgaatgccgtgtttgcctgataattcagcgaagtagtcaaccaggcgctgaggccatgcctctactgggtctattgcgtattgcggattcttccaccacgagaaaaagaaaaacttccaatcgaggttagatagctgcttaccctgtagttgtgctttctctgccgtctggcagtagtcaaagaagtatcccgctctcccttccgccgtactctcaatcgtcgtgaaacaatctgtcgataccgcttcaaaagcaccggtgacaatttctctggctttgtgggggaacttggcgcatatcttcccgaattcagagacatgcagataacgcaatgtgccaccacggaaagaggttgatacgtacagcgagccgcccttgcgaaagactaattcacccgctgcgtcattactggcaggattggcggctttaatctcatccggcaattggtcataggcgtacttaaccttctcacggaatagtcgctttgcgtcattcagggtgtgggcaatcagggcgcatttggcagattcgaatagggcagcgtcaagctggataatgcatacctcagttgtgaaaccgagctgacgggctttcaggataatattacgggtatggatgccctcgaaatactccagctgctctggtgtcatcttaaatctgacggggcgaccttctttgtccgtaatccagtagagatgattcagccgccagagtttatcgcgcagtaacgctaaatgttctggcttcatgattaccccttagagagttcgtccatcatatcggatagcttaccgacaacatcatgttcattcttgacctgatcacggaatgcctgaacgctgatgtgcttgcctaacagctctaggttcttcactttatccggccacttgattttcttgagtaacgctgtggtatcttgtgaacccatctcaaccacttccataccggatagagtggtacgccagactttaggccagtcttttaccggtttcagttcaccgccatcagtaagaatgtcgagtacgtccatctggtcaatttcgaccaaccgctttaatacgtaggtggcattaaccccgacctcttcattgcgaccggctttcagttctgcaattcgcgactgaatatcaggttttgacaggttttcagacgcagtgcggttagcagtcctttcgctgtaccccgcacgaatggccgcttgtgtggcgttcaaatcaacgaggtactcgcgacaaaacatttcttgtttgtcggtgagtgccatttctttttcctctataaagcaaaaaaccctccgaagagggctgaattatcgtgcattaaatatcaatttggagctgaactatacttttcaatcattgggtcttcttgaatatgatattcacctatatctataaggcctaacgattcggaatctttgcaggactttttattgataattttatcgcctttataaacaacaagccctgaaaaatcccaatatttacttccccctgcatagacgacatagctgtaatcaccatttttaaatctgacataagttgatgacccacccataagcagctgataaccgtaaaatacatttttactatcattcaattttaccggtaaagtaatttcagttttagataatgttccatatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgtggcggtgtatccgcatcaaatttatgcggggcacccattgggttcttgtggctgaaaccttgacggggaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtataggccaaacgtcacctttcaagatgatgaatatgtactcattttttgaaggaaatcctacattaccagaaaaaaacccacaagatatattggacacacacttttatattgtagtcgttggagattttgaaagtgcttatgacatagatataaaccataaaaaatggtggagcaaagtactgcaatatttccattaaaaagaatggcgatttatatcgccattcttatgtatttaccttccttgaatctaaaatgctgcgctactgcggtatactttagctaatgaaattaatatttacatgttagaccactgactactggccttaaacagcataccaataccggtagtagggtatgtaatgcccgtgccgtgggttgtgagaacgactttaatggtcggcgttgtattggcggggatggttatagggggtgtaaacaacgtgccggaaatacactgcgggacgctatcagaagactccatgaaaaagttttgcccagccacatgcgcattattaacgtataccgaaacggatgcctcccccgaaccacccaaagatccgacgtaacgctgagtcattatcgatccataaataaaaacccgatcaaacggcatagattccgttagtcttttatgaaaaaaaatgctgtcacggttgcctaatgatacattccccaacgtaacagacacaacgtcacccacaattttggtcgcatatactgcgccggaaaaatagccatcagcgccctttattgttccggtgaacgtgccactggttgcatgtatctccccgcgaacaataacatggttgaattctgccgagccgcctttgtcaattttccaccctgcccgacccgtgatataatttctggattggatgtaattgccaattttggcattggtaatactgccatcttctataaatccatcccgaataaacaactgaccatttttagctgccacaaagggttcgaatttgttatttgcgggattgacgaaggtaaaattattggcattaaaaccaatatccgttctcacttgaccattcaccatctgagcaccaataaccatccccgctccgtgataatttccgctggcatctttgatacccactttaatgtcccatgttgccaatgcggtgacttctttcaggtcaaaaaccgtctgtatggtatactataccgctgcccagctcttatcggccgttgccttgaccgtatcaatcttttcagccaacgattttgtctcagtcacagtgaagttccgaaccttgacaatttccgatttcatttccccgttctggcgcataaagtattgactgttgccattcgcggcggcggaattaatcaacattccttcaatgttggtatcaatctgctcctgcaactgctggcctgctgtgttggaaaggaactcattaccagccgcatcaatgatccagttcgcatccgaagacgactccccacgagtgaacgccgtccacggggattgattaggacatccagcagttcgaggggttttatatctgctattggcctattaccaatataaggaaagacgtcattttcaaagcactcatcatgtcagcgcgataccctgctgaccacctatccttacgtttttcgtaccattcacgagtaattttttcaaaagtattttcagacatgatgacactctccctcttcttctgctttctattttcagaaggattaatgccatcagcaatcatagaacggcaccctgctgtccttttccttgcctctgctaaaggtacttcaggataagtgcctaaagataacatcttctgcttaccttcaaagcgataacggaatcgccagcctctagatccgttcggttctatcaataaccaaagcccatttccatcagatagcgtataagattttgcttctggcttggctctcttgattgccacgtctgttagcttcatcatttcacccgtgtgtataggaagatgtgtataggaaaaactatacacaaaactatgcacaatttcatgtcgctttcaggagatgttaggagacttggagttatcgttatctattgatttttctatgaaaagaagactttaggagacgttgcgagagggaggagagaacaatacacaacacctattataatgataaataataactaattaaattctaattttcattctatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggtagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtatagtcataatggcaaaccattcaaaacgcggtgtatagaatgtcggtaatgcaaaccacggtgcctcaagtacaggagtaaaatccactgctcccataaaaaacgccagcgcatagcctgctaaaacaccaatcaagattggaataatcgccataaagccacggaacatcaccgaacccaaaattgtcacggctaatgttaccatcgatatagtcaggttagccgtattgacttcagctccaatggctacgcgcaaaccagccatatctgctgcaacccctgccagctccagaccaatgacagcaacaattgctcccattgccgctggcggaaaaatcacattgatccaaccccgtcctgcaattttgacaatcaacgaaaccagacaaaacaacagtccacaaacaataaatccacccagagccagctcatatcccagaggcaacaacaaaagtaccggcgaaataaatgcaaaacttgagcctaaataagccggaattttccctttacaaataaacagatacagtaatgttggcagtgtcgcgttaacggcggcaagttagcaaaagtggtgttgccggttatttaggccgccagcaaatagaattgttccgcgggtgataatccatcactttgtggatgttgatattgccctttgcgtatcatgtgaatcagttcgatgccggccaggagcgtctgtgcccggcgaaacgatttgaaccccagcatctgtcgtatccgacgtttgatattgcggtgatcttgctcaaccagattattcaggtatttattttgccggatttcaatcccctgctgaggcgatccttccgcattgaggagagtgagcgcggcagtattggccccacttttatcgatagtcacaacggcgggtctgccgtgcaggcgtatcgctttacggaaaaaacgctgggcagccattgcatcgcggcgagcggtcagcaggaagtcaaccgtctgaccgtcggtatcgaccgcccggtaaaggtatttccactgacctttcactttgatatacgtttcatccattcgccaccgggagccaacgggctttttgcgaggtcggaaagccttgccgagcaggggcaccagacgtaacacccaacgatgtattgtggcatggtcgacctcaatgccgcgctctgccatcatctcttcgagattgcgcagactcaaggcataagcgaggtaccaacggacacattgggccatgatatcgacaggataatggaggcgtttaaacgcgtttcggatcagggacatcactctggactcgctcaaaaacaggggagcttacctgatgaccgcttaatgcgacagaaccttatttatatcctctatgttactttgctagaaaccaaaaaaagccggcttttcagccggctaaatgttatttagtaccaaatattttatcgcccgcatctcccagaccaggaacaatatatccatgctcattcagacattcgtcaatcgaggcagtaaacagttcgacatcaggatgaaccttcgccagtgcggcaaccccttctggtgcggcaaccaaaaccaataccttaatcacaggacatcctgcctttttcagcagatcaatcgtggcaatcatagaaccgccggtcgccagcatcggatcaacaaccaaagccatgcgctcactaatatcagaaaccagtttctgaaaataaggcacaggttcgaacgtttcttcgtcacgataaacaccgacaacactgatccgagcacttggaatattttccaatacaccatccatcatgcccaaaccggcacgcaggataggaaccacagtaattttcttccctttaatctggtctatttctaccggaccacaccatccttcaatggtcactttttctacttctaaatcagcagttgcttcatatgtcagaaggctacccacttctgaggccagttcacgaaagcgcttagtgcttatatcatgagctcgcatcaggccgagtttatgtttaactagtgggtgttgaacttcaacgatcttcatgcgtttctcctactgtatatagccggcagataaaaaaaaatattcaaatattacgctaagttcccgctatagcttgctattatgctgaatttactgaattgttgtttttgctgattttcgtgcatttaaagaagttttaagctatttttggattatcagcacccctcatagcaccccgttgctttgcaaaaatttaaacaaggagaacatcacaggtggcctattatagcattgaaaaaggcagtgtcgcgttaacggcggcaagttagcaaaagtggtgttgccggttatttaggccgccagcaaatagaattgttccgcgggtgataatccatcactttgtggatgttgatattgccctttgcgtatcatgtgaatcagttcgatgccggccaggagcgtctgtgcccggcgaaacgatttgaaccccagcatctgtggttctgtcgcattaagcggtcatcaggtaagctcccctgtttttgagcgagtccagagtgatgtccctgatccgaaacgcgtttaaacgcctccattatcctgtcgatatcatggcccaatgtgtccgttggtacctcgcttatgccttgagtctgcgcaatctcgaagagatgatggcagagcgcggcattgaggtcgaccatgccacaatacatcgttgggtgttacgtctggtgcccctgctcggcaaggctttccgacctcgcaaaaagcccgttggctcccggtggcgaatggatgaaacgtatatcaaagtgaaaggtcagtggaaatacctttaccgggcggtcgataccgacggtcagacggttgacttcctgctgaccgctcgccgcgatgcaatggctgcccagcgttttttccgtaaagcgatacgcctgcacggcagacccgccgttgtgactatcgataaaagtggggccaatactgccgcgctcactctcctcaatgcggaaggatcgcctcagcaggggattgaaatccggcaaaataaatacctgaataatctggttgagcaagatcaccgcaatatcaaacgtcggatacgacagatgctggggttcaaatcgtttcgccgggcacagacgctcctggccggcatcgaactgattcacatgatacgcaaagggcaatatcaacatccacaaagtgatggattatcacccgcggaacaattctatttgctggcggcctaaataaccggcaacaccacttttgctaacttgccgccgttaacgcgacactgccataaatctcatgatcgcacggctgggattgcaggaaatatgctggagccacgtgaagtgggtattggagcgaaagtgagtttctaaaaatcagcattaaccgcgctgatctgtcaattgagtaaggttagcgcaccccgttaacgatgggggaggcgtaggggcgactaatcggccgcgcctcctgcctccatctcattacgtgtgggacttattatctgaattcacgacctgccaattttgattaataatttattggcctgaatttgtcacgataggttctattaatagcagcttggttaattctttggacgaaggcttactttcttctcctttcggcaccacaaaaaactcaccttgctttattattacatgatcatctttaaaatcgatgcgaagttcaccttcaataaccatgaataccttgtcttcatctttatgggtgtgccatataaaatcaccgtctgcgagtaatataattatcttatattcgtttgtttgagttattaccttcggtgaccatacttctttgattaaatcaaattcttgttttaaattttttacttttctcaatgcagtcatctggctcatgttatatacctttcctttagtgagtttttggtttgagtttttaatgcttaccaattatctggaattatagtcttcgaaatccattggagatagacatatgggttatcaggcaccgagagtggcaccgccatcaataacaatatcctgcaacgtcatgtgacttgcttgttcggaggctaaaaacagaatgacgctggctatttcgtcgggatgggcgattttcccgagtggaatgcccagcttaaattgttcggtaacgccatgaatcaaacgctggtgcgcgatatcatcatcgaacattccttccagcattggggttaacgtggaacccggcgaaacaatgttacatcgtatcccaaaaggagccagttcaagccctacactcaggcacaggctccgcattgctgctttagaagcgcagtaaacggccatattaacgcgtggtacatgggcggcgttggaggcgatcgaaacgatattaccgctgcgctgacgctggaaatgtggaattaatatcttaaacagattgaatgctgcacccgcattaacgttgattgagctttcccagtcttcacgacttaatgtttctgctgaaccaaggcgcaaaattccggcaccgtttaccagtatatccagcccgttttcctttagcagtggcgggcagattttttgtaccgcacaatcgtcactgacatccagaatcagcgtctcaaacggcattgaatcagggaatttcagatcgaatccaaacaccttagcgcctgcctcgtgaaagcggagtgctgtgcggtaaccgataccgctcccggctcctgtcacccagacggtttttcccttaaagctgttcatttcgcctccaaatcgccgttcagtaatgtgagccaattgcgcaatgtgggttgtttcatcaacgaggtaaaatcaagatcgtacccttcctgccggcgttttgagacgaaagacatcatgcgtagcgagtctaagccataatcaagcaagttttcatcatcaccaatgtcgtgtacatcttcgtccagtgtagactgtaacagggtaagcaaccgttctcgatcccattgactttctgctgtggaagaatcgagcgccgacagcaccatatcggtactcaacacttgaccggaacagcctgcagtatagcgtagtgccatcatatgctcttctcggctgaagtctgccagcgcattgcttatcataaaagcctgtatatcgcgcataaaggcgtcagtggcagtggttaggcagccgatatgggcatacacgccgcagatcatcagctgatcacgcttgtgttctttcagctgagtctccaaatcagagcgctgaaatgcgctgtagcgccacttcaccagcacattatcctgttgctcgggggacagtgctgccacgattttttgctgttctgggtagttgttcagccccggtccccacatatcatttagtaacgctcgttcgacgtcactctgttgggtcggctgagctgtataaaacactgggataccaagtgcatggcaacgggcgcgcagaataacaatgttgtcgataacttgctgaaccattttgctttcttttccccagaagttgaggaaatattcctgcatatcgtgaatcagcagagcagcacgctgcggctctaacgtccattccactttatttgcaggtaaggtggcctcatcgggcagggtatagtcctgaagtttaggaatgctcatggcgtatttcctcaattttctaaggcggcgctggcaagtgtacgcaacgcctgtttattgatttttcctaccggggtgagcggtagtgtaggcagattttcgaaacgatcgggaattttgtagtcggctataccttgttcgcgcaaccagcgacggaatacggctggctttacagcttcgtgttcgcgtgttaccacatatgcgcaagttttctcacccatcagacagtcaggaatagcgaccaatgcggcgtataccaccgctgggtggcgcagcagaagatgttcaacctcttcagccgcaattttttcgccgccacgatttatttgatctttttcacgtccgacgactttgaggtatccgccgggaagctgaatgacgacgtcaccagagcaataaaacccatcgctgtcgaacacggtttggttatgttctgggctgcggtaatagccccgaaaagtgtatggacctctggtcattaacaatcctggctctccgagcggcactgggagaccttcttggtttgctacccacacctcatcatcttcgctgatggggcgaccctgagttgtgaaggtatgtgtgtcgtcatcatctagtcgggtgtagttcaccagaccttccgccataccaaatacctgttggagctggcaccctagctcttttgggatgcgtctggccagtgcttctcccagaggagcaccgccgaccagcatcacctccagactggagagttcgttgatgtgaccgatgagattggcatactccagccagatgctgacagcaggtggcaccagggcaacaagattgatctgatgatgtgcgatagcaggaaaacatccatctggactaggatcgggaacgaggacaacctgaccacccgcatagaatacgcccagagctcccggtgaactcataggatagttatgtgcagccggcagtgcacagagatatcgggtcttactgcttacgttgcagatcggattactggcgcggatgctgtaatagtagtcgttgtgggtacgtggaatcagcttgggtgtgccagtgctgccgccggaaagctggaaaaatgcgacctcatctgccggcgttggtgttggcgtgaagtctcccggttcttccgatatcaggcgtgcaagcgaatggtctgaatctgaattcgcatggtgaagcaccactatattcagttctggacactgatctattagaagatcaataagaacatcatcatgaaactggcgatgttggcgatcggcaatgagtatgcttggcataatttggcgtgcatacgcggttaattcgctgctttggtggctataaagcgcgttgacaggtgcgacacctaggcgcagtaaggcaaaaaagacgatataaaactcagcctcgttgccaagctgaaccagtgcagtttgtccctgacgcacgccgcgtcggtgcagagaggcggctaatcggtttactgcctcattcagctcccgatagctccagctctgctcaccgcaaaatagtgctgtggtatcgttctcgcggtgaatatcaagaatctcgctcaatggacgatcaatccagtaccctttcaggcgatagagtgcagccagatcctgaggccaacggttgaattcaatcataatgtctgctcctgttgcatcgcaaaaccaagtgcgttcagcatggtgttaaatttggtatgggtttccatccattcgttttccggaacagagtccggaacgatgccggcgccggcgaatagctcaatctgatggggccgcactttaccgcagcggatcgccactacccattccccgtttccgcgggcgtcgcaccagccgacgataccgccaaaccagccgcgatcgaagggttccagcgcgccgatcaaattgcgggatgaggtataaggagcgccgcataatgcgggcgtgggatgaagtaggcaggcaagcgatagagcactatcgcgatcattggccaatataccctgaatctcagtagcgagatgccagagcgtgggcgtgctgaacagcgaaggttcagggatcgtcagagactggcaaagatccgtcagttggcgacggatagcctccgtgaccacccgatgttcatggcgatcttttccggagaccaacagcttttctttggcatttcggtcactggcggtattgtcgcctcgccgcactgagcctgcaaggggacaggagcgcaagacattaccctctttgcgtagcagcaattcagggctagcaccaatcagcgtgccatctgccagcggtaagtgaaagttgtagctctctggattctgtctgttgagctgcagccacagattcagtgcgctaagcggggggatgctttcaatctgtagcagacgcgacagcacaactttatcgagctctccaatgcgtagaggactcagcgcgctctccaccatggcgcaaaacgcatcgtgatctggaatgtagtgaaagaggtggactacgacttcagcgttgcggttagataagcctaaatagttggtgaaggtactactagtgtcaatcaatgcgtcggatacggaggttgcgcttgcaagcgccatctggttacgcgtaacgacgaaaattgtctgccgtattttgaaaagcggaattgccgttttggtgcctggtgcactcctctttgctacgattccttgcattaatactattacgtttttcagcttcgcggttatcactctcatgatgccaatcccgtgctagccgcatacgcctcatcagataacgtgggtattgaaaacagtaccacctgaaacccaaatccggtgcatctggagatgattttcaccacaagtttttttcttatcttaaacataatcaaacaccgtctgatttgccttataaaaataatttaataaccatcaatgaatttgtactgcttacaggcggcgctggaaacaaaatgttcgtcataaagaggtatgagctcttgaggaagaaaacactattacaatattttagatgtaaatgattatcaatataattagcgttattggtattaataattttcttgtaaaaacggttctgtcgcattaaggagaagtgaggtaaaatagcgacttttactctgtggttgtggtttcatcatttctttaatttgaaaagccttcaaacgtctacgctatcctaccgatattatcgttcaatgtgtccgtaggtacttagcttatgaaagcataaaaatccttggtgcactcatgcagcaataatctctgccaaatagtgatctgtttctttgcttaatttgatccccggataccagtgctcaaatcgcgtttttaaatcattattgagtaccgctgttcgcgtctggagtagataatgtgcaccttgttgactccattgcatttgctgttttttcaccatgcgcttagtactacagccgtaaacactatttatcgataggaaatccgccataaaaagattgaaattgcatagtttcttaatttagcgattatcagataacacgttgatttgtactacagccgtaatccatattgtgccatgatagggctcttcttccttaaatcaaaggcggtgttacatgtcatcctctgccaaaatctgggaacaggcgctacaggcatgacatgcccgtctgactcccttatttcactctatcggcccacgacaacgcagcctcgcctatcttcgggggattgctcagtgatgttgaacgtaagaatagctggcaactggctgaatggatgggggaaagtactcccgatggcattcaattgggcgatgaacagggggttctcatccaaggcaatcgcatctaaatttgatgcgctttgcccagtactgtaagtagatattcaccatcccaaccagcccgtttacggcgtgctttaattcccgctttggtgggagctaagcgcagtaaattcaacgcgattttattgagtaatgccatattggcggctgcattgccttcccgcatccgctgctgatcttcattaaaagcaatatccagacaccaatggagttgcgtttctatttgccagtgactgcggatcgctgtcgctgcccgttgagcctctgtcggacgtaaagtgctgataaaataacagctctcccggctcacttcatttcctacatagcgttcgcggatcacccgtattatgctgtgtaaaccacaccagcacgccttttccggcaaccaatcaacatgggtcatttgtactgtgcgtcgctcaatgcggccatgtccggcatccacgtcttcatattcgctcaggcgctccggttgggatgagacataatcgaaataatggctgacatcattatacgggccgggatgattttctttcaggctcagtacgtaatccgcgcccgcttcatgtaattgatgagcaatcgctttctggcatcccatggcatcgatagtcaccagacttccagacaaaaccaatcgtcgaagtaactcaggaatagcggtgatttcattggatttactctccactttcacttgtcccagaactaagcgattggtacaggcaaaggcgctgaccagatggattgccgccttgccgttggctttatcgagtgaccggcgcatggttttgccatcaatagcgatgataccctgatcaactccttgtgccagcgtagatatccaggaggtgaaacagtcggcaaaagcctgcgcatcaagtgcagcaaagacacgaccaaaggtatcgtgagaggggatgccattagtgagatcaagcagttgggtaaagaaatcctgtttagattcgccaaactcttcaatttcgacccaaccttcagcgccacaaatcacagcgcagatggcgatagtcaggatattttccaaactatgcaactgagttcgttgaactcggggatcttcaagtgaggcaaaatgctgtaacaaagggctgacagaggacataaggatggatttaaaagctgcataacgacatgaaattaaaccattgtcaatgaattttagatgcgattgccctggcacctgaactaggtcacgtattcatcccgttgtttctcacgtataatgagggtaaatacgtgagggatagtgatggcattagttgaagtgaagtgtcggttttgtggccaaaccacgcctgttaaaaaacacggtaaaggagaaggtgggcatcaacgatattattgccagtcctgtcgtagaaccttccagctcgaatacacttaccgggcttgccattcgggtatgaaagagcaaatcgtcgagcttgccatgaataacgccggtattcgtgatacggcacgggcacttcatgtcagcattaacgctgttgtacgcactttaaaaaactcgcgccgcgatgtgtaaccacgctgccgctggatacccctgagcttcagcttatctgtgaagtcgatgaaatggggtcattcatcagtaacaaaaaacggcaacgctggctgtggtacgcgtgggagcctcgcttgaaacgtattgtcgctcacgcttttggcgctcgtagcaaacagacactcaggacgttgctggaaaagttatccgcttttgatgtggcattctggtgcaccgataatttcggggcatatgacatattggctgatgagaaacatatcaccggtaaactttatactcaacgtattgaacgagaaaatctgaacctgcgtaacaggctaaagcgactcaatcgcaagatgctgggttattctaagtcagttgaaatgaatgacaagatcattggcacattcatcgaacgtgagttctattattgatggccaatcaacaggttgaatacacgacccctgaactatgttgatgagcccgaacaatactgccatcaatgaacaaccattctgtatctgtattctcagataataatttgaataataaattaaaaatagctttcttagacccatcattaaagcgcttaaaaatggtgttccatttgccaaattcagtggggacatctcgccagggacagcctgttcgcatccggtaaaggatcccctcgaaagtcagataatgttcttctttgtgatatacatatccactttgttgcatcaatacagctagcttattccataaaggttttgataacattgttcttggtatgatggtctggggtaatggttttttcgcgaagacaatgataccagagcatcatgctgttcaaattcccctcataaaacgtcaacagcccctaatctggtcaatatgatcatgaattagcaatattttattgaatgtaaataatatgactaacatattaaattttaagttattattctgctgtgtattggtcggtgtaaaaaccatcagtcaaagttttttgcagggaacaaaaattcatgagctatgttgatcctactttacttattttgttagtgctggcaggccttggcattatcagccataacatgacagtaacgcttgctatgctgtttttgctgatagtccgtattacaccactgaatcactttttcccttgggtggaaaagtatggcttgacgataggtatcctgattctcaccatcggagtcatggcacctatcgcaagtgggaaaatttctgcgcaggacatattcagttcattcctgaattggaagtcgctgctcgctatcgctgtcggcattatcgtatcgtggctgggaagccgtggtgttgccttgatgtcgagtcagccatctacagtggcggggttattggttggtactgtattgggcgtagcgttgttcaagggcgttcccgtcggcccgctgattgcagcgggtattttatctatcatgattggtaaaccatgaccatgttagattcgatctggaaaaagttgcaggagcaaatgcagcagcaagggcagcgccgcttggtggttttaagtggtgatgtcctgtggagcgagcagattgtcaatcagctgaaaaaacagtttcagggggattgggtaacagtcgcatctggagacgagggtgtgattgagccagtaaaagcgtgtagtttgcttgggcgcgaatttatgcatggggtttttgatgtcacccgtggttttaatgccgaagcgctggcgattctggctggtacgctaaaaacaggaagctggctggtgatgcgtgtacccacttggtcacaatggccagcacagccagatgaagacagttcgcgttggaacgagtcggctggcgtgatctctacaccttattttatccaacatattcaacagcaaatcctagggtttcccgatatcctgctatggcaacagggaaaaccctttcagccaatgcaattaccacaaaccgcatcgtggcagatgcctgatggtaatcctactgccagccagcaggctattcttgagcaattactacgggcttcacagggagtttgggtggtcactgcgccccgaggacgcggaaaatctgccttggccggaatgctcatacagcaatggcaggggaagtgttggctatgtgcacctgcaaaaatcacaacagaagttattcggtattattccgggacttccgatcctgagcagggttctcccgttgataaaaccccattctgggcggtagacaatttattgaaatattgtcgattgaaaaataatcgggaaggacatgatattgatgcagactggcttctgattgacgaagccgcggcgatcccaaccccgcagttagccgaattaatccgatattttccacgagtgttattaacgacaacggtacagggctatgaaggaaccgggcgtggatttttgctgaagttgtgtgccacattgcctgattgccatgttagagaactggaaacaccgatgcgctgggctgaaaatgatccactggaaacatggttagatagcacactgttatttgatgaaaaatcgttgtctggtaagccattggtttattccgaacctgagaaaaatttgcacttttatcccatcactcaggcaatgtggttgcgacaacctgaattactgcgtcagttttatggactgttgacgagtgctcactaccgcacatctcctcttgatttgcgccgtttgctggatggtaacggaatgacttttctggccgctacatctcgttccgctgtgaataatcaacaattgatcggcgcgttatggatggtaagtgaaggtgggttgccacagacattggcgcatgaagtgtgggcaggtcgccgtcgtccaaggggaaatctggtggctcagtctctggccgcccatagtggctttccacaggctgcgatgatgcgttcacagcgtgtcagtcgtattgctgtccgggcacaatatcgccgtcgtggcattgctcaacgcttggttgctcaacagtgtcaagaagctcgcacgcaaaagcaggattttctttctgtcagctttggttataccgctgaactttggtcactctggcaaacatgcggctttcgattggtgcggataggaacccatctcgaagcaagcagtggttgctataccgcaatggctattttgccactgagtgagaagggaaaatggctggctgagtccgcacaacagcaactatgtcgtgatgcatactggctggaattactgatcggtttttccttacccattgatcatcatgatgataaccagctcagtgataatgactggcaggaactggcgggttttgcattcgctcatcgtcccctgtctgcgtcttattttgcgttacagcggctattgttggcacttgatctggctttgccagcattaagaaaatatcttcaacaacagatagatattgaacagtgcgcgcgcgatttattcctgagcggacgtaaggcgttgttgaaacgttgtcgggaagaaaccgcaggagcattggcaagcattgatgagatacttgccaatcagtggaaaaattggactatttcttgcggtgtttctgggaacaatcgtcctcatcatcccatttatcattaaaatctcggtgagggggtaattctcgtttgttatctaaaaagcgcttctgatcgacgcggctcagctcttttatcgcattaacaataataccgatgagtagtaacagaataacccaccaataatccatcaaccagtgcatcatgctctcctgagaatattatgaaattagcgcctgctgggattacgcttaatcctgctcggcaattttgacatactttgcaaaaagagaggagaggttggctgataaccaatcaataccagcaatgttgtgatcctgccaggcctttagcagcacttgctcattgaacaaattttctgcttcatgggacaacggccaaaaactgatatgccacggttcatatgctacaccactgctatgtcggttgaatgggcgataaaaatcgtaaatagacatattttcagtcagccagtctgatagtggttcaaaatagccaccgttttcatattcccatggttccagtaacaatttctgaccttgtggcagaaggaatgggtcataaatatccagttcagtaccccagtgatgacggctggctcccggcagagcagaccagcggagaatagcttcgcaaatctctccttcggtcatttttgtaatatcaaggggctggctattgtcatccaataccggacgttgtccccgaaatttttcattccagatagcttgctggcgtgcgaaatcacgaaatgaactggcgggctgtaatttaaagcctgccttggctgcatctctttgcatggcaagaaacgctttggtggcattgaactgtaaacggtgattacccgcgaatgtcaccaagtgatctgttgacagacctgtcaacatttcaggcgtcatcatttgattaattgctccatgatacgttggtaaatcaggctcaatttctgtaaatctgacacgctgataccttcattaactttatggatagtggcgttaataggccctaattccacaacctgcgctcccattttagcaataaaacgcccatccgatgtgccgccactcattgatatctctggtttatatccgcaacactgttcaatggattcaaccacggcatcgaccagttcacctttgcaggtcaaaaaaggctggccggatagccaccagtcaatgtcatatttcagattatgttttttcagcatatcttcaacccgctggcggatttcggtatctgtcaattcagtactgaaacggaaattaaattgaacccacaatttacccggtatgacgttattgctgccggttcccgcttgaatattggcgatttgcatactggtggcggggaaaaattcattgccattgtcccattgggtattgactagttcttgtagaaaaggcagtgaatggtgaatagggttatctgccagctgtggataggcaacatgcccttgaataccgtggatagtcagactggctgtcagggaaccacgacgcccatttttaattatgtcacccagacgttgctggctggaaggttctcctaccagacagtaatccaggcgttcatggcgtgacattaaagtttcgaccaccttgacggtgccatttgtcgcgctggcttcttcatctgaagtaatcaggaaagcgaggcggcccggatggtcaggattatctttgacaaaacgttcagcagcaacaatcatggccgccagagaacctttcatatccgctgccccacggccatacagcatgccatcacgaataacgggatcaaaaggaggggtttgccactcagaagtatcgccggcaggaacgacgtcagtgtgtcctgcgaaagcaaacgttgtgcctgttccgtgataagcccagaaattcagggtatccccgaaaggcattcgttctattgtaaaaccagtatcttgcagacgttgaatgagtatatcctgacatccttggtcatcagggctgacagaaggatgtttgattagctgctgggcaagttcaattactgggcaaatcattatttggcctttatctagtcatgaaagaaaaactgttgatattgttcggctttaaagccgagtaaataattccctgtttctgacaccaatagtgggcgttttatgattgcaggttgttccagcatcaattttttggcagcgtctgtactattaatagctgacttttgatcatcagacaatttgcgccaagttgtaccgcgagtattcaacaggggttcccaaccgacttgttcaataaataactgtagcaattctgaggatagaccatcaacgcgatagtcatgaaactgataggggatctcttggtcttctagccagcgacgcgcttttttcatggtatcgcagtttttgataccgtagagagtgaatgctgtgtgataagtggtatctgacatgatgagatccttagtctggttttacacatccgacataatgcgggaaatttggcattttatccagataacacgacatctttcatgtacgccatctacgtcatttctttagaatggataacaatctgttctgcttatgatcaaattattctgtctgttacattagttaatcatgcaaaataataaattatacaaataacaattgttattaatcatatatgaaactaattggttggtaattgattgacagtttcgttaactcacaatttccccgttggcagacttagggaaattgtgttgcatattgaggacattgatcaaccaaatgtcagactaactctggttttctatgtcttagatagatgatggtagcttctagtcgggagcgggatttaagctttttcaataagttacgggtatgaactttcacagtttcttctgaaataaaaagaaagtcagcgatttctttatttgtcattccttctgagatttcttttaggacatccaattcacgtttggttaattttgataaaggatcaatataaagatgacgggtggataaatattgatagactttttcactgtacaccgcatcgccatttgcggctttttttatcttacttatcagaggagtcagttcaatatcttttaataaataaccatttgccccggcatcaatggcatcataaatatcaccgcgattatctgaatctgagagtaccaaaacataggaatcaagaccttttcggcggagagatttaatcgtatcaattccggaaaggccatggatttttaaatctatcagaataatgtcaggttttatctggcaggcgatatttatagcatcttcaccattgtctgtttcagcagtcacaatgagttcacgttccagttcaatcaacctttttaaaccgtgacgaatgataggatgatcatcgactatcatgactgagtgattatgcatgttctttctcccatatagaaatgcagatttttatatttaataaaacataaaagacaggactctgctttatgttaaattgctgtgtaatttttatagagtatgttgaatcatagataatgagattctgaaaatatatcctgatataaaaatatcgcaaacaggtttatccattcaggcgaaataaaattcactgccataagaaaatgcgtttccttaattgctagtaattttctaaataaagtacgcataatgattttatagattaaatttcgtttttgtaagcttattttaaaagttgtttttagaatacttcattaattaatttagcgggttattaactaattaaagataaaaatacctctttatgagtgctatgagaataatatttatataatattgattaacataagatcatattttgtctgttttttatccttgattcccaatggttcttaacaaaatgttgctgacatcatgatttaaccttctgtaactactatactgggcgggttttcacttcgatatgactcgcaaaggatcagatgatggacgagaaattaaaacaaagtgctcttgattttcatgaattcccacaaccaggaaaaatcaccgttaccccgaccaaaccattagcaacacagcgtgatttggcattggcatattcgccaggcgttgctgcgccttgccttgagatagcaaaagatcccctggcggcttataaatatactgcacgcggcaatcttgtagcggttatctctaacggtactgctgttttgggcttggggaatatcggtgcattagccggcaaacccgtaatggaaggtaaaggcgttctatttaagaaattctctggtattgatgtttttgatattgaagttgatgagtccaatcctgataaattgattgatatcattgctgcattggagccgacttttggtggtattaatcttgaagatatcaaggcaccagaatgtttctatattgagcagaaactccgtgagcggatgaaaattcctgtattccatgatgatcagcacggcacggcgattatctgtacggctgcggtattaaatgggttgcgaattgtcaataaagatatcggcaaagtacgcatggtggtatctggtgcgggtgcagcatccatcgcctgtatgaacctgctggtggctctgggtctgaaacgtgaaaatattaccgtctgtgactcgaagggtgttatctatcgtggtcgcgaagagaatatggaaaagaccaaagccgattatgctatcgaagataatggctgtcgtacgttgatggatgtgatcccagatgccgatattttccttggttgttctgggccgggtgtcctgacaccagagatggtgaagacgatggcgaaagatccgctcatcatggcgttagcgaatccagaaccagaaatcctgccaccactggcaaaagcggtgcgccctgatgccattatctgtacaggtcgttctgattttcctaaccaagttaataacgtactctgctttccattcatcttccgtggcgcactcgatgtcggagcgacaacgattaatgaagagatgaaactcgcctgtgttcacgcgattgcggatttggcattggccgaacaaagccaggaagtggcttcagcctatggcgatcaagatttgttctttggctctgaatatattattccgaagccatttgatccacgcctgattgtcaaaatcgcgcctgccgtggcgaaagctgcgatggattctggtgtcgcaacgcggcctatcgctgatttcggggcatatattgagaaactcaacgagtttgtctataaaaccaacctgtttatgaagccaattttctctcaggcgaaaaaagagaaaaagcgtattgtattggcggaaggggaagatatccgtgtactgcatgccacgcaggaattggtttcccttggattggcattcccagtattgattggtcgcccaagcgtcattgaaatgcgtattaagaagcaaggaatgcacattgaaattggtaaagattttgaagtagtgaataacgaaaatgatccacgttttaaagagtattggcaggaatattaccaactgatgaaacgccgtggtatttctcaggagcaggctcgtcgtacagttattggtaatccgacactgatcggtgcaatcatggtacatcgtggtgaagcagacggcttgatttgtggcaccgtcggcagctacagcgaacattatcaagtagtgaaagatttctttggcttccgtcagggggtacataccgcaggtgcgatgaatgctttgatgttgccgatggggaatacttttattgcagatacttatgtcaatgaagatcctactccagaggaactggctgaaattacattgatggctgccgaaactgtgcgacgttttggtattgaacctaaagttgctttgttatcacgttcaagttttggttcttctgattgtgtttcagcacaaaaaatgcgtaaggtgctggaactggtacaggaagcggctccgtcacttgaaatcgacggtgaaatgcacggggatgcggcactggtggaaaatattcgccgtgacatcatgccggacagtccattaaaaggttcagctaatttgttgatcatgccaaatatggaagctgcgcgtatcagctataacctgctgcgtgtcaccagctccgatggggtaacggttggcccggtattgatgggcgtgtcaaagccggtgcatatcttgacgccgattgcttctgtccgtcgtatcgtgaatatggttgcgttggctgccgttgaagcacaaaccgatccactgtaagttatctttataacccgtcccgatagcagtaatcaggtcgggatgaagaaatcagctaccctgccaagcataggcttaacagggtagttttatttgtaaataattctcattatctatagtatgcggaaaatttatattttgataatgaatacctatgaaagcacctacctgtataaaatcgacttttttagcgtgtgccttcctgtttggcggctgtgtaacaccacagcacgatcctcaaaatggatctcaaagagcgcttcaaaccctttccagtgaattagtgcaatccggcatgttgcttgatatgaagacgggcaaagcgatcacctccgcagaactgcttgagcaactggctgtttatcctcgagtcattgtgggtgaaaagcatgataatccctatcaccatcagatcgagttatggctggttcagcagcttgggcaaaaacgcccccacggttccgtattgctggaaatgattaacccaaaccagcaggaaaaagtgaataaagtcaaaagctggttgcagagcaatccgattgtcagagaggaaagaattaaacaattattggcgtggcagcagggctggccgtgggaattgtatggggaactggtcacggagttgatgaaagcaccttatccgttgctggcggcgaatttggatcgttcggagattgatcaggcatataaaaatcattcccctacggataaagcggcatgggtttctgatgatgttaaaaaattaatcgaagaaacgattaaaaattctcacggtgcggacgtagaggcaaaacacctttctgccatgacgatgattcaacaaatgcgtgatcggcggatggctgagcaattggttaacgcgccatcacccgctttgctatttgcgggcggataccacgcagtaaaagcgatgggagtccctcaacatgtgaaaaaaatagtgccaaatgagcaggttgctgtattcgttatcgcagagcaaggggtttctctgaacaaagaatatgctgattttgtctggtttacccccaaagtgactaaagctataacccaatagttgtaaatatcacaaggatgtgatgacactaataaataaaaatagttttcatttgtatatctaattgattatcattctcttaatttatcattgatattatgtgttataagaaatgttgacgtataccacgtatcaaaccactcacgttggtcacgtgacaaaatcctttctcgctgcgatcactctccatgctttgctggtgggttggttcatttatacacccgagaacattgatattgaggagtttctgcctccgccagcggttatggtggagttgtcattgcagacagaagcgatacacaagatacagaatcaacctattggaattgaacagcaattgtctgttgctagccagcaacaggaaagtcaggttgatgaagtcaacatgccaaaattagacgtaaatgagaatgcccatgttttggtacataaaccaaagaaaaagcagaaagagcaagagatccctaaaaaaacacagcctgttaagcgtgtgaaggcaaaagaacgggaaagtgaaaaatcccgcagtagtgttgcaccaacaaccagtagtgcgacggcagataacatagcctctcgtacagctgcatcttatgaaagtaattccgatgccattgctgatgccaaagctatttggcaggctgaggtcagtgggcatttaaatcgctataagaaatatccgccggatgcccagagaagaaatcgaacagggcgaccgatggtaaaattcacagttaatcagttgggtactgtgattgatagtgaattaatacaacgttcggggacgaactcactcgaccgggaagcaaggctcgtgttggagagggcacaacccttacctttaccacctgacgttattttaaccaatggcagggtgacagttgaactaccgattgatttttatttatctcagtaaaaatacaggatgaatggcatgttacagcataaaacggtattttcacctcaaacaaaaagggtagtgcgcagctttctactaggtggtagtttgctgtgtaacagttttgccactattgcaatggagaaaaatatggtgccacctatggccacaaaacagccacataagatgacgttccacggtgatacccgcgttgacaattattactggctgcgcgatgacactcgtcaggataaagacgttattgattatttgacggctgagaatacgtataccgagcagatgctgaaatcaggccaggaattacgggaaacactgtataacgaaatggctggcagaatgagtaaagaagaccagtcagctccttatacctataatgggtatgtttatcgtaccgtttatgaggcagggaaagattttccgatctatcagcgtaaacctgtcgataattcaaccgactggcaggtgatggttgatggcaatgagcgggcaaaaggccataagttttatcgagtcagtggatttgcggttacgcgggacaacaagcgtatagctgtggcagaagatactcaaggtcgccgcaattatcaggtttcatttaaaaatttagatgatggtgaatggcagaacaatgtcattgaaaacacatctggcaatattgtgtgggcaaatgatggtagtacgctgttttatgtgcgtagagatccacagactctgttgccttatcaattattccgtcatcaatatggcactgatatccaacaggataaaaaaatctatcaggaagatgatgaccgcttttatctgggaatatcagaaagcacctcgcttgactatattctgatctctattaccagcagtacgacctcggaatatcggctgattgatgccaataatcctcaatcagaaactcagattttttccgctcgtcaggctgggcgtgaatatgatctcgatcatttccgtggacaattttatatccgttccaaccatgagcatccattgtttggcttatatcgagcagacgctattaataagccgtggaagacggtgattgcacctcaggaagagactgatctggaaaattttgccctgttcaatcactggctggtagtgcaagagcgtaccaaaggattgtcaacaattcgccagattgattggaaaacccagcaggaaaaacgcgttaagtttgacgaacctgcatatatggcatcgttagactataacccggaacccgatactgatttactgcactatagttattcctccatgactacacccagttcggtattccagtggaatatgcaaacaggtgaacgtgagttactgaaacagcaggaagtgaaagggttcgataaagagaactatgaaagccagcgtatttgggtaaaagcccgcgatggtgtagaagtaccggtttctctggtataccgtaagtcattatttaagaaaggtgaaaatccaatcttgatttacggttatggttcttatggtatcagtatggacccttatttcagctctccgctgctgagtttgctggagcgtggcttcgtgtatgccttggtacatgtgcgtggtggtggtgaattgggtaagaactggtatctgcaaggtaaagtcgaaaacaaaatgaacagtttccatgactttattgatgcgacccaaacattgcttgctgacgggtatggtgacagccagcgcgtatatgccgaaggtggcagcgcaggcggtttattgatgggaacggtgatcaatcaggctccggaactctatcgcggagtgattgcaaaagtcccttttgtggatgctgtgaccacaatgcttgatccatccattccattgacgacgggtgaatatgaagagtggggcaatccaaataacaaagaagattacttccgcattaagtcctatagcccttatgataatgtcaaacatcagcattatcctcatttattggttacgacgggtttgcatgattctcaggtgcaatattgggagcctgcaaaatgggtggctaaattaagggaaataaagcagggggatagtctcttattactggaaacgaatatggataccgggcatggtggaaaaccagggcgttttaatcgcttgaatgatattgcctttgattatagttttcttttaatgttggatgataccaaagtttattttccacaactaaaagactaataaaaaatatatttataacccaaggcgctgataatttgttatcagtgtcatgggtattttatcgccaaatttgcgaagcaatatgagtattcatcagtattattttatttaggatgtgatgttaatgaaaattgtggcaaaaatagcgggagccagtgcaatacttattgggcttcaggggatagctcatgctgaaaatgcgagtgacaataaaaaagaaaaagttatgcgctttagcagcctgaaagtttcaggtgctcaagataataattccccacaggttgaagcaatggaaaaacccggcgcttatagttctgtcggggaagataataagctggaatcgatggacagcgtcctgcgcagcctgccggggacttatactcagatggatgcaagtcagggaactataagtgttaatatccgtgggttaagtggttttggccgcgtcaatatgatggtagatggtgtcagtcagagtttttatggtacttcgccgagtgaatatgggcatggggcgcagccttataaccaatttggtgtgttgcttgatcctaattttattatacgaacagatattgatcgtgggcaatccagtgattctgactcagtcaatgcgttggtgggaagtgctaacttccgtaccattggtgtcgatgatgtcatctttgaagggagtaaactaggagtgcgtactaaatgggcatacggtaacaatggtattggcaaaagtggaatgatggcggttgcaggaaaaatacaaacatttagtccagaaggttcccttggtgcaatgtttgctgttagtgggcacagtattgatgcacattataaaaatgctatgggtgttagtagtaatgaatttggtacaagagattcatttaaacaaaagccaaaatctcaactgatgaaaataaatatcaaacccaatgattttcatgatctggagttaagcgggcgtttttatcacaataaatttaataaacgtaatattgatagttatgactattatttgaaatatcattacacaccatttagtgaattaattgacacaagaattttgctcagtacaggaaatagtattcaagacgttcaaggtggcgctttggctggactaagcagaagtgaatcacgtaataaatctgatgccattgatatcaaaaacaccagtcgatttaattacggtgataccgattttgcgtttacgcttggtagcaaattgatacgtaatgaatatcgcaagagaacgggtattgatttcggtgatgggaaagagtatgtatctacagaagataataacgtattttccccaagcgggaaacagaatactaccagtatttatagcaagttaaaagttgaacacgatatttataccgcagatctgggactaaattatctagattccagcttaaaaggaataaaaccagcttgtgatgagatattagattgttttccacagggaagatcattattgaatataaaatcgcgtggatttaatccgggaattttattatccgcagaaatcatccctgcattccagccatttataagttacgcccattcaatgcgaacaccaaatgcacaggaggttttttattccaatgaagcgggggcttctgtaaatcccttcctgaaaggggagaaagcggatacttatcaaattggttttaatagctatcgcccaaatttaattgtggaaagagatacgttccgcctgaaagcagtatatttccataccaagattaaaaattacattaggagtgaatcttatacactatgtgcaacaggaaaaatctgcaaagatgatggttcattggaattcaaagattaccatgaaagatcgtttaatataatggtttataccaataacttaacaccaactaatatgagtggttacgagctttcggcaaactatgatgctggtatattctacagttcattggcgtatagccagcaaaaaacacaacagccgacttccagagcaacatccgaatttggggcgagtccagcatctcaattgccagaacgttatatcacattggatacgggcgttcgtttattagacgaaaaaattcgtgttggggctatagtgaaatatacgggaaaatcttatcaccaagatcctttaatggaggtggataaaaacaatggtggtcatataaagatggtgaaagatgataagataccaaccattgtcgatttatacacggattatcaggtcaataaaaatatttctgttaaattatccgtacagaacttgaccaatagaaactatgctgatgcattgaaccgtatgaattcctcagcatttatgggagatgatgatgcagtgacccaaactgctcgtggcagaacctacgtaatgggtgcggaagttcgcttctaatagaatagaaatagcggtaggaaatcaccgctatttctattttttgtatctattgtaatttttctctcttggtcggtctttttacttgaatcacctgacttttaacccagccatcctgtaatcgagtgtttagggtatccccaactttcacttgcttagtttccttcagtaaagtgccatccgcagtttcactgatactataaccgcgttgcagcgtcgccagtgggctgactgcattgagctgggagcaggaaaccgcaaatttctcccgataatgtcctaattggcgttcaatcgcttgcttcaaccgaaaatcatattgttggatctgttggctataatgccgaatttgctgctcaggatttgtctgtaagagtcgtagatttagcttctcatgtgaaagaaaatgttgcttcaaacagcgcaggaggctatcgaccagtttttgacgtaattccactaatttattctgctgacgagccagccgcaaatcagggcgctgttgctggagctgatgctgcaacgtattaaaaatacgcagtttttgggcaaaaaagtaatccatcgccatttcgagtcgttgttgcagagattgaacctgcctcaacagctcaatttgattgcgactgactagctcagcggccgcagaaggcgtaggtgcgcgtagatcggctataaaatctgcaattgtgacatcggtctcatgcccaattgcgctaacgataggaatacggctctggaagattgcccgcgctacctgctcatcattgaaacaccacaaatcttccagcgaacctccgccacggccgacaattaaaacatcacactcctgccgatcatttgccagttcaatcgcccgaataatctgtaacggcgcttcagctccctgaaccgcagtgggataaatgataattggcagtgatggatctcggcgtttcaggatatggagaatatcatgcagcgccgcgccactggcggaggtaatgacaccgaggcgttttgctggtgagggcagtggctttttatggatcgaatcaaataacccttctgaggtgagtttctgtttcagtatctcaaattgttgctgtagcagtccatctccagcaggttggatactttccacaatcagttgatagtcaccccgtggctcatatagcgtaatctgtgcacgcaccaacacctgctgaccattttgtggacgaaatgttgcccgcagattgctgctacgaaacatggcagcacgaatttgtgctcgttcatcttttaacgtgaagtaccaatgccctgatgaaggctgggaaaaattagaaatttcagcacttagccaaattctacccatttccagctccaatagctgacggacagtctgattcaggcgactaacagaaaaaattccggtgttggttggtagtgacatgtgagccagatcaaatttcaaagcaagaggttaattaactgatactaatcatcccagaatacgaatcaagaaatttttttaaaaaatgctggaggcaatcgattacggcctgtataatgccgcggcaatattttatgccttattgcccatagcttggtgagatattgcccatgttgcgaattaaaaaagaagcattaacttttgatgacgttttgttggttcctgcccattctacagtcctgcctaatacagcagatctgtccactcaattaacttccactattcgtctgaacgttcctatgctctcagcggccatggatacagtgacggaatctgctctggcaattgcactggcccaggaagggggtatcggctttattcacaagaatatgcccattgagcgtcaggcagaagaagtccgccgcgtgaaaaaacacgaaagtggtgtggtgactaaccctgttactgtaacgccacaaactacactgcgtgaagtacatgaactgactaaacgtaatggtttcgcaggttatcctgtcgtgacagaagagaacgaactggtaggtatcattactggccgtgatgtacgtttcgttactgatctggatcagccagtgactgcggtaatgacgccgaaagagcgtctagtcattgtaaaagaaggtgaagcgcgcgaagttgtgttgcagaaaatgcacgaaaagcgtgttgagaaagcactggtcgttgatgatagtttccacttgcttggcatgatcactgtgaaagatttccagaaagcagaacgtaagccaaacgcctgtaaagatgaagagggtcgtctgcgggttggtgctgcggtcggtgcaggtgctggcaatgaagaacgtgttgatgcgctggtagctgcgggcgtggatatcctgcttatcgactcatcccacggtcattctgaaggtgttttgcagcgtattcgcgaaactcgtgctaaatatcctgatttgcaaatcattggtggtaacgtagcgactggcgaaggtgctaaggcactgtttgaagccggcgttaacgcagtgaaagtcggtattggccctggttctatatgtactacccgtatcgttactggtgtcggtgtccctcaaatcacggcgattgctgatgcagtggaagccctggaaggtactggtattcctgtgattgctgacggtggaatccgcttctctggtgatatcgctaaagcgattgcggcgggcgcatcatgcgtcatggtggggtcaatgctggccggtacagaagaatcccctggggaaattgaactctatcagggccgttctttcaaatcctaccgtggtatgggatcactgggcgcgatgtccaaaggctcctctgaccgttacttccagaccgataacgcggcagacaaactggtgccagaaggcatcgaaggccgtgtggcttacaaaggcctgttgaaaagcatcgttcaccagcaaatgggtggcttacgttcctgcatggggttaacaggctgtgccactattgacgaactgagaactaaagcagaattcgttcgtatcagtggtgcaggcattcaggaaagtcatgtacatgacgtgaccatcaccaaagaatcaccaaactatcgtttaggtttgtaatttatttagggtggcccactatcgggccactgacttctttatttttcttgccacttgtttttggaattcacctcaaatgacaactaatatccaccagcatcgcatcctgatccttgattttggttcgcaatatacccagctaattgcccgccgtattcgtgaaattggtgtttattgtgaactttggacatggaatgtcacggaagagcaaatccgtgaatttaacccgagtggtatcatcctttcgggtgggccggaaagtacaacagagaataatagcccgtgtgcaccggaatatgtctttcatgcaggtgtgccggtactgggaatttgctatggtatgcaaactatgtccatgcaactgggcggcaaagtgggcaattctactgagcgcgaatttggttatgctcaagttgaaatcaaagatgactgtgaattattccgtggcattcaggatgttcagagtgaatccggtaaacctttgttggatgtttggatgagccatggtgataaagtcactgctattccagaaggtttcatcaccgttgccagcacggatacctgcccgtttgccattatggccaatgatgaaaaacgtttttatggcgtacaattccacccagaggtgactcatactcatcagggtttgaatattttacaacgctttgtactggatatctgtcaatgtgaagtattgtggacgccagcttccattatcgacgatattgtagaacgcctgcgtacgcagattggtgatgatcacgttattctggcactgtctggtggtgtggattcttccgtaaccgcattgctgctgaaccgcgcgattggtaaacgtctgacctgtgtttttgtagacaacggtctgttgcgtctgaatgaagccgatcaggttatggcaatgtttgagggtaaattcgacctgaacctcgttcatgttaaggcagaagagcgcttcctgtctgcgttggcgggtattgatgagccagaagccaagcgtaaaaccatcggccatgtctttattgatgtatttgatgaagaagcatcaaaacaaactcaggttaaatggctggcacagggtacaatttatccagatgttatcgaatctgctgcttctgcgacaggcaatgcccacgttatcaaatctcaccacaatgtgggtggtctgccggacgatatgaaactgggattagttgaaccgctgaaagagctgtttaaagacgaagttcgccgtattggtttggaactgggtctgccatatgacatgctgtaccgccatccattcccaggcccaggtcttggtgtgcgtgtattaggtgaagtgaagaaagagtattgtgatctgctgcgccgtgcagatgctatctttattgaagaactgcataaagcggatctgtacaataaagtcagtcaggcgttcactgtattcctgccagtgcgctctgtcggcgtaatgggtgatggccgtaaatacgattgggtcgtttccctgcgtgcagtagaaaccattgactttatgactgctcactgggcacacctgccatatgatttcttaggtcgtgtgtcgaacaggatcattaatgagatcaatggtatatcgcgggtagtctatgatatcagcggtaagccacctgcgacgatcgagtgggaatgatctagagtcttcccaagcctccccaaatcatcataattttctaattaagaccctgatttcagggtctttttatccctgtatctcaccaaatcacaccacctcagtattcaatttttgacggtatcgcaatatacgttatattaattgactcaaaagaccgtcacagttttactctaaattgacggtatcagatcaataaaaggataccaacatgcgctgagttaacatattaagtgcaatcggcgggatattaaaaggagtgagtcaactgtgatacatttcatggctctcacacctgaaatcatggcctgatatgcataaacaaaccagacagtaccgacagttgactcccgagcaaagatatcagcttcaagccctgtataacaggggctttccacaacatcaaacgctgaatcgcttggtgttcattccagcacggtttcacgtgaactgaaacggaatgcaaacaataaacaatattgtgctaagtctgctgaaatattgaaaaataatcgaaaaaagaccgcttttaagtttagaaaataccacccccggcatgaaaacatcttgtctgagggattatcaatgggttggtcgccagagaatattgactacgaatgcgtctggagtgtccggagatatagcagaatcaacataacctgacctattcaatatgctccgtaaacaactcatcaactgaacatcttttttgcctccttatcgcttttgctccgccccatttgtgttctatagggtttaaatccggactataagcgggaagccattccagttgacatctgctgtctgctatcgcttgtgtcgtgtcattccgtttatggaaaggcgcattatccatcactatcactgctccgtgtggaagctttggcagcaaatcttgcgtcatccacgcataagaaacatcggcattaatattcccggtaaataagcttaaggtgacgaaggtattttcgagaatggcgccaatgacgttgagacggccttttgcgtgccagtcatgcgtaccaaaacagcgtaaccctttttccgaatacccctgtttacgtggcatcgattgagcaaaaccactttcatccaaataaacaaggggtctgccagtctgttcatcatcgctgatgtgctcgataaatgcctgacgagcttgaggatcagcgcgagggtgttggagcgttttttttcggggtgatattcagccgtttcaaggcgtaatgaatagccgattatgagacacctaaacgttttgctctttcccattgagagtcatcagaaaaattttggacatctgcaatgagtaccttatcagggattttcgtggcgggtttatcgcgggtcatgcaaggttctattttattgcaccaccggaacaaggtacgcatggagatctcaaaatgggcactcgtttgttcgaaagtcaacgaatgcttgtctttgtatgccagtactcgctttcgaaaatctaagctgtagcccatctcattttatgccttgttatcttagagttagatattatgtcatattaatatgatttagctatagcccttagccacagtactagggcaatcgcatctaaaattcattgacaatggtttaatttcatgtcgttatgcagcttttaaatccatccttatgtcctctgtcagccctttgttacagcattttgcctcacttgaagatccccgagttcaacgaactcagttgcatagtttggaaaatatcctgactatcgccatctgcgctgtgatttgtggcgctgaaggttgggtcgaaattgaagagtttggcgaatctaaacaggatttctttacccaactgcttgatctcactaatggcatcccctctcacgatacctttggtcgtgtctttgctgcacttgatacgcaggcttttgccgactgtttcacctcctggatatctacgctggcacaaggagttgatcaggatatcatcgctattgatggcaaaaccatgcgccggtcactcgataaagccaacggcaaggcggcaatccatctggtcagcgcctttgcctgtaccaatcgcttagttctgggacaagtgaaagtggagagtaaatccaatgaaatcaccgctattcctgagttacttcgacgattggttttgtctggaagtctggtgactatcgatgccatgggatgccagaaagcgattgctcatcaattacatgaagcgggcgcggattacgtactgagcctgaaagaaaatcatcccggcctgtataatgatgtcagccattatttcgattatgtctcatcccaaccggagcacctgagcgaatatgaagacgtggatgccggacatggccgcattgagcgacgcacagtacaaatgacccatgttgattggttgccggaaaaggcgtgctggtgtggtttacacagcataatacgggtgatccgcgaacgctatgtaggaaatgaagtgagccgggagagctgttattttatcagcactttacgtccgacagaggctcaacgggcagcgacagcgatccgcagttactggcaaatagaaacgcaactccattggtgtctggacattgcatttaatgaagatcaacagcggatgcaggagggcaatgcggcggctaatatggcattactcaataaaatcgcgttgaatttacttcggttgtcccctaccaaagcaggaattaaagcccgccgtaaacgggcggattgggaggacaaatatctgcttacggtattgggtaaagcccagcaaatttatatgcgattgccctgggtcgcacccgtttcaggatgcaaccgcgttgcgcacccgttatgcaaaaaataaggatgctgatgctgacagtctgatggctgtgattgtggctcaagccatgaatcacggcaaccggactttggcctgaaccagtgatattccctaagaaagaagatcaccactcaatcaccagacatacatttcacggtaagcataaaggttgtccggtacggaaggtggaaaaataatctgctttactgatgattcattgatgaatatgcgagtaataaaattaatccactattaattttagcatttaatttttttttattataagtattgcaattattgattctatctgagattctggctaagaataatataaaataacattcaataaatattgattctatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcacctgttagattaattttcatgggcgcaatcatgatctgatacaaatgaaaaatcaagcatcttcaatgacgacgggtagatatctccttcataaaaaagaataagaatattgataataaggatatttttacaaaaaaataatcctggtaattaattacattttagaaatttaatttaaaattattttttattgatctacatattgactgtataaaaaaccagtgtaatgataagctagatattcatcataaagtatgaatatcaacatattaattacatcgatagcagtcgaaaaatattcgacaaaaaataaatcacctcgagaaaccaatatgcaaacagtaagcctaaatgaaaaaattcaaattttccgtcaactccatgaggaaggtcgcctaatattagccaattcttgggacgtcatgagtagtcgtttagctgaacaaagtggtgccaaagcgatagccacaacaagttctgggatatcttggagcttggggtaccctgataatcaattagccgatcggaaactggtgataaaagcgctaggtttaattacagactgcaccaaccttccagtttctgctgacattgaagatggtctgctgagtattgatgaaaatatggatcatcttgtacaagacttatattctgtcgaatgtgtcggtattaatatcgaagatgctcaaaatggtaagtcaatgtctatagaggatggtgccgaacgcatagctgctgtacgtacttccgcgaataaattgaattacaatttatttatcaatgctcgtattgattcatggcttcgtggtgaaaataccgaaccagctcacttgatttcccgtgctaatgcttaccttgccgctggcgcagattgtatctttatccccggtctaaccgatttagctatctgccaaacgatcagtactcatattaacggaccgttaaatgtaatggcacactctggggcccccagcgcagaagaattttttgcggctggagtgaaaaggatttctggcggttctttctttgctgaacaagcatacggaatcactttggcaagtatggagaattttgtacgaaatggtatgttacagccaaatgataaggcaaaactgaattatatggagctaaatgctctattggatcagaaagtataatcaatacgttgcaggaaatatggcattctatcctgcaacattaaacaaaaatctaaaatactgagaatatagttccttatgttacaatttaaatatgaaattaaaataacaattttactctattaataactaattaagaaaacaatacagtattaaaataatttcaattagataaaaacaaaataaattttctcttgaaaattcacacagcttagaaacataatctgttttcaaagaagtcatcttttcacaaaagacagacttttgagggttaggtattttatacctgagtgtatgtcttaaacatcagataatggcgtctggtatgagtcaaacgttaacttctcaatctaatttacaagataatccctgtataagctgtggtgcttgctgtgcatattttcgtgtttcattttactgggcagaagccgaagatggcggaggtactgttcctatctttatgaccgaaaaattaaacgctttcatgagttgtatgaaaggtacaaatgaacctaatccccgctgtataaatttacgtggtgaaattggtcaatcagtctcttgtaccatttatgataaaagaccttctccttgtagggaatttactcaagcttgggaaaccgacgattacaatgaagcctgtgatcgtgccagagccgcttatggacttccgccactgccaaaattgtaggcctaatccaccatatttccgttacctgtcatgaattataatgacaactgattcattaatattgttatggataaatattactatgaggaaatattacgatgagaagagttaagacatttagatgaagtggtgggcgataccagattcgaactgatgaccccctccttgtaagggagatgctctaccaactgagctaatcgcccacttcatggtgggtcgtgcaggattcgaacctgcgaccaattgattaaaagtcaactgctctaccgactgagctaacgacccgattaggtaattctgattttatatctaaatggtgggtcgtgcaggattcgaacctgcgaccaattgattaaaagtcaactgctctaccgactgagctaacgacccaattagataattttgatttgatatttaaaatggtgggtcgtgcaggattcgaacctgcgaccaattgattaaaagtcaactgctctaccgactgagctaacgacccattttaaatatcaatgtgatactgcgaaacaatctgatgaagtggtgggcgataccagattcgaactgatgaccccctccttgtaagggagatgctctaccaactgagctaatcgcccacttcaatgactataacgacatcaataccactgatttatgattggtgggcgataccagattcgaactgatgaccccctccttgtaagggagatgctctaccaactgagctaatcgcccaatcataaaatcattttttatcactacgagagagatggtgggcgataccagattcg

SEQ ID NO: 14966 - DNA, 62759 bp, Xenorhabdus bovienii
  Genomic contig Name=Xb4151_4152.C425
tcagccaaaaccgataaaatagatgctcaggtgctggcacagttagccctggttttatctcaacgaacagaccgggataaaatagtcaggatattgccctctgctcagcaacgagtcttgcaagccatgatcgcacgtcgtcgccaattggtcgtactttccatctcagaacgccaaaggttggggaattgccatccagacattcgagaaagcatcactttaatgatcagctttatacaggaacagcttaaggtcattgaatctgccttgtctaaacacattaaaacctatcatcgttccaaactcgatttattatctacagtaaaaggcgttgggcctgccacaatagccactttgatcgctgatgtaccggagttgggtaagttaacacgccgggaaattagtgccttgattggtgttgcaccgtttaatcgagattctggatttttccgggggaaacgaacaatctttggaggaagagcaatggtgcgtcgaatgctatatatggccacgttaacggcaattagatttaaccccgttctctgcgctttctacaagagattgaccgaagcaggcaagccaaacaaagtcgccatcgttgcgtgtatgcgtaaattactggtcattctcaatgcaatgataaaaacaaatagaccgtgggacgaatcattccacacggtgtaaagtgaaagacagttgctcattaaccgccttgctaaaaatagtcttttttgtgatcgggcgcataaaataaacacaatcatgattttgtcaaagttgttacctatttttttatttttatctcatgatgttacgaaaaaaaacaccttttatggataaacattaagtggttcgatacactaatcacatacgctatctaagaatattatttttcaaccgaaatcattttaactttttacgctgctattgtcggataccattttttatttcacttgatttaacttggcctttactccttctttacttacttattattgccttcattttatttatcacggatcagtcgatatattcggacaacagagtcccttcaaattatcggaaaacaacctattgcgtccttaattaggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagactccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttacgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccatttttgggggtcagggaacaataaaggcttaaacattttatttttatactttcctatagcgccataataatcccatctttttagtgcatcatctttacttataggttgaagctgaggtaaataatcaactccatttatagcctgataaaaaccaagtagatttgaaaccaaatcttcaccactgtacccactatctgtataccaattaaaaggaaaagaatcttgatgtgcttcaaatagatgagttgtatgcatcataatagtaagggcaactctttttttatcgtgtaaagatagtcctcttcttactttccatcttgttattttagatgtgccatattttaatccaagccccatgtattgtgtgtacttaatggtaaagtatggttctttagtatcatcacctgaatttatagcggccattaacattctggcatcattaccttttgaatgcccagtatctacccatcctaatttttcggtataaactaaccttccttttattacatcacttctactactcatggaacctcctgtaatttagttaaatacactataaaattttagaacacataatagtacataaagtaattaatcggctacttaatagaagactcttgctggattaacacaaagttacaattttgttgttttacgttaaaatgtaggcttctatagtatatgatactataattacatagtagattagtaaatcccaatctcactttttagtaaggatatatgatttatataaaataacgttagattgaaagtgtgtaagttttcttcattgaaagtaatactgaaaataaactattcccatagttaaatatttaaagcccacatcataaaataatggggagagatggggatttaagcggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccaaaattagagcacaatgaagagtggagtttgcatgatttaagaagaactttttcaactaaactcaatgaattaggtgtggcgccacatgtggttgaacagcttctgggtcatgctttgccgggcattatggctatatacaataagagtcaatacctaccagagaagctagatgctttaaacaaatggtgtgagcgtctggatgtattggcgggtaattatgaaaatgtggttatattaaaggcggggcagcaatgacagaatacccagagtatgtagattattgtttgattgagtggtatgaatcagaagtgattttggattttacaattcctatccctgatgcaaaaaaagaagaacttgataaagtggggtgttttattgattctaatgaatggactccaactctatcggagaaagatgtcgcttataaattaatatttgatgaaaaaatgattttcatttggtcagcattatctaatagagcgaatgagtgccgcaatccttatatgttctatcaatctcttacggatgaaattatttccgcaatcaaagggcctagcgattgggatctattaacgcaaaaacaaaaagaagaaaaaacagaaaaaataaaaaaattgtcatttgagctaaataaagaaatatccaataccccattagatgtttcaataatgaactatgcaagccatgaatcttattttcaacgtttcaaaagaatgcacaatagtgaaaaatcaaataatatgcttgatcaccatttagagaagtattgtttttataaaaattcacattttcttcctaaatatgggcatgaaggtgctatagggtgggcatggaatagcgttggtgttacatcaccatcaataagttcttttttgcaagatttaaatgagcaggctaattcatttaaatgtgaatccatcttaaaaagaaaaaatcaaataaaaagaactttttttgttagaaaaatatcagcatttttttccgataattttggtaccccacttcataatattacagcgacaattagtagtgtttttcttgatgaagatataacgatagaggaagtcagatccatgatcagataacataacacattggcgtaaaacaacattaaaatgccagatttacgccaatggcttaaaaaagaataaatgaatgggtataacaccaatggctataactaactaaatttcataggttttacgccaatttttttatttttatttttgattaagaataccctcacaaaaacaattaaacagtgagggtaacatgaccattcgatataacactcctacaccagaagaacgccgctctatcctttccgagtatggcgaaccttacgatcgtcttatccgtgaaaaggaacgccatcacatcacttctatttccagaacatcagcgtggaaactggagaacgaaggccgcttccctgcccgcaaaccactaggccgcaattcctgtgcttggttactcagtgacttactgcattgggtacgcaacccgccaacagtagagaacgtcaataacccctacagccgaaaatcaaattaattaagacagggtaaaatatgaaatctaaaaatgcggccttaactggtcagggacttgctcacgctgaaaacaatcaagagcctattttagttcagcgcaaagagaacctaaaaaagaattatgccgaaatgatcccgttaacagcgggaactattaatggaaaggcagcaatggttactgatgccagaaacctgcataagtttcttggcaataaggaactgtttgctagctggataaaacagcgcattgatcaatacggttttattgaaaatgaggattacgagacttatttggaaaattccaaaaaaggtcgtccgagaactgaataccgtgttagctctgatatggcgaaagagctttctatggtggaacgcaccgaagaaggtaaagaggctcgccagtactttatcgactgtgaaaaacgtctgcgccgtgttgcaccagaagaacaccaagctgcgctgatgaactggcgtaaaaatcgtgtcgctgcctgtgaagatcataaaagcatgactgatgcgatgaaaggatatatggaacgcaccggagacactcaaaagggctttgcttacagcaatgaatctcgatttattaataaattggtgctgggtatagatcctgtcaaatgggctaaaaataagggcattaaatccaaagaagtcagagacaacatgaccgcagagcaattacagctactgacgtatttggaatcacgcaattgtgcatttcttgatttggacgcaccgactgagaagcgaaaagcccaattaatggaactggctcaacgttggttagcgcagcgtatggaagcgaagcaatgaattctgtaactttaagttatccaattatttctggtgactccttgagtttgaggagtcctactgtcgaagtcctcactttggccgatgggtatgcgaatattttcggacacccatcagtgaaatattgcgccaattgggatttaaaagcccatctaagtgggaatgcccattttagtgataactcattgatatctattcaaacgccagatttggcgtttgcttataatatgcgcatatcatttagcgacgcggttaatttgcgatcctcattaagtggagtgcaaacagaaaaggatagcacggcgaatgctaccctttggcgtaaagcacattttctttacaagataaatcaatcatttatccgtaatccaattctggtttacgacgaattacaacagcttaagaggctcacctctttaagaggtttggttaggctccccgataacatcgggttggttagttattgctcaatcaacttaccatctttaagagggggagttaaccaagtgaataatgttcactcggttagttattgctcaggtgatgctttggttttgcgttggcggcgtttgatctcaccctgtaatgcggtgacgataaactgtgccgtactttccccaggttcctttaatgattctacattatcggctatttcgtgtggcactcgtgcgctcatcttttgtgatttgttattaacattatcacgtgtcattactgctctccacatttgtttatgggtgccagtatacacaaaaataattataaaaaaagtattgatgtgggtgccagtttgtatttatactgggtgccagttgaatgttgcagcattcaataagaacaaggctccgtcggattgcagtccaagcggagcctctgaccactacgttacggagattaacgctatggctatacaacagcataaccaaactcgccttaaatttacattcctaattgcatcgggcactcaacgtctggtggatattcaccctgtacgtctcattactgtgttggcggacagtgaaggtgaagcccgtttactggtcggtatttcctctctggtatttgtttcccgtcaaggggtggccgcatgagcaagcctatcactattcatcaagccgctgaaaaggcccagcaactcgaatttattaatcagcttattgagtcataccctcaccaaatacagggcagtgaaatatctgttatttcttctctgatggcaaagctatccggcgatattgctgtatttctgattgaagtaatcgcaggtgaggaagctattgataacacttccaactatagagatatgtctaccgttcagggggggagccatgcgtgaccccgcaccccatgactactacacccatcagaacggggaaaccgttcaggtgctgtcggtcgcctttaaccgcgtgacgtttgtccgtgatggctataacaccccgtgcatcatgccagtaagccgtttcactaaagaatacacctacgcagggagagcctgattatgtctgatatctataaccacttagtacgcaacaactttagcaccatgagcactgaggaaattaaagatctgcgtaagcattcagatggagcacatagcgcagtgatggcggcaatgtcagcgatgggggaactggctttctggtctgccgataatgagaactatgcagattgtcaggcaagggacgatttacgccgtatcggtgaagccctgatgtacctgccccgaattgccgaagccctgaatgacacagcacagcacgcggattttgaaattcatcaccgcgagaggttccccaaatggtaagtcatattgatatccgttcagtgaaaatggcggctaaggatcactggcagggtttgctggctgcctgtggggtggatgttccggcaaaggggaagcatggagcttgcccgatatgcggtggcactgaccgttttcacttcatggacgatcatgggaacggtgactggcattgtcgccagtgtgatgagccgaatcacggtgatgggctggatttgctggtcagggcgaaggggatcacgattattgaggcggctaaagaggtttctcaggcgttatcgctgccactgcctgagcctgccagaaaggaagctcccaaatcaggagctcccctgatagccgaaagaattaaaaagctggtggctcaaaccacgatcgggcaatccgactatctgactaacaaggggctgcaatgcccccatcagaagctattgaaagacggctctttgttactggtcatgcaagcgttagacggaaccgtaacaggcgcacagacgatcaagccaaacggtgaaaagcgccttgtctcaggctcacagaaaaaggggagttttatccccttatccggggtaaccgaaacaccggacacgatcatcattactgagggttatgcaaccgcgttaaccgtcagccagttgcatgatggcgtggtgctggctgcgattgatgaagggaatctattcgctgttgccggacacgtcagggaacggtggcctgatgcgaaaatcattctggcggctgacaacgatatgaagtccggtcataagaatgtggggaaaatttcagcagaaaaagcggccaaatctgtcaggggctgggtcacatggccgcccacggaagataaagcggactgggacgattaccgccagtgtcacggcatcgaagcggcaaagcaggcattcagccaaggattgcatcaggcaggggagaaagcgtcagtgttaaagtcagtggtgattaatttagatgaccatcgtgagaaagaacgtgatcccctgataccgtttattgatgtgcgccacaccggggttttttacgtgaccccgaaattagacaaagaaaccggggaaatcatcaaaccggaacaatggctgtgttcaccgattgatgtcatcggcacgggcattgatgaaaatgacgagcaatacctgatagtccgttggaaagcgaagggcagtaaagacccggtcattaaaggggtagcgtcggccgacattggagaacgcgaaggctggcgaatgctcaaagcgggcggtgtgcaagtcacaacaaaaagtaatctcagggcgatcctggctgactggctgatacgaagccacacaaaagaaatctggagtatgacggcaaaatcaggctggcataaaggggcgtatatcatgccggacggttcggtgattggcgtacctcagcagcctgttttgtttaacgggggcagtgccgcggcgaatgcctataccgtttcagggacaactgacagctggcgtgaagaggtggcacggctggcgaataataacccctttatgatgctgggcattgcgacggcgttagcggccccgatgataggaattgtgggggcggacgggtttggtgtccatctgtatgcgcaatctactgccgggaaaaccacgacggctgacattgcaaccagcctatacggtaaaccggatgagcaacggctgacgtggtatggcactgcgctgggtattgctaacgaagcattggcacacaatgacggcctgttgtcactcgatgaggtcggacagggtgcgaaccctaagcatgtccacacctcagcctataccctgtttaatggcaaggggaaaatacagggggcgaaagaaggcggtaaccgtcctttggcaagctggcgaaccgtggcgatcagtaccggtgagaaagatatccccacgttcttgatggaggccgggattaaaattaatgccgggcaattagtccgattgctgaatattccgatggaaagggccaagaccttgcacggttcagaaaatggcaaggcgcatgcggatgcgttaaagcggggctgtcgtgaacatcatggtgcggcagggcgggaatggatcggttatctatcgtcacaccatgaggaggccagacaggcgtatatcgcggcgcaatcacggtggggcaagctgataccggaaagttatggtgagcaggtacaacgggtcagtgatcgctttgcggtgctggaggcggctttaatgctggggcgggtcattacgggctggaaggcgcaggattgccgcgatgtgctgcaatatatctttaatgtctgggtggcggagtttgggaccggcaacaaagaaggtgaacagattgtcgagcaggccgtttcctttcttaacgcccatggcatgagccgctatgcccctctgccctatgatgaacgggacttaccgattcgggatttggctgggtatcgggaaaagaaaggccttcatgataatgatccgatgattttctataccttacccgcgacttttaagcaggagatcgcccggggttttaacgtggatatgttcgcagacacgttagtgaaaagcgacatactcaaaaagccggccagtggcaggagctatcagggcaagacaccccgtcttaagcatctggggggtattcagcaacgggcttacatcatggtgctggtgcctgaatcagacgaagaagactgatctcctcatgtgagggctaaaatctgttgtctcagttgtctcggttgtctcatttttattaactgtatgaattgtaattattttagtttttaaattgagacaacatgagacaacaaacaggggttttgagacaacatcgaacgggtaaaaattgtctttttggcaggccattggaggcattatgagaaaattacgtaaattataccgtcagaaaatcaatgttttcgcgggtattctgccgggatcttgtactcaatccgaggagcggttccatgatcgtgagctgaccgacaggattatcctgaatctggtgggggagacagcgtaataatgaaactcgaatcagcattaaaacactttcacccgaaaacaccgacgttcagtgatgcgtcaaccagtaccgcaccggacagaatgaaaggaatggataccgcagcagctttggggatggcgggatcacaagccaagttcggcatggcggcatttttcgccaagaacgaggtcagtgaagaagacaggttcagcacggtagaagaactgacccgatacgcaaggcgaactgttcctaagctgatatccaaagcagcagggaataaactggggccctgtctggttatcttatcgaagatggcgtttgaagattatgcccgttcagcggcgtctacttgtcagtgttcggaatgtcgcgggaaagggcttatctacggcataaaagaagttgaaaaacatcccggcattattcgtgcggacggtgaagtgattatggcgccgtggattgaaaaagagcaggtgggtgaactttgccagaagtgtaatggtaaaggcacgctgtcaagtcgttgtcgctgcaaggggcggggtgtagtcgttgatgaggaaaagaccgccttgcagggcgtaccggttgataaaatctgcccccgatgctcaggccggggttacagccgggtgccatcatcagtagcttacacggctatcaaggcgcttgttcctgcattgactcaatcatcatggtctcgtaactggaagcccttttatgaaaagctggtaggtaagtgttacgccgaagaaagcagtgcggaagctatgtttagcaaggtaacaaaataaactgttttatgtcatcaacagtatttgcattttgcataaagatggcttaatatctccaaatagtgggaacttgtaactatactcactacgaattttaaacctcgcccagtgcggggttttttgctttctgcaacggtaaggttgcttttgaatgagttatcttaccgttgtggagaatgccaaggctgattggcagtgtatggactatcggatgtaccgcacaccatctagaggcggcctctgcggattaggctaagcccctgagagtatctagaaaccgatgcaggagatcagcacctgcctccacaactcgatcggggtcggacagcaccttatatcactgtaaaatcaattggttaaatattatttcgggtgatatgagcagcaccttgatccccatggataactcaacctgttggtgaaaccaactagttcaaattcaaggctgcgcatggcgtggccttttctatatctggaactttggcgtagagggttcgcgcggatgcctgaagagcatcaggactcggttcgattccgagaggttccaccaaattatcgaaggtcacttaggtggccttttttgttacctacgcaatgaggaaattaaccatgtacgcattaaagctaatcacagaaagaaacggtcgttcagtagaagagtcatggatcttgggagacatgtaccgtctggagtttttcccgaaagatgtcgctgataatgttattgcccgtgtcgagcatagccagaacggcaatctgattaatcacgacatcaaaaaaacagaccaagcctacattaccactctgacgggtgacactgttcgcacggtctgtcgaggccgaagtggacttgtagctggttccatacagtaaccaatacagagcgtctatatttgggcgctcgatattgcttattatctaatttgccgccgcaatcactcccagtacctccgtacctccgtatctcctattgcggtcggcatcctattaactcactcgtgaggtgaatgatggaaaatcgtattgaagaactggaaagaaaggttgttgggttggaaaaacagctcgttgaaaaaaataaatctgcgagctgtataattgaaaatgatatggctattctgcgtaaatgtgatggaaggattatttttcgcttagggaaaatttagttatttgtccaactaaggctattgactctcgacttgttccatcttcattgttttctaaaaccttatcgaacaatttatagagctgatccaatttttcaggctctttgtttgtgaccatcccggccaaaatagtgaacagtactggaactgcataagtcatatcttctagattaatttcgtcaactttgattttttcaaattcgtagctcattttttatccttcacagaggtaatcagccatccctctattgattagttaatgtttggctgatctaacaacataccttaagtatcaacttattacttttaactaactcacaggggcgaccatagctcaccccacggacgcccattgttcaaatggggtggaatatgaagatgaaagaaaatcctgatgtatgggctgagctgctcaatggcctgcaaaattcgtggccgcagatatccggctctgttttggcaatagctatctgttatggccgcctgatttatgacggtgtagaacgcaagaaccgttgggtcgaagcgctgctctgtggtgccttgtcatggagcgtgtccagtggcttagagatgtttggcgttcccagtagtttcgcgccggcaatcggtggtgtcattggttttattggcgttgaaaaaatacgtgagtttgctatccgtgccatcaataaacggttgggagataaataatgagcagaggcattcgcaataacaatcccggcaacattgaccacaactcagcgaataagtggcagggtcaattgccccacgacccgaagattgaatctcggttctgtcggtttgagtcaccagagtatggtattcgggcactgatgaagctgttgtgcaattaccacaaaaaaggctatcagaccgtcgcgaagatgatagaccgctgggcacccactaacgaaaacaacacttcggcttatatcaatggtgtggccaaggcgctaggtgttgatcctcatcaggtcattagcgttgataaggtcacattgattgcattggctaagtccattatccggcacgagaacggcaagcaaccgtattcagaggcaacgtttgagaaagcctttaatttactctgaatcctgagcctcgcaatcgcggggcttctttttatctgcgtactgacgtgcgctaaatccaatcatgagcttatagaaatagagcctgagagatatcgccaggtggcgacctttcatgaggcgatatttctacgtcagcaggctcttatttctataggaatacgcaagatgcataccattacagtccctttttataacgatgaactctatgttgtggaatacaacaatgaaccgtatgtaccaatgagaccgattgttgaaggcatggggatggattgggcgtcacaatatactaagttaaaacaaagatttaatacctccgttgtgaacatcacaatgcagctccctgatgataaacaacgcagagatgtagtttgcttagctctacgtaaattggcggggtggttacaaaccatctaccccaataaagttaaacctgaaattagggacaaggtgatccgctatcaggatgagtgcgatgatgtgctttatgattactggacaaaagggatagcaatcaacccccgcaagcgtagtgtgatggaagagctgaatgaggcctgtgctgaatttaaacgagacaagcagatagccagtgtgtttggtactggccttaacgcatggaagcacgtcagtgtcgaacataaaagcaaaataagaggattgaccgaagagattgctggtttagctctggattttgttctggccgaaataggcaagggcaaaacaacacgaacgaaataaggcgaatgacatgaaattcaacagccagtatttcacggtgggtgctctggtggtcgtctccggcctgctctggttcttttacagtgagtatcagcaaaaggctcaagattatagcgagctggacacgaagcatcaaactcaactcatcgctataaacgaacagcaaaaacgtatccagcgccttgctgaactggactccaaacacaggcaggaactcgacaatgccaaatctgaaattgatactcttcgggctgatgttgccgctggtcgtcgcaagttgcgcatcaaagccatctgtcccgtgtctgaaaccgttgcctccggcagcgtgggcgatgcaaccaccgtcgaactctctggagaaactggatcaactgttctcgatatccgagaaagcatcatcagcgaccgagcaaaactaaggtatttgcaggaatacgttaatactgaatgcagggggaatgatggcaatattcaaacatctcactaaagatgagattaagcgtgactatgaccactatggcctattcatgggattgattccagtgtatgtcggtgacgttcatggtgagtgtagattggcggtacgaaactggttgcccgattggttgtttgatgttgccgatttcatttgcagtttatgtcccggtgattattacgtaatcaagttaacaggaataatcaagtgatcatcaccccagcgcaaatgatactggggtggcaggattatgttaataccgagtgtaagggggcaaataacgatgaatggattatccaaaggtgagtacaaaaccaatcggaaaatgcataaccagatattcaaatatcggcaactcaagttttatcaatattcaaaggtagctgctggagacatcactaccttgaatatttacgtgtgcaaatggttcatcgtattaattgccattccaaatagacacgtcatgtaggagcctggaacgtcaggatttactgccatacaccaacttatacagttcctccagtcttgggtgttactgggatgcatcgagcaaatagaagcataagtctgcatcgaagctaaaagagtcgtgcctgctactaggcaaagaagaagatattttttcattttattctctatatttcgattgaagtaacattattgcaacaacaattaaacccatttccgcctaacaacaaacgaataatatttaacaattagttaacgcttgaaactcaacaaaatattcctttacccattcccttgagtggttaaaggaatcccccacgccatcagttaacgcgggtggcatttttgtatcagcatttcaccgcgtcgggttatcgccgtctgcctgtattagccatgacatgttccctttgcatcgagcgtacaggtcagaatcaaaaataatcaatgccccagacagtcattatcagcaacatccgctgtaggcagaagaagcggtgtgacagccggagagacggcctgtattgccatcatgattcattgagtcgtgatcgctatgtagaaaagcaaagtccgataatcggatattggattaaccacacatatagaggtcactatgacagaactgaactatgaagcgattgggcgttgtaaggtgttaagagaaaagatagaggctttacacacgcgaaggcaccaatgtgtttataaactgagagatgaaacttcaaggctgacatttagtgatggctaccggatacctgaaattgccgagtttgacagggatctcatgcaaagtcagatgaaggatattgcccttgtggacagtgacctgatgcacgcagtacacgaatttaatatctggtgtcaggaggcaggagaaccatcaataaaactaaatccttcaactaagaaagatttggagaaattaaaaccattgccatttgatgggtttcccggctctgcgttattaagacgatgatgtggaactgctacataaaggtgcagagtaggttatcaataaggccatcagttaacagggtggcattttctttttggagaacagaacatgacacaaagtacaggcacggcaacatatgacatcactgttggtatcaaatatgacactgacacactgaaccagcttgagacacaactaaagcgtatcgctgaacaagtggatcgcattaatggtcgtcgctatgacgcaggtatgacactgtcagtagatacaggtgctaaggctggaattgctgccgatagcttcaaggtcttcgatgtaaccggaaaggtttacatgaaagaggcggtcataccccaagcggtaataaaggataatgataaccatctccgccagataatccgtgaagagatacgccagttcgtcacccgtgagagtgaacgaggcggattgttctccaagtggtgatgtgatgccgccaagaataccgagagcctgccgcaagcagggttgccccaagaccaccactgaccgaagtggctactgcaacgatcaccttcacaccggctgggagaaccatcagcaaggcaagagccgacatgaacgcggctatggcagcaagtgggacaagctcagagctaccatcaaggcgagagataaacacttatgccagcaatgcttacgccatggccgggcagtgacaggcgtgactgttgaccacgtcaagcccaaggcacacggtggcacggatgcgttaacaaatctggttctattatgctggtcttgccatagggcgaagaccgcaacggagcgtaacaaatgatattacctgacttaccagaacctcagaacaaagaacaggcgtcaatctttgctaagaactatgcaaccgctattaaaaaatcacatcaaatgaagcaacttaaaatgcgtcgatttgagtgtgaggaaaaggacgcgccaaagtggtttgttcgaatggttgatatagagattaacttcattctttatcgcatagattatctagagagatgggatagaaagcctgactcgcacacctatgcaacagaaaccctgcgtcatattcgtgtcgcactcgatatgatgtgcagctttttaaagcccgaaaggatgtattttaatagcattagtcgagctgagaagtggttagagctaaaagaccatccagttaaagcggacaccccaaagcaggtgaaactgtcacgcctgtataagggtggtcacttcaagggttatgccctgagcgtggatggcatgttgctgtcgaaccagcagcaggtcgtgattgaaactcactctgagggtgttcaccccacactgaacgtaaccttcacggtaactgatgagatggcgggtgagggggtcgacatttatatttgatctcatcattgcatcatatcaagtgcaatggtcatggtgactgctaccctgagatgattttaatttaaatataaaatgatctcacaagcaatagtcacgtagggggaggggcgggtcaaatccctgccactctcgccccaagggaccgcctccctaagtctttttttatccccgcgaaaaatgaaatttaaatcgggagtcttttttatccctcttgccctgttttttgaatacgggaggttctgagtatggctggaacggcgggcagatcaggtcgtcgccccaagccgacggcacgaaaagaactggcaggcaatccgggcaagcgaaaactaaaccgggatgagccggcctttacgcccctgtccggggtttccccgccggactggtttatggaaaacgaaatgcctctggcggcggtgatgtgggaactgaccagcaaagagctgtgcacccaagggttactctgtgtcacggatctcgctgtactggaacgctggtgtgtggcgtatcagttctggcgcaaggcggttatcaatattgcccaacagggtaacacggtaaccggtgcgaccgggggacccattaaaaacccggaactgactgccaaaaaagaacagcaatccgaaatggacacgaccggctccctgctggggttagatcccagcagccgtcagcgtctgatgggcgctgcgggcaaggccaaaactgacaaccctttcatgaggatgatctcatcatgagccgtaaatcttaccccaatgttaatgcggccagccagtacgcccgtgatgtcgtgcgcggtaagattgacgcaggccgccatgtcaaagatgcctgccggcggcatctggataacctgagtcaggaaaagacgacagggtttaagtaccggttcgataaagatcgggctgaacaggccgccaaatttattcaattgctgccccacaccaaaggggaatgggcatttaaacgcatgcccatcacgctggagccgtggcaactgtttattatctgctcggtctttggctgggtgcataagggcagccggttacgccgctttcgggaagtctacaccgaaattccccgtaaaaatggcaagtccgcgatttcggcgggcgtggcactttattgctttacctgtgatgacgaattcggggcggaagtgtattccggcgcaaccacggagaaacaggcgtgggaagtgttccggcctgcgcgattgatgtgcaagcgcaccccgatgctggttgaggcgttcggcattgaagtgaatgcctccaacctgaaccgcccggcagacggtgcccggtttgaaccgctgatcggcaatcccggtgacgggcagtcgcccagctgcgcgattgtcgatgaataccacgagcatgacaccgatgatctttacaccaccatgctgacggggatgggggcacgccgccagcccctgatgtgggccattaccacggcgggttacaacattgaagggccttgttatgacaagcgccgtgaagtgatagagatactgtccggcaatgtgcccaatgaggagctgttcggggtgatttacaccgtggacgacggggacgactggacttcgccggacgtactgcggaaagccaatccgaatatgggcgtgtcaatctatgcggactttctgctcagtcagcagcagcgcgccctgaataacccccggttagccagcgtcttcaaaaccaagcacctgaatatctgggtgtctgcccgggaagcttatttcaatatgctgagctggaagcagtgtgaagacacgacgctcaccttagagcaatttgagggtcaaccctgttttctggcgtttgaccttgcccgtaagctggacatgaacagcatggcccggctttttgtccgcgagattgacggtaagcggcattactacagtattgccccgcgtttttgggtgccgtatgacagcgtgtacagcgtagagcagaccgagaaccgccgtaccgctgaacgttttaagaagtgggtggaaatggatctgctgaccgtgactgagggggcagaagtggattaccgttacatccttgaagaagccaaactcgcctgtcacctgaacccggttaatgaggccccgattgatccctttggggcaacgggtttatctcactcactggcggacgagggcattaaccccatcatcattacccagaacttcacccacatgagtgacccgatgaaagagctggaagccgctatccagtccgggcgctttcatcacgacggtcatcccatcctgtcatggtgtatcagtaatgtcgtggggaaaaccatgggcgggaatgatgacattgtgcgccccatcaaggagcaaaaagacagcaaaattgacggggcggtcgccctgattatggcgatgggccgcgccatcctgcatgaagaacccgactttctttccaacctcgatccggatgaccttttaatgttatgaaaaatttactgattgatggcactgcgctggcgggtgtcggggcagtgctggccggctgttaccttaagtatgggctggcaaacaccctgatcatcgggggcgttttgttgattgcctatgccctgaccgtcgcccgccggaggaaacatgttgcttgatgccctgttccgcagtgaatcgctggaaaacccgaagaccccgctcacggccgaggccgccgagcatgacggcctgttcagcgccgatgtgtatgtcagccccgaaacgtccatgaagctggcagcggtctatgcctgtatttatgtactggcctcgtcagtggcacagatgcccctgcatgtgatgcgcaagaccgggaaatcggttgagatggcgcgggaacatccggcgttttatctgacccatgatgagccgaacgactggcaaaccagctacaaatggcgcgaactgaagcagcgccatgtcctcggctggggcaatggctatacgtgggtgaaacgcaaccgaaaaggcgatgtgattgcactggaggcctgcatgccgtgggaaaccaccctgctgaacacaggtggacgctacacctacggggtctataacgacgagggcaatttcgctatcagtcccgatgatatgatccacatccgcgcgttaggtaataatcagaaaatgggtttaagccccatcctgcaacatgcggaaactatcggtatgggcatgagcggacaaaaatataccagcgcgttttttggcggcaatgcccgtccggccggcattgtgtccgtaaaaggggaaatcagtgataagggttgggaacggctcaaactgatgtggcgaaaagccgcggcttccctgcgcagcgaagagaacaaaaccatgctgctgcccgctgaattggattacaaagcgctgaccgtttccccggtggacgcgcagctgattgacatgatgaaactcaatcgctccatgattgccggcatatttaacgttcccgctcacatgattaacgatttggaaaaagcgacgttttccaatatcagcaatcaggctatccagtttgtgcgccataccgtcatgccgtgggtggtgaactgggagcaagagttgaaccgtcgcctgtttacccggcaggaacggatagcggggttctatgttcgcttcaatctggccggattactgcgcggtacaccgcaggaacgtgcgcagttctaccattttgctattaccgatggttggatgagtcgcaacgaggctcgcgcctttgaagacatgaacccggtggacgggctggacgagatgctggtcagtgtcaatgccgccaatcctgttaacggcaatcaacccaaccaacctgaacacgaggacaaacccgatgagtgacagagaaatgcgctgttacagcggtgaggtacgtgctgaacaactggaaaaccagccgacgcgcattgttggttacggttcggtgttcaatagccgctctgagccgttgtggggattcagagaaattattaaacccggcgcgtttgacgaggtactgaatgatgatattcgggggctgtttaaccatgatcctaattttattttaggacgcagtacagcaggaacattaacggtctcggtggatgagcgtggcttgcagtacgacatcgccgcgcctgacacacagaccattcgtgatctggtgctggcccccatgcaacgtggtgatattaaccaaagttcgtttgcctttcgggtcgcccgtgatggtgaacactggtacgaggatgaggaagggatcgttatccgcgaaatccacaaattttcacggctgtatgatgtcagtccggtgacctaccccgcctatcaggaagcgggttcggcggttcgatccctgaatgcttggaaagaagcccgaagcagcggtatctgccagaaagccattaacgaaaaacgggcgcgtgagcgtcttctgactttattgaatcgataggatgtgagtatgaaattgcatgaattaaaacaaaaacgtaacaccatcgccgcccaaatgcgcaccctgcatgacaaaatcggggataacgcgtggacagacgagcagcgcaccgaatggaataaagcgaaaaccgaactggacagcattgacgcccaaatccagcgcgaggaggaattacgccatctagaccagcaactggtggacaatacggagccggagcagcgtcaacaaccgggcaaccccgaaaccgagcaggcagagcgccgcgccgccgcatttgaccggttcctgcgtcacgggctgggggagatgagcagcgaagagcgtcaggcgttgaaagaattgcgggcacagggcaccacgccggacgagaaaggcggctataccgtccccacacggatgctcaataaggtggtggaggcgatgaaagcctatggcggcattgccagcgtggcacaaatcctcagcacctccaccgggcagaccatcgaatgggcgacggcggacggcacggcggaagagggtgagctgctgggtgaaaacacggcggccagcgaagaagatacgctgttcggcactgagtcactgggggcgaagaaactgtcgtccaaaatcatccgggtgtccaatgaactgttgctggactccggtattgatatggaagcctatctggccgcccgtattgcccagcgcatcggacgcggtgaggccaaatatctggtgaaaggcaccgggacaggcagtccgcaacagcccaaaggtctggaaacctcggtcacgggcacggtagacgcagcaaccaagtttagctggaaagacatgaacagcctgaaacatgcccttgaccccgcctaccgcaatacggggacgttccgctgggcgttcaatgacagcacgctgaaagtcatcaccgagatggaggatgcccagaaccgcccgctgtggttgcccgaaattgccggggtagtgccttccacggtattgggggtgccttacgtgattgatcaggcgattgccgacatgggggcgggcaataagttcatctattgtggggactttaaccgctttattgtccgccgtgtcacttacatgaccctgagacggctggttgagcgttatgccgattatgaccagaccgcgtttctggccttccaccgtttcgactgcattctggaagacacggcggccatcaaagcgctggtcgggaaaggcggcagcaacgcggcctgacctgaccggatgtgaccccatgccgcgtgaagcggttaatgagatggtccccaccaccctgtgagcggtatgctggcagggtgtttctttcaggagaagaccatcatgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtgataaaaagactttcaaccgtcttggcagagaacgaacttcctccctatctggcacagttgctgatgcgtttacatgcccattatctttatcttgtcgaacagctcaccgagcttgagacggcactggagcaggagctgagacgtgatgaaacaggacagcgtcttcagacaataccgggcgtgggtccgataactgccagcgtcttatcatcgcagctgggcgatggtaagcagtatggctgtagccgggattttgctgcttcaaccggtctggtaccacgccagtacagcacgggtggcaaaaatacgcttttagggataagtaaacgcggagacaaaaatctgcgacggttacttgtccagtgcgccagagtctttatccagagaatcgattatcagtcaggaaggctggctgaatgggtaaaggctcagcttgagcgaaaacactcaaatgttgtggcctgtgcgctggccaacaaattagcccggatagcctgggcaatcacaacacggcaaactgtgttcgaaaggtaacgacgacgccagtctgactggcaggttaatcgttaattaaagcagttcccaatctggttttgcgaagactgattattgatgacatgaacggcttatcgacctgatggaatcctgacataaaaaatggctctctgaagccgtgcggttttttaggcttatcaggtgcggaactcatcgaggcgcgggcatccctgcccatagtgacgccggatagatttaagcaagccaacatcaatcaaaaatcagtgttgcaaaaaaggtggggaccatagatttttaggcttatcaggtgcggaactcatcgaggcgcgggcatccctgcccatagtgacgccggatagatttaagcaagccaacatcaatcaaaaatcagtgttgcaaaaaaggtggggaccatagatttttaggcttatcaggtgcggaactcatcgaggcgcgggcatccctgcccatagtgacgccggatagatttaagcaagccaacatcaatcaaaaatcagtgttgcaaaaaaggtggggaccatagattttcatagcgggttgcaatacgccgatttcctttcagaaaaccgaaacagcgttcgaccacattccggtcacgataagcctgcttatcaaattgcgtgcgaccatcagtactacctttttcattgattttataaggaataatgctctttatcctcaattttcgcagataaccacggagttttccgcccgaatagcctttatctgccagtaccgctttaccgcgccgtttcatgaaaccatttttgcgttggacgccaatgccatcgagcaacggaatggcggattgactttcatgagcttgcccagcggtcactatcaggttgaggggaaatccctttcggtcggttgccaggtggattttggtgccataaccaccgcgtgagcgacccagcgcatgatcgtcagcgatatcgggatgttttttttcgcgcctgcggcatctttactcgcgcgaatattgctgccatccaggcaaatttcagcccagtcaatcaaccctttttcatccagaatggacagtaaacgattaaatatcttgttgataatgcctgattttgaccaacgattaaatcggttatagaccgttttccaaggcccatagcgttccggtaagtcgcgccacggtgcccctgaacatagcacccagaacatcccattcatcacacggcggtgttcaacatagggacgtcctgcccgttctgaatgaaccaggggcaaacaagattctatcaatatccatgcttcatcaggaatgtcgtagcgtgccatcatcttttcctatattgaaaaccgtttagatgataatactaccgatttacattaagggacacggcctagtgctgttattgatcctcatattcctggccacgcttggtataacactccaaaaacggatgcacgtttgcgttttactgatcccaaatatgggtttgtgacccctccagcccgattttttactgttatgtttgatgatggaataatcaatagcgtacgcatgtcaccacaaatcgagccattactttacgatgatgcgatcaaaattgtgttggatttacaagatcagtggcacaaagcgggttgggtacttaccaaagctcaagaacgcccagctttagccaacactccagaattgcgtgctcaactgcgtagtatgaaaggggggggctggaacaactttttggcaagtaggtgaacagtatcagataatgttaaatatagcgcttttccaagatgatgatcatcctgatgaagagcgctatttgatcacattgcagattgccgagccgtggataaagaattattcagactgacacagacgcgttgcgcttgtcttctccgtattacaggactaatacattaatccgataatacggagagcggcacaacattttaatgagttatcatacagtgatagtaaacggaattcggtcgaaaaatcgatacgagcaattgcttcaggtggaggtgtaaattgaatctattacgacgcttaggcctacgacgtggtagtttaatcatactactatccattgtttttggtctgacgattatctacctctatcatgccttttattcacgtgacccggagatagctctggtgattggcgaaccttacgaggcgatgcggcaacgctccagtgctaaaattagcccaccctatgataatagcatcggattcagaatcccaaaaacggatgcacgcttgcgctttaccgatccgaaatacggatttattaccccccctgcacgattttttactgtttcctataataaaggaatcatcgagaacgtgcgcatgtccccacaaatcgaaccactactctatgacgatgcaattaaaattgtgctagatttacaagatcagtggcgtaaagcgggttggactctgactctagctagggagtccccagccttggctaacacaccagaattacgtgccaaacttcgtagtttaataggctctgaagtgacttattggcaagcaggtgaacaatatcagatcatgttgattatggcacgttttaaagatgaccgacaccctgacgaagaacgatatttaatcacgctggcgattgccgagccgtgggtaaagaattattcagactgacgcgcttcgcttgtcttctccgattgaccgggctaatacattaccccggtcaatcggagcgctgcgcaacgttttgatgaattgctacataacaataaacggagtgtgatcgaaaaaacgatacaagctattgcttcaggacgaggtgtagaatgaatctattacaacgcatagatatacgacgtggtagtctaatcatagtattacccattgttcttggtctgactatcatctatctctataatgctttttattcccgtttcccagagatagctttagtgatcggtgagccttacgatgagatgcgacaacgatctagtgccgctattgatcctcatattccaggccatgcttggtacaacatcccaaaaacagatgcacgtttacgttttgctgacccaaaatatggatttgtgactcctccagcccgattttttactgttatgtttgatgatggaataatcaatagcgtacgcatgtctccacaaatcgaaccgttactttatgacgatgcgatcaagattgtattggatttacaagatcaatggcgcaaaacgggttggatgcttactaaaggataccaacccttggctaatacatcagaattacgtgcccaacttcgtagcctaagaggctttgaagcgacttattggcaagtcggtgatcagtaccaaatcaaactggacatagggcgttttaaagatgacagacatcctaatgaagagcgatatttgatcacgctggcgatagccaagccatgggcaaatcaataacgcaaactcaacggtgtgtgagaatattatcttctcacacctctttcaggctattgcttaaggacgagatataaaatgggtttgttacaacgaataggccaacgacgcagtggtttaaccttcgctttattaattgttctaagtctgacaggcgtctatctctaccattcctttaattcccgtgaacccgccgaaatagccttggtgattggcgaaccttatgaggcgatgcggcagcgctccagtgctaaaattagcccaccctatgataatagcatcgggttcagaatcccaaaaacggatgcacgcttacgctttatcgatccgaaatacggatttattaccccccctgcacgatttttggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgacccgattttttactgtttcctataataaaggaatcatcgagaacgtgcgcatgtccccacaaatcgaaccactactctatgacgatgcgatcaagattgtactggatttacaagatcagtggcgtaaaacggggtgggtgctgaccagggaataccaacctttagtaaatacaccagaattgcatgatagccttcgccgtatgaaaggtactggaatgaccttttggcaagcaggcgatctatatcaggctatgctgaatatggcgcgtttcaaagatgatcggcatcctagcgaagaacgatatttgattacattgcagattgccgagccgtgggtaaagccataacgtaatctcagataggtgtgagaatattatctttcacacccactattcaggatattgcttcaggacgaggtataaaatgagtcttttacaacgcataggtcggcgacgttctggattaatcttcgcattattaatcgttcttggtctggctagcgtttatctttaccattccttttccgataaaccagagatagcgctggtgattggtgaaccctacgaggcaatgtggcagcgatccagtgcagatattgctcccaaataccctaataacatcgggttcaacacacctaaaactgatgcgcgtttacgttttactgatccgaaatatgggtttgttacccctcccgcacgattttttgttgtgcggtatactgatggaataatcaacagtgtacgtatgtcgccacaaattgagccgttactctacaacgatgcgatcaagattgtattagatttacaagatcagtggcgcaaaacgggctggaagctcactaaaggataccattccttggttaatacaccagaattgcatgacagtcttcgtaagatgaaaggaaccggaatgaccttctggcaagcaggtgacaagtatcagatcatgctgaatatagcgcgtttcaaagatgatcggcatcctgatgaagagcgatatttgatcactttagcaatagccacaccgtgggtaaatcagtaaagtaaactcagatgggtgtgagaacattatttctcacactcgctatttagaacgatactgacgcgctgcacttgtcttctccgagttaccgggctaatgaattcacccggtaactcggagaatcgaagaaacataatcgttacgattggttatctctataccactacacatattttcacgggataacggggtgaatagcatatttattatatatttcatttagttactctatcccatattatcccagcatatcccgtaatagtgtgtcactactttaaattcaagatattaatacctaccagagagaaattttttttcgggataacctccattgttataatatttatttttgtaataacactacgttacgggatatactgggataacacgggataattaaaatatttataacttattgatatagtttaaaataaatctctcttatcccaatatcccgttatcccaacgtttttttaaccctaagtgagagtcaatcttcatccctgaaaatcagcaccacaaatcgcccctgagtgccgtttactgaaatggttttgctgataaagcgatctttttccgctttaaccagcattccggcttcttctaaggcctcaaaaccggatttcttctgtaatccctgcaatatctctgcttcaaatacactgggaataatgtggtattccgtttgcccatcattacgacggttatgcaccagatacccggcaagatcgctaattctcatggagtgtgatgtatcaatatcaccatttggcctgccgtaggtataaggttggaagcgtgaaagcccgtatttttggataaagtcacgagtacgggtgataacctgatatttttcccgatttccgatgccaaaatcagctaaccaatcatcgaaactttgctttatcgccgcatgactcgcttctttactccagccggtaatatggattgccagctctccggcagcatccagtaacgcgaaacgaacagcaacgcgcttgacttgggctgaggcttcttctggcaggccatcaagccactctttttctttacgggcggttacttcgattacctgctcctgatttacagacaaccattgaacccatgcccgacccgctgcaccacaatagcgtttggattcacgtttgatggctcttgcatgagaatcaccatcctcatagccattgaaacattccgtatcaataaagggcacactgagcaacctgacaagctgcccggcttttggggtgatcccaccttttatcaggaacgtttctaaatcttcctcgcctgttgaaagggcggcaattttccagcggatcaccgcgcggttcccgccttcccgttttccctgaatcttaccgacaccgttgaacaggctgtaggcactgtttgcgacttccttcggattcgaactttgccctatttcatcaatgggcatgaaaccatcattacgggcagcggcttcattatttaaaccgtggttagtaccgtgccacgataatttaagttcttcgggatcaccgtataagctgctggcagcctcaacggtggtggttttccctgcggaggattgggcgaatgaatgcacaccaaagcagctaccacctgtcagtgagttaagtggtgcagacaatcccaccagtacgcccagcatcattgaccggttgcctttcagtaatgacgcaacgtgcattttccactcttcggctgttcctctgaccacataaccggcaattgcggatgtaccgccactgaatgccacgggcatatagggttggccgatgatttcaccgtccggcatcacatacgctccgcagtgccagcccgctttctgcgtcacaatccattcacggcgatcaccgctgcgttgcagatgttcagctaaaataggcaacaaactgttttttacggtgatattcattccccgcgagcgcaatcttgcccagccaaccggcatcccgatttcacggcggggaaatgcctcaacaatatattttcccgaaccttcctggcgtagcttgataatgagatagccttcgctgccatcattgccaatgccgactatctccatgtaatcactcaaccatttttcaacttcgacgatttcgccaccttgctctttaggttcaacccagtaaattccgttcttgcgaatatcgatatggggttttagcggatcgtattctttctctcggtattcatctgaattagcggtcacagattttgacaccgctacgttctctaccacctgatacaacccattactgaatgtctgttttgctgactcaatgccatgctgctgacgataatcatcccagtcagctttgtattccgtggagggcaacgtaacccaaccattaaccgcaagagcaactttttctgctgaaatcttgccgatatttacctttgggttgccgtttttatccagttcgtcgggatgatgccagtcgttatctgctgcaataataatttttgtctctggccagcgttccctgactgattgagcaacggagagcagattgcctgcgtccagtgctgccagaacagcgccgttacagagttggttaaccgtgagtgccgtggcgtaaccttcggtaatgatggctgtgtcggggtgttcttccagcgctgacagagcgataaacgcacctttcttctggctgccagtgagtaattttttctcaccatccggtttgatgatctgcgcacctgttacttttttgtccagtgttgcgagccgcaacactgctgaattatcgggcaacaacctctgattagggcaatgcagccctttggcggccagatagggagattgtccggcaacagtttgcgccatcagagctgccactctgtcggcaatcggctgtgttgtttgaatgatttttctggctggtttaggttcgggcaaaggtaatgccagtacatccgcaacgattttcgccgcctcagtaatagaaattcctttggtttttgctaccaaatccagcccatcgccatagttcggaatgtcacactggcggcaatgccagttgccgtaatggtgatcatcaataaaatgaaaacggtcggtgccaccgcagatcgggcaagcgccatgtttacccttggccggaatatcaatgccacatgcaggcagcagattttcccaatgatacatggcggactttttcacggtctgaatcagatcgagcgctttttgacgagcggtcttatctgaaagtgtaaatttagggtgagtttgggtatgctgtatatcagccatcatcgttactccatataacggttgttggtcagacgcctcagatgtgtaccagcacactggggcgttgtttttttatattctgtttattatgttatgttcttttctgtgctatgccgctcgtgatcctgcgatccgctgcgcaatccagttatcaatctctgattcaataaacgcgatggaacgggagccgagtttgatttgtttcgggaattctccatcactaatcagtttgtagatccacgccttgctataacccgttctgcgctgaacttcgggcaaacgaataagattttctttcggtgctgtcattgtcatattatttatctcctgttaccgagtccttgagcgctcatcgtggacgttgtttgatgacaggcggattatttaaaaagcaagattaaatgaacagcgttaattgtttactccatttgtgaaatttatcggtttacagggagtatcagctcccgaattgtattctgtatgaaaattagtcaccgctggagcctccaacacagaataaaaaatcaccacacatcttaaattgtatgaaaaacaggctattgtgccccgggcacaggtgtgtgaaaaatcaccgcatctttacgcccttttgccaaattttccgatcaagacattttcaccgcgttccagcatctccatatggtctgcataccattgcagcatttcccttcgcccctccagatattgggcgtgattgtaagttccccggatgctgttcttatccacatgggcaagctgggtttcaatccaagccgtgttatagccttgttcatgcaggatagtactcatggtatggcggaagccgtggccggttgctctgccatcataaccaatgcgtttaatcacctgattaatggcggcctcgctcatcggtttacccgcatcattacgtcctgggaaaactatttcccacgccctgtaatagagtgcagtttgataagaatggctttaacctgattggatagcggaacgatgtgaggacggcgcattttcattcgctcagcaggtatctgccagatatccttatcgaaatcgaattcagtccattctgattctctcaattcgatggtacgcacaccagtaagcatcagtaaacgtgtcgcggattgggtcacttcgcttccgctataacccgccaaggcgacgaggaatgcattcatttgatcagctaaaaggtgtgagaagtgtttttgcttcggtgctttaagtgcgctggcaagatcagtaacgggattgaactcagctctccctgtaatcacggcataggtgaaaatttgccgacaggcctgtctggtttttttcaatttatccaaaacaccgcgttgctccatttttcggagcacagccaacatttcggcgggtttaatctcggtaacggcacgtttaccaatatacgggaagatatcttttttcagatattccaaaatgtcttcggcatacccttttgaccagttggggcgtttatgttcgtgccactcaatggcgatggattcaaaactattgctgaccgcaaacgctttggctgctttttcagctttcttttcttctatcggatcattgccatccgatagcgtccgccgggcttcgtttctcttggttcttgcgtctgagagggagatatcaggatatacccctaatgcgagtaatttttctttgcctgcgatccggtacttcaaccgccaatagcgagcgccattagggttaaccaataagtatagtccgccaccatctgcaagtttatagggtttttctttcggctttgcagtgtccacctgccgggctgttaacttcatttgggggtatctcacttcgttgaacctgaacgtacccctaaatatacccccataagatcgtggatttcaacctacctgactggactacagaagaacggaaaaaggctaatactgcgtatttattggggttttatggactttggaagacgttgagatatgaatggatggtacgccctacaggattcgaacctgtgacctacggcttagaagggcaaaaacctttgatttcactctatttcttacaatttcacttggtttcatcattttgatttaaaacggattttatagcttgaacagtttcatgtagttgcatatcatttcatcataacttgacccgctacttgacctgttatgaaggatatatctaatggctagtaccttattgactgacagtaaaatccgaggtttgaaacccaaaaactcagcttattatacatggcaagcagcagcaacacgaggaaccgggaggttaggagttaaaacatatccatcgggaagaaaggtctttgtctatcgttattttaagaatggaaaagaaaagttcataaacctgggtgatttccctgctctttctttggcagaggcattatccaaatcacgagatgccgccgccaatgtttcagcgccagaaaaagccatcataaatcacgccacaattgaacagctattcagcgactatattgccgaccagaaacgccgtggcaagagatcttatgataaaacccagtacaggctaaatcaggtattagatagccagcacattgatagaaatacgccagcaaaagatattaccccagaccacattaaaagggtattagctgaatttatctcacgcggtgctgttgctggctcaaataaggttcgtgccaatcttcatgctgtatttaactttggtctgttcgctgacaatgatcctgccaaactgaacgagaaagttatttatggccttgaccgaaatcctgtcaccgtcgttccacgccaagaaggagcagataaagccctggatagatttttatcttgggatgaaatgaaagagattctaaaattgtttcgtatttcgtcgacagtattcccaatccatcctgattatggtcggttaatattgctttgcattttcacagctggacaacgcccttgggaaataatgaccaatacaaaagataactgggataaaaataataacacgctgacagtgcctcttcatatttcaaaaaacggtgattaccacgtcattcccttgtgcgagtctgcaactgaaatattagaatgccaagccaaacaatatccagattcagagttcttgtttcccggagacactaaagaaggtcatttactcactgctgaatatgccaagcagatccgcaaattttgtgctcgctatgattttgaaaaatttacaccaagggatatcagacgaacctttaagacgcttgcaggagagatggggatcagttctgagatgagagacaggttacagaaccataaaaaacccggtgtctcaaccaaacactacgatcgctacgactatctgaaagaaaaacgggaaattatagcgcaatgggaaagtaaattactatcactatagggcagaaagctgccctttgcaatccgggcagttatctaacaaagttgagatttggattgacttaatccttatattgctaaatatgccaaatattaatttgtctgtttccatttaggatttagctcatcgcaatatttactttcatttgaattaatagcttatgtttatatattcaatgcaaatatatcattgttattattgtttttttaaataaaaaagacagaaaataaaaatctatggtccccaccttttttgcaacactgatttttgattgatgttggcttgcttaaatctatccggcgtcactatgggcagggatgcccgcgcctcgatgagttccgcacctgataagcctaaaaaaccgcacggcttcagagagccattttttatgtcaggattccatcaggtcgataagccgttcatgtcatcaataatcagtcttcgcaaaaccagattgggaactgctttaattaacgattaacctgccagtcagactggcgtcgtcgttacctttcgaacacagtttgccgtgttgtgattgcccaggctatccgggctaatttgttggccagcgcacaggccacaacatttgagtgttttcgctcaagctgagcctttacccattcagccagccttcctgactgataatcgattctctggataaagactctggcgcactggacaagtaaccgtcgcagatttttgtctccgcgtttacttatccctaaaagcgtatttttgccacccgtgctgtactggcgtggtaccagaccggttgaagcagcaaaatcccggctacagccatactgcttaccatcgcccagctgcgatgataagacgctggcagttatcggacccacgcccggtattgtctgaagacgctgtcctgtttcatcacgtctcagctcctgctccagtgccgtctcaagctcggtgagctgttcgacaagataaagataatgggcatgtaagcgcatcagcaactgtgccagatagggaggaagttcgttctctgccaagacggttgaaagtctttttatcacggcggttccgatcggcatactgatgccaaattccagtaaaaaagcgtgcatctgattagtggttttaaccctgtctctgaccagtgattctctgacccgatgcagggcgcgcatagcttgttgcgcctctgttcgtggttgcacaaatcgcatggagggacgagatgcagcttcgcatatggcttcagcatccacaaaatcgttcttgttgctctttacaaaaggacgaacaaattgtggagaaatcagcttcgcttcgtgaccaaaagcagcgatccggcgagccataaagtgagcaccggcgcaggcttccattacaacagtcgctgatggcgatcccgctaaaaactccatcagtctggcgcgggtaaattttttacgcagcagggcctttcctgatttgtcctgacagtgaacgtggaaagaatgtttgccgagatcaataccaataagcgtaacgttttgcatgatggtcttctcctgaaagaaacaccctgccagcataccgctcacagggtggtggggaccatctcattaaccgcacggcttcagagagccattttttatgtcaggattccatcaggtcgataagccgttcatgtcatcaataatcagtcttcgcaaaaccagattgggaactgctttaattaacgattaacctgccagtcagactggcgtcgtcgttacctttcgaacacagtttgccgtgttgtgattgcccaggctatccgggctaatttgttggccagcgcacaggccacaacatttgagtgttttcgctcaagctgagcctttacccattcagccagccttcctgactgataatcgattctctggataaagactctggcgcactggacaagtaaccgtcgcagatttttgtctccgcgtttacttatccctaaaagcgtatttttgccacccgtgctgtactggcgtggtaccagaccggttgaagcagcaaaatcccggctacagccatactgcttaccatcgcccagctgcgatgataagacgctggcagttatcggacccacgcccggtattgtctgaagacgctgtcctgtttcatcacgtctcagctcctgctccagtgccgtctcaagctcggtgagctgttcgacaagataaagataatgggcatgtaaacgcatcagcaactgtgccagatagggaggaagttcgttctctgccaagacggttgaaagtctttttatcacggcggttccgatcggcatactgatgccaaattccagtaaaaaagcgtgcatctgattagtggttttaaccctgtctctgaccagtgattctctgacccgatgcagggcgcgcatagcttgttgcgcctctgttcgtggttgcacaaatcgcatggagggacgagatgcagcttcgcatatggcttcagcatccacaaaatcgttcttgttgctctttacaaaaggacgaacaaattgtggagaaatcagcttcgcttcgtgaccaaaagcagcgatccggcgagccataaagtgagcaccggcgcaggcttccattacaacagtcgctgatggcgatcccgctaaaaactccatcagtctggcgcgggtaaattttttacgcagcagggcctttcctgatttgtcctgacagtgaacgtggaaagaatgtttgccgagatcaataccaataagcgtaacgttttgcatgatggtcttctcctgaaagaaacaccctgccagcataccgctcacagggtggtggggaccatctcattaaacgccccagtcaaaagaaatgactggggcagctaatattcagctaaatccgattacgtgaagtaaaaggtctgaaagatagaacatcttacctctgtaccctacgcgaataactctaccctatttttttcactagaaaaagattttttttgtaattaattttcatatgatactgcgattcagtcgcaattatttcgctaaatcgggtcattacatcattttttatgtagtttaattacatatttgtgagatctagatctaatctcaaacctaagctaaattcttgttacaagccctttcgcggcattatgcggataatttcaggtcgttaaataaacagtcattccatcaaaatacctcaataaaaaattatccccataaaattctgcaccataacaaaaaagccactttttttgcggctattttgtttacttttcagatttttgactgaaaagtggctgttttcatccgttaatcagtgagcttgatcccagttgatcccaattcccacatccacttttaacggcacatcaagctgcatacttttttccatcaactcactgattttctgctccgctgtcgccagttctgattcatgaacctcaaataccagttcatcgtgcacctgcataatcatacgtacatttggctgctcactgacgatccaattatccaccgcgatcattgccaatttgatgatatctgccgccgttccctgcattggagcgttaatcgcctcgcgttcagaagccttgcgacgcatggcattgcgcgatttgatatctggcaggtaaagtcgacgcccttccaacgtttcaacaaaaccatgctcagccgcctgctggcgtgtacgttccatataggccagcacccccggatagcgttcaaaatagagatccatatagcgttgagcttctccgcgtggaatacttaactgacgggataggccaaacgcactcatgccataaatcagaccaaaattgatcgctttcgcactgcggcgctgttcgctggtcacttcttccaatggcacgccaaagacttcagccgccgtcgcactgtgaatatccttaccctgcgcaaaagcctccagcaagcccttatcctgtgacagatgcgccataatccgcaattctatctgcgaatagtccgccgccatgatgcaataaccttccggtgcaataaatgcctgacggatacgtctcccctcgtcattacggacaggaatgttttgcaggttaggatcacgggaagaaagacgcccggtcgctgtcactgcctgatgataagaggtatgaactcgtttagtgagcgggttaaccatctgcggcagcttgtcggtataagtggatttcagttttgccagaccgcgatgttccagaatcacccgcggcagttcatgattatctgccagttcttccaacacttcttcattagtcgatggcgccccatttggcgtctttttcaatacaggcaggttcagtttttcaaagagaatgacctgcaactgttttggggaagccagattgaactcttcaccggccagttcataagcagctttttccagttctcccagccgcgcagtaatttccgttgagtgttcagccagagtttgggcatcgatcagcacaccggttcgctctatgcgagaaagcactggcaccaagggcatttcgatgttctggaagacgcttttcaacgtcggtacactgtctatctgtggatacatgacttggtgcagccgtaaagtcacatccgcatcttcagccgcatattttgccgcttcttccagcgggatttgattgaaggtaagctgttttttgcccttgcccgcgatttcttcaaaagttgtggttttatatcccagatgacgatctgccaggctatccatatcatgccgtccactcacactgttcaggacatacgactccagcatggtatcaaaaacaatgccattcaaagcgacgtcataacgtgccagcaccccacgatcaaatttcaggttttgcccgattttaggcaggtttgcatcttccagcaggggttttaatgccgccagaacttcatgcagatccagttgttctggtgcatcgaggtaatcatgccccagtggcagatatgccgcttcaacctctgattctcccaccgcaatagcaaaagacatgcccaccagattaacggtcaaagtatcaaggccatctgtctcagtatcaaaagagaaggctggagcctgtttcagcttcacaatccactcatcaagggattttcggtcaaggatagtttgataattttccggcgaaatattgacagctgccggagcgctgctgatagtggctgatttagcagcagagactgtcgcagcggatttttgactattaccttccaaccaactgccattctgtacatcgctcaaccaacgtttgaattcataacggctgaacagcgccaacagctcatcactgtcaggggctgtaaccgcaagctccagacaggttttatccagctcaacatccgttttaatcgttgccaattgataagaaaggtaagccacctctttgtgctgcgccattttcccactcagcgttttagcgccacggaagctgagtgtcgcgatctcatcaagtctggcatagatatcatccagactaccgataccctgcaataatcccagcgctgttttctcaccgacacccggtacgccgggaatattatcggaggagtctcccatcagagcgaggaaatcgatgatcaattcaggtggaacaccatatttctcagaaaccccttccggccccagaatggtgttagtcatggtgttaatcagcgtgatataaggcgtaaccaattgagccatatctttatcgcccgtactgatcagaacagaacgcccttctttttccgcctgcaatgccagtgtaccaatgacgtcatcagcttcgacgcccggcacaaccagaatcggcagccccattgcctcgaccattttgtgcagcggctcaatctgctcacgtaaatcatccggcatcgggggacgatgagatttatattcagcaaataactcatcacggaacgttttacccttggcatcaaacacgaccgccacatgactgggtttatactggatgattaagctgcgcagcatattcaggacaccatacatggcgcccgttggttctcccgcactattggtcagcggaggaaacgcatggtatgcacgataaaggtatgaagaaccatcaaccaaaatcaggggattgtctgctatctgtgccataaaattttcttcgtcgttctgtgggatgattaaagaatagaatgccatattgtgtcgttatagacgaattttgcgataattttctcgtgctgacaggctttttctgacaaatattctgatgaatgaattgtggataactttgtgcacaaaaaattggcacataaaacagatttatgtttatccccctaaaaaatgagcaacaggaggtaaaaatcaatggattacgcggagtattaaagaaatattacaatgacttaaaaatcactgacttgtggatataaccaaagtttatgttatgaaaggggcttttcagcaagtattgtgccagctttattgtgactggcacaatacacatgttattttatattaatactaacgtgcctgtttaattacagccgtggcttccgactcatttttttgtcaccagataattcactacatcagaaaaacccttggcatacccagccattgtcgtcgactcaataccatcatttttaacctggtacttgccattcacataaatagcaggaacgccttgaagttgcagactgctgacggcctgacgctctttggctgccacagacttcacgataaagctgtttaacgccgcatcatactcttcacctgacacacccgccttgataaaagcactacggatatcggccttactattgatagtatggtttttctggataccctcaaacaaaatcggggagattttatcctcaattttcatgacaatggcaaccgcccacgcatctgtcaaatctttccccaaaggcccgataaaatcgacgtggtaacgctcatgagtgacacctgctggcaaattcttctcaacggtactaggaacatggtaaatattttcaaactggtaacagtggggacaataaaaggagaaaaattctaaaacctgtggctgattagccactggattttttaattcaacgtattgtttatcttcagaaaaaccagaggcactggcattaaatgccataaatattcccaccagtgctaaccaaaatgtcttcataatgttctccagtaaaattaatacatcggatttagctgtaaaggtgattcctgtaacagccgaatttgttcagaaaaaagactaacttgaccatgccagaagtcgctgtcggccatccacggaaaagcttttggaaaagccgggtcttgccagcgacgggcaacccaagccaaataatagaccattctcatcgcacgaagtggttctatcagtgccaatgtctttggatcaaaatccgtaaactggctatatgactcaagcaggatatccaattggatcaagcgttcttgccgtgagccattgagcaacatccacaaatcctgaatcgccgggccattacgggcatcatcaagatccacgaaccatgcctcatcacgccacagaatattgccggcatggcaatctccatgtagccgtatctgcccatcaaaataccatgctccttccaccgtttgatttaactcatccaacgcagcaaagaagacttttttatgtttagccggaattaatttacatgcagataaatagtggtatggctgatataaatattcatctaagccaatggttggacgggaagaaaatattttctggcgaccaatctgatgtatttgccccagcaatcgcccgacaccttccaactgatcaaagttatcagattcatactgacgcccacccacactggggaaaatggcgaagaagaacccaccatgtttcagtaccgtctggccggcaaacaccagaggcgccgcaactgacaaatctgcctgctgtaatgccagtgcaaaatcatgctcttcttggatctgctgctgactccagcgctgtggacggtaaaatttcacgacataacgtttacgattttcatccataaactgatagacgcggttttcatagctattcagttcagttaagccagaatcaatatacagacccgactgcaccaacgcatccatgattaagtctggtgtaatattctggaagttaaaagccatttgttccgtcacaaccctgctctctcttcattaatctttaataatgcctctggtacgcagcaaagcagtcttaaaattttcttcatttttaattccttataaatggctatacaaattagcaaggataatgatttagagaaagaattggtctgtcaataagcgtaaaggttatactcccctccatgaaagcattgttacatattgatttacaaaggttataaaccaaataattgaatatttcattgccaaatatcaggtgagttaacatgacgcatccaaaaatgagtggcgcaattctggccggaggactatccacccgcatggggggagatgataaaggattactgcaattcgacggcacaccattataccaacacattgccacaagattgcagccgcaggtgcaagagctgttgattaacgccaaccgtaatcaggcggtttatcagcagagtggttatcccatcataccggatatcatcaccgatttttctgggccgctggcaggtatgctggcagtattgaagaaggccattcatgaatgggtgatctttgtcccctgtgatgtaccagatttccccgatgaccttgtggaaaaactgtggcgttatcgtcagcattcatgggcagtttatgtccatgattgccaacgtgcccatcccacactggctttaatgcaccgcagcttgatcccccgactggaaagctatctggcattgggagagagaaagctgatgttttttatgcaaatgattaaggcaaaagcggtttattttccctatcccagcgccttcaccaatttaaatacaccggaagaataccagcattgggaatattttcaggagtcagcatgaaaccaacgacattgccgctgctcggcatcaccgcctacagtggaacaggtaaaacaacactgctcaaacagatcattccgctattgcgccaacaacatatccgggtgggattgattaagcacactcaccataatatggatgtcgatcaaccgggcaaagacagttatgagctgcgtaaggcaggagcagcacaaacgttggtcgccagccagcagcgctgggcattgatgacagaaacaccagacttgccaaagctggatctgcactatctcgccagtcggttcaacgctgattctctggatctggttctggtcgaaggcttcaaggaagaggccattgcaaaaatcgttctctatcgccacggcctgaatgttgcctttgatcagatcatggatacccatgttattgctattgccagcgatatcccgctggcaacatcgcttcctctgcttaatatcaaccagccacagcaggtgacagcatttattgtggcatggttgagggcaggcagcgctagcaagcctggctaagaaccatcagaactggcagataaggaagaaatgtatttccttatgaacacatgtaatgtacggcgcttccgacataaatgaagctgatgagagttgatttcagaaatcatcactaggaatagagataagcaacgaaactttttggataacagcccacaaattatgttgtaagttgcatatattatacagaattgtccagtttatccgtgctatttatcttccggtattaaaccaataaaagaggtttttttcttggctcggccattaatgctccaattatatataaaataaaattaacactggcgattccatataataagtgcaacaccattattatcgaaaataattaattaattatgtgtatttcttctttttttaattccatatggcatgatttttttaaatattctcaaataagtttgtttcaccaatattactttcatgttgaaaatatccagatctgtactatgattttattatgaataaattctaattatattttgctcttgacgcttattgaaaatttgtttttgttgttttttataaaacaagtctcagtcaaagacaaattcataaattatgctaattttttaacaaactggaatctgggagggcgatgaaattacgtaataaagattaaaatgtttattgctatattaaatatgacttaactattatttttttctgacatctaatcagaaaaaatatttaagttttaaattaatctttctcgatttataaatctgggggataggatgaaaaaatcattatctactgaatcagaatcttccttgcttgttggaaaaggactgaaaattatcgaatctttatctgaggaaacagcagataggttaaagcacaaaacgacagatgattcgatcacaaagttatctgaatcaaacacacatatatattatgaggctactttgtccttagttagttactttttttactatacatgtaccctagatgttcaaggtgcgaaaacattttacggaaaagcaggaggaataggatctgtgggaaaaggaaaattttccggtgagtttttttttggtacgaatgatattaatctaatttatcagaaagcaacattctttgttgcaatgataacacctttaactataagtatggcttttctagatccacctatagataaattggcacagtttaacggatccggattaggcacgatatctgccacaatcacaggagcgggttattgggaataacatacaggattttaagcgattactctttattttagatagaaaaaaggcttcatttgtgatttgataatcggcaccaaaccatacatcaaaaccacgtaatgaagcctatgacgacgattatcacgataaagaacccactaagacaattctttagttattattttatctttagctaacccattttctcgccagagagtttatctgtaaatcagaaaaaatatttattctatttctctgttacgtttatcaaatatattcatactttaaaaaataacacgttgatattagcaaataaccgctaatttgccgagtgattccatatggcagacatattgcacatgaaattctatatcatcattatgctgttccgacttttctctggcatgctctatcattattattactcccctgataaacagataatgataatcgctccgattttctactatgcagttgaagggggcttcatatctttatgaatgacatctaattttacttgatgatgccaatggtacataaagctaaaaattcaaaaaagtgcaaatatgagcagcattaagcaactgcattttcagaaaacagcccacagattatgttgcgggctgtgcatatatcaatcatgttataacgctatttcccttccggtatcaagccaataaacgttgtttttttccttggctcggtcatcaacgcttccaatctctcgacacaacgcaagtaatgaggtgtttttttatgggcagccactgatgcttcatcggcataagcttcataaacataaaagcgggtcggaatattttcatctctcagcacatcaaagcgtaggttgcccggctctttgaccgaaccaaggtgattatcgcgaaagacctcgataaattcgtcgagcttgtcggctttaacgttgatttcaactaacgtgacttgcatattattcccccttagccttttcactcaggaacaattcataagcctgtgctggcttttcattgtgatgaaccaccgcctgaaccgctttcagcatggctaccggcgcttcggactggaagatattccgtcccatatcaacgccggacgcaccctgatcaatcgcttgatagcacatctccagtgcttctatctctggtaatttcttaccgcctgcaatcacaatcggcacaggacagcccgcggcgatccgctcaaaaccgctgtcaacataataggtcttgataatattcgcccctatttcagcggcaatacgggtcgccagtgagaaataacgctggtcacgcgccatatccttcccgacgcctgtcacggccattgtcggcataccatagcgcattccctgatccaccagcttgatgatgttcttgatggattgatgttcatgctcagaaccaatataaacttgcgccgccacagcgcatacattcagccgaagcgcatcttccatcgctacagccaccgcttcattggataactcagtcaaaatcgaattagcgccggatgcacgcagtaccaccggcttattggttgcaggtggaacctgactgcgcagaataccgcgggtacacatcaatacatcagtgtgctcaaacagcggggcgatattgatatcaatacgctccaatcccgtagtcggcccctgaaaataaccgtgatcaaacgccagcatcaccgttttattagtcgttggattgaaaatccgcgacaaacgcgactgcattccccaatccagcgcaccgctgcctttcaattcaaacagagtgttcttttgtggtgtatcaataccaaaatctttaccgtctttgatgtcatctaaatctgccatttctctctccagaaggtgtcagcccataaattagaaatcgtattggttgatgttttcgctggtaaaaattacacgctccggcatcacaacaataccgttgcctttcgcttcgtagcggtatccctgtacgctgttgggtgagatcgccagtttaccgatatctggaatatctaactgctcccctacattcagatcgccttttttcagcatttcattggcaacatgaatggctatcttgccctgcttaacgacatcccacaggccgaactgtttgaccgtgccgttttcaacgtaaggtcgcatcacattcggcgtactgaacccgacgatcgctatattccggcgtttcaggttttccgcggcctgtgcagcccgcgtataatttccactaactgcttatccgccacattcaggttgccagcaggggtattcagatccatcgaacaattcagctggttcagtaattgctgcatccggcttttgctgacctgatgtttaggcagacggaataaaatgttttcctgaacaaaaagactgggaaataacaaaggttcctgtggcaccagatagatgcccaattgatgcgcttagcaggtgtcagatgactgatagtacgaccatccagcatcagcgtcgattgacctgcgccattgccgccgagcaaagcatgaacctgccccgcaatcagggtgaaatcaatatgtttcaataccgccagaccggaaaattgcttactgactccacgaaccgccaaaagagggacatagcaattgaacatttatcaatttaaaatacttttgttcacaactctaattcataatctgaagtttttgcaatatttccatcacattttgtgaaaaaatcagatctctatcaaaatatgttcaaatttttgcgatcgccctctagcacatcagaggcttttatgcttaattctttgccagtggataaacaagttgttatgtcgatcaaaccaaccaagaagcaatcagtatcagagagaagcgggttatccgaggaactttcttattcagataataaccattcaggtcatggctattcaggaaacagcatgagtgaagaagaactactggctcgcatagcctggttttactatcacgatggtctgactcaaggagacatcggtgaattgctcggcctcagccgcctcaaaatctcccgcctactggagaaagggcggcagacgggcgtgatccgcgtgcagatcaattcacgctatgaagggtgtctggaattggaagatacgctgcaaaaacgctttaatctcaagcaggttcgtgtactgccggctcttgacgaaataaatatcaacacccgtcttggcgtcggcgctgcccacctgctaatggcactgattgagcctagtcagctactggctatcggatttggcgaaaccccgatgtgtactttacagcacctgagtgggtttatttcgtcccaacaaatccggctggtgacgttgtctggcggcgtcggaccttatatgacggggattggtcagcttgatgcagactgccctgtcagcatcattcctgcaccgctgcgggcgtcaactcaccaagtcgccgctacgttccgcgaagaacgcagtgtgcgggatgtgatcctgactgcctgtgccgcagatatcgccgtggtgggaatcggagcgatcaaccagcgacagcaggcgaccatcatgcgttccggctatatcagcgacggagaacaattgatgtttggccgcaaaggcgcgattggggatatcctcggttatttcttcaatgcagaaggtgagctggtcagccatatcgatatccatcaggaactgatcggtatctccctgccagaactgaaaacgatcccgaatgtgatcggtgtggcgggtggtattgaaaaagccggtgccatcattgccgcactgaaaggcggctatattagctcgctggtaaccgaagaacagaccgcaagagccatgctgacgtaatcgactaacactgcttatccatcccctgtgccctatcgaataaaaagataacgacagacgaggatagcatcatgaatcaacgcgctcacgctcacccatcagggaagtatctgatggcgcttgatgcaggaactggcagtatccgtgcagtaatatttgatctcgaaggaaatcaggttgccgttggacaggctgagtggatacaccagcctgtaccgaatgtctcaggttcaatggaattcgacctgaaaaccaactggcaactggcgtgtcaatgtattcgccaggcactgcaaaaggcggaactgcctgccagtgcgattcagggcgttgccgcctgctcaatgcgggaaggcattgtcctgtataatcgcagtggcgatcccatctgggcctgtgccaacgtcgatgcccgctctggccatgaagtcagcgaattgaaggagctttacgacaatacctttgagtatgatgtttaccgttactccggccagacactggcgctgggagcgatgccccgtctgctgtggcttgcgcatcatcgcgcggatatctatcggcaggccagtacactcactatgatcagcgactggctggcttatatgctcagtggcgagctggcggttgatccctccaacgctggtacaacgggaatgctggatttagtcagccgcaactggcgccctaacctattggaaatggccggactgcgttccgatatcctttcccccgtcaaagaaaccggcaccctgctcggttacatcaccgaaaaagcggcagcagattgcgggctaaacagcggcacgcccgtcattatgggcggcggcgatgtccagctcggctgcctcggcattggtgtcgtcaaacccgctcagaccgccgtactcggtggcactttctggcagcaggtcgtcaacctgccagctccgatcaccgatcccaacatgaacatccgcatcaacccgcatgtcattcccggcatggcacaggcggaatccatcagctttttcaccggcctgaccatgcgctggttccgcgatgccttctgtgcggaagaaaaactaatggcggaacggctgggtgttgatgcttacagcctgatggaagacatggcggcacgcgttcccgcaggagcttatggcatcatgccgattttttcagacgtaatgcgctttaaatcgtggtatcacgcagctccttccttcctcaacctgtcgattgatccggaaaaatgcaacaaagcgacgctatttagagcactggaggaaaatgcggccattgtctcggcctgtaatcttgatttgattgcaggtttctctggagtgaagccagactcgctggtctttgccggcggtggttccaagggcaaactctggtgccagatcctcgccgacgtaacaggattacccgtgcgggttcctgtggttaaggaagcaaccgcattgggctgtgcaattgcggccggtgtgggagtttcattgtatgactcactgcctgaaaccggagaaaaactggtgcgctgggagcgggaatatcagccggatttgacacattgggatatttaccaaaaagcgaaaaaaaattggcaggcggtgtacgcagaccaacttcatctggtagatgacgggctgacaacatcgctgtggaaagccccgggattgtgagcaacaacttactcccaccaccaattcagtaaatctgggactaaacaggtaagcaatacgttagttatgatcaggttgccctgtttcttattcagcacgttaatgacaacattaaatttaagatggatttgtttcgccgcattgtttatgcctatccgctaggcaataatgactcgcattgccattactggttcaggaggaaggagataagggacttgctccgggctttgaaactaagtatggcgagtatctggggattgacttccttctttttggtcaaagtatggggctgagtgaaaagctgctcagaaagctattgatggacttaaccaaagagacccagttgatagaatcaacttaccgaaattcttttatgtcgaaggaggcgatcaaagcgacacttcaatgctatcagcagcgcctcaatcgaatgcaagtgcttgatacttaatctacgaagaatatcctccagcgaggaacattatcaggacttttagcgaacgtgaacagtctgtttggaagctctatttattgaatatatgaccgtaaatttaataggttatgagtctgacaactcataaccttaaaatattggatttcaacgatgacataaaaaagaaataaaattatctcattgtcacaaattcttctgctgccgtcgggtggatcgccacggtattatcaaaatccttcttcgtcgcgcccattttcagcgcaaccgcaaaaccttgcaggatttcatccataccaaagccgataccatgaataccgacaatcttctcatccgctcccgtacaaaccaatttcatccggcatggctgacgatgttgcgtcacggcagtatacatcgcagtaaatgacgaagtataaaccttaacctgatcatcaccatactgttcccttgcctgcggctccgtcagacctaccgtaccgattggcgggtggctgaataccaccgttggcacattggtgtaatccagatgctcttccggcttgttattaaacagacgttccgatagacgacgacctgccgcaattgccaccggcgtcaattccactgcgcccgtgttatcgcctaccgcatacacacctttgacattggtattctgatatttatcgacttgaatataacctttctcattcaactcaacaccagtgacggccagattcagattatcggtcatcggctcgcgaccaatcgcccagatcaacgtatcaaccgtctgctctctgccatcctgcaattgcaacgtcaggctgccatcagcatgtttaatcacggcttttaatatcgcttccgtatgcagtgtcggcccttcattcttgataacttccagcaaggtctcgacaatcagcggatcgaaagaacgcagcggcgcatgtttgcgcacaaacagatgcgtttcactgcccagcgccttcaaaacaccagcaatttccacagcgatgtaacctgcacctaccacagcaacacgctttggcatttcatccagttcaaagaaaccatcagaatcaataccatattccgctcccggaatcgtaggacacaccggacgcccacccgtagcaatcaggatatggttagcggtgattttttctccattgacctcgactgtatgtgcatcaacaaaacgggcaaatccatgaataacatcgaccttattattgcccagcacacgctcataagactgatgagtacgatcaatgtaggcagtacgactggcaatcaatgtcttccagtcaaaacgatttaccgtggtatcaaaaccataatcaggaccatattgatgaatagattccgcaatctgggcggcatgccacatcactttctttggtacacagcccacattcacacatgttccgcccagcgctttcgcttcaatcagggcgcatttctgcccatacatggcagcacggttcatggaggcaataccaccactgccaccaccaattgcaatataatcgtaatgtttactcatcttaggtcacttccgtctaatcaattaacttaccagtacaagctaaagttcaacctagtctattatgacaaaaagttatcactgactctggatggttctggctttcattactataggcaacaactatttgatgataatgcagttttgaacaaatacctattcaggcacaacccatgccacagaagtatgacctgttccttcaggaaccagtacttgatgcagccaaggcaataccgctttcatctgctgttccagcttccacggcggattaatgacgatcataccggacgccgtcataccacgctgatcactatcaggacgtaccccaagctcgatctgtaaaaccctgcgaatgcctgttgactccagatccttgagcatacgtttaatttgctgacgcagtacaaccggataccacagcgcgtaagtaccggtcgcaaagcgcttatatccttccaaaatacctttgacgacattctggtagtcagatttcagttcataaggggggtcaatcagcacaaacccgcggcggcttttgggtggtagttttgatttcaactgctgataaccatcttcccgcaggaggcgaacacgttcatcacgggaaaattcactacgtaacaaaggaaaatcactggaatgcaattcactcaagttaagctcgtcatattcccgcaataaatggcgggcaatcagcggggaacctggataataacgcagaacaccatgcggattcagcgcctttaccgcgctcatatacgccgtcaattcctcgggaatatcatcacgctgccaaatacgggcaataccttccagatactcccctgtacgctcggcatgttccccgctcaactgataacggcctgcgcctgcatgggtatccaaatacaggaaaggtttctcttttcccttcattgactcaatgatcaggctttgcacagtgtgcttcagcacatccgcgtggttgccggcatggaaactgtgacgataacttagcattaaacttatttcctattgatttttaaatggattttaattcaagaaaagacaaattattcattttattaccccagatattaccccacgcttcattgcactaatacaaaaacataataaagcatagtaacaaagtaatggatgaatatttattttggaagagatgaaaaccgaaccaaaggaacacactgagtggggtaatcgttaccccacggagatattttttaactaaatttccgctaattagaaacttttcgggcagttcgtttgataagttgaccgttactatcaaaatatcgacttggccagatttctgagggatgtatttcgaggtaattagcgataatccattcacctttcggccaaggccgactaagtgtattcgctaatgtcgatgaactgagtcccgattcacgggagacagccgctaaggttgtaccacgtttacgtaattcagcaataatatcggcttgatgccagtcatttctaacgttacttattcctgctactccttccattaattgatcattgatggtggcgatccagacagggtttgcagactgggtaactataaccagcgaggccgaagcctcccctgcctgaaccaccattgaaagggtgataacagacgcactggtagaaacttcctaccagtgtatatagttacacaaggctgcaaaaccttgaccattggattttgccaatagcggggctacttttaactgattggtttatctgactcaataagcgtatcagtataaacgcttaactttttgcgctatatcctattgaatgctttaggtcgctgttgttactcactcaagggaaaagccaaagttcatcagaaatacgatatgcaggttaatacacttatctgctctggccttgtgaaaggacatgtgattaatacagtttattgtttgacgtccgtgtccacataccggaagattcagttcagaatcatcgacaacaatccacagcaaaattaaacctgtaattattctcccttagcaggaggcatttgcactcgaacagaaacaaacctgccttcggggatatcaatcaaatcaccatccgcgtagccttcacgtatatttctggcgaaagaagggacgtctgagtgttcacggtggtaggtcattaatttgattgagccatcaggaaggacttcgtggttgacccaaatcaatggaaggtcattctgacaccgtgggatttcgatactgcctattgcttcatcattactaaacccgataacacctttgatgagataagtgccctttgatagacactcaacaatagtattttcggatttattgttgatagtatatttgccatctgagtaaattagaattgtaggggctgatttcttaatgcagccattattacctatagtagtattaacttctgaccaaacttttccccctacgcgatcctctccattaacaaaataataggcatacaaatcgcctgacgagcgaatatatatctgacccgtatcataatctagcaatccaaaattaattccttttgcatatccactagcagagccgctagcactaaacaccccaatatatttggagtcaggaataccatcaaattttataacgtcattcagagcatggacatcctttgaattcaatataatatcattcgttaatgatttatcattgatttttctattattaggtacggaattttttgctagatttatggtttccgttagaccaatattctttacgaactcatctttattcggaatatccgctccgttctgcgctttctctaaatagagatcggagttgttattgagagcattttgattggcgatattcgctaaatcataggcttttttaacagctttagaggttgccgcagtcatttcactatcactatccacatcattactgagagtcacaaaccctctgtcagtcagggttgcatagggatgattacgacttgcggcatgttgatcaatggctgctttgattgaatctttgacatattccggtgtggtaactgtcactaaattgctatcttcggaaacaggtgtatcaggcttcttatcttgcatagtaattccctcatttaatcaacaatacacattgctaaataacatgaaggcggtgggatactactccgcctgtgaacatcaataaatggttcatcaatattggagagtacggattgactaatatttgatagattgcatgttttggtggcaggatgacataaaatgataagtgaagaattaataaaatatatttaatgactgataaaacttggtgaagtaaaggcgatacctcaccttttaacgcattgattttattgttctcatcttgatagggaattacttatatctaaactccgtcaaagttagccaatctctgctgttgctcatcattgagactgaacgcaaagtcttcatgctcaatctgccatgtgccaaagctcatcaggaacgcgattgcagggtcgattttattcgcggacttcttcttgttcggttcgatattggcgttcgcgggaacggctcaacatccagccccgcgccctgcaattgggtgcgtaggtgcgtggcgttccatgtatcaaatcccactaacttgatatcaaggtgctgactgtctttgagaatgtcgtcccgaatacggtcataatcaatgcagtcgccttgtgtggtacgtatccccccccagacaatcaccgcatacgcattgccattcagcaggcaatgacgcatcagggtgcgtttgaactgatacggcgtctggcagtcattcggacattcattcagcaaataatcgaccggatggtcactcaaccattcgcggaattctttgccgttctggtgctgtacccgatagagatagcaaggcatggaagccaccgcttcgctaatgacggtaacagcgttcatcacagcgggtaaaccttctgccatagacggggaaacatgaagacagaatatttacaaaatttttcattcacaaagtgataaatctttcacgtaagttgttggtgacatccacgatattttatcacatgtcaaataaccaacattttttaacttataatcaacataaaaagaggtcatgtattaaatggttagttgctgtgatatgcttccggctttttaaggatgaagtatggccaaagttgatgtctattgccgttattgccacaaatcaggacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgacccataaaaccgccgatcaaaaattatgatcagcggtttttatatttataaataatcactattctacgcattcgacatattatttctctgaatatgtgtgactgtttatctgctttttatctaagccaaataacttgtcatggctaaaaagacttatcttgtcccttatccgaattgatggattgttatatcgtttaccacattcacaaagacatgagataaggggttttattaatgagtagtttgcgccttgcctattatgatttatcaccagagttgttacagggttttcgtacaataaagcaagagttggaagaaagtccattggggctagcactgattgaattaatctatttgcgtatttcccaaatcaatggctgtgctttctgtttgaacaaacatagtcaatccttgcgggaaaatcaggaaactgaacgccgtttgtctgaactggcagggtggcgtgtcagcggtcagtttaccttgcgtgaaaaggtggctttggaatggactgaatccctcacccatgttgttacaacacatgcggatgactatgcttatttaccactgaaagaccattttacggataaagaaatcgctgatttgaccttcgcgattgcattaatgaatggaatgaatcgccttgcaatcggtatgcgtcagtgatcgtttaattactggatcttgatgcagtaggcagacatttttgcagtaattgagcatgtttcaaagcattttcgggagtggtttcattggcaaaactaaacagtaatcccttgccacaatctgagctcaatcttcgtgcggacaaggcggtaatgccaagcccatgctctctggcgagttgagccagtgctacatcatcttcataatgcgcaagtcttgccagcaaatggaggccacctgcgggaatatcgaacctcaggcggctatcaaaaacttgattcaaactctcaatgactatctggcgtcgctgcgcataggcagtgcgcattttacgtaaatgacgggcgaaatgacctccctgcatgaaatccgtgacgacggcttgctgtaataaaggacagccatcttgccgagtgtggcatacagcattaaagctcgttaacaaatggggaggaacgacgagataggcaagccggagtgttggcgtcagaactttactgaatgtgccgatatacaaaacattgttagatcccaaactggccagcgcaggatgagggcgtccatcatattgatattcactgtcataatcatcttcgatgacaaaggcattattctgttctgcccacgctaaaagcatctgtcttcgtgccattgacagtgtaacgcctaatgggctttgatgtgctggtgtaaccagagcaaatcgtgcatttggggcgagttcttgagccaccgcaatattcatgccctcttgatcgactggcacgggaataatttcagcgcctatttgagatagaaaatgttgactgggaggaaagcagggatcttcgagccaaatttgatcccgtggttgtatcagggtgtgagcaattaggttgagagcgccgcgatagccagcggtgataaaaatctgttgtggagagcagctcaccccacgtgataattgaagataagccgcaatggcttctcgtaacggtaaatagcccgcaggttgcgggtaagacatatatcggctttgcaaacgcagttgtttgacggtgagggtattccataatttgcggggaaagagatccaacgctggtagccctagttgataaggtgagggatgaatggatgaagcagaatcgaataaagatatactaggccgtgtcccttaatgtaaatcggtagtattatcatctaaacggttttcaatataggaaaagatgatggcacgctacgacattcctgatgaagcatggatattgatagaatcttgtttgcccctggttcattcagaacgggcaggacgtccctatgttgaacaccgccgtgtgatgaatgggatgttctgggtgctatgttcaggggcaccgtggcgcgacttaccggaacgctatgggccttggaaaacggtctataaccgatttaatcgttggtcaaaatcaggcattatcaacaagatatttaatcgtttactgtccattctggatgaaaaagggttgattgactgggctgaaatttgcctggatggcagcaatattcgcgcgagtaaagatgccgcaggcgcgaaaaaaaacatcccgatatcgctgacgatcatgcgctgggtcgctcacgcggtggttatggcaccaaaatccacctggcaaccgaccgaaagggatttcccctcaacctgatagtgaccgctgggcaagctcatgaaagtcaatccgccattccgttgctcgatggcattggcgtccaacgcaaaaatggtttcatgaaacggcgcggtaaagcggtactggcagataaaggctattcgggcggaaaactccgtggttatctgcgaaaattgaggataaagagcattattccttataaaatcaatgaaaaaggtagtactgatggtcgcacgcaatttgataagcaggcttatcgtgaccggaatgtggtcgaacgctgtttcggttttctgaaaggaaatcggcgtattgcaacccgctatgaaaaatctatggtccccaccttttttgcaacactgatttttgattgatgttggcttgcttaaatctatccggcgtcactatgggcagggatgcccgcgcctcgatgagttccgcacctgataagcctaaaaaaccgcacggcttcagagagccattttttatgtcaggattccatcaggggggatctctagagtcaactgcgaggtcatgcaacgcaagac

SEQ ID NO: 14967 - DNA, 70027 bp, Xenorhabdus bovienii
  Genomic contig Name=Xb4151_4152.C426
gcaggttctagcaaggcgggaatagctcagttggtagagcacgaccttgccaaggtcggggtcgcgagttcgagtctcgtttcccgctccaaaaaaggcgcgttggcatagtggccatgcagcggattgcaaatccgtttacctcggttcgactccgggacgcgcctccagattcaagcccaggtggtgaaatcggtagacacaagggatttaaaatccctcggctgtaaggctgtgcgggttcaagtcccgccctgggcaccaaacataagtttactaacgtctactctagtaaactaaatcttataaagacctgataaatcaatcaggtcttttctttttaggtctactttagtcctttgcaatcaacatgcaccacggggcataatctggggcacctacacttctattattaaatgtgcccctaaaaatgaaactaaacgcacggcaaatcgaaacagcaaaacccaaagaaaaaacctacaaactcgctgatggtggcggactctatttggagatcacctcacgcggctctaaatactggcacatgaagtatcgccgccctaccgataaaaaagaagaccgactggctttcggtgtttatcctatagtgtctttagctgatgcacgagctaaacgggatgaagccaaaaaactcatagcccaaggttctgaccccaaagcagagaaaagggggacacaactcgaatcaaaaggggcaccatcttttgaacaggtagcccgtgaatggcacgccagcaataagcgatggagtgaagatcacagcaaccgtattctgcgcagccttgagcactatatttttcctcatattggcaagctcgacatctccactgtaagaacaagccaacttttagcgcctatcaaatccgttgatgctgatggtaaacacgatatcgcccagcgattacagcaacgtgttacctctatcatgcggtatgctgtccagaatgatattcttgaatctaatcccgcaaatgatatgtctggcgcgctttccactgtaaaagccaaacatcacccagcactccctcacgaacgcttacctgaatttcttacccgtctttctcactatcgcgggcgcttgattacccaaatcgctgtagaactgactttattaacgtttgtccgttccagtgagttgagatttgcccgttgggaagaacttgatcttgaaaatgcagtctggaaaattcccgccacaagaaaacctattgaaggcgttaaattctctgagcgtggcatgaaaatgaaaactgagcatattgtgccactgagtcgtcaggccgtatctctctttaaaatcttgcagggtttgagtggagaatgtgaggtgatgtttcctcatgaccataatccggcaaaagtcatgagcgaaagtaccgtaaataatgctttacgcgttatgggctatgacaccaaaacagaagtttggggtcatggatttagaacaatggcacgtggtgcgatgggagaatctggattatggaacgatgacgcaatagaacgccagttaagccatgtggaaagaaagaacgtccgcgctgcgtatattcatacatctaagcatctggacgaacggcggctaatggttcaatggtgggctgattatctggatgcaaatagggaaaaatatataacgccgtatgactttgctaaaaaacggcggaaatagccttaaatatcactgtatattacataactaaggcatcgggtaaatgtagtaagttatatgtattagctcagatttaatctgttagttactcattttttattctgttcacatattattttcccactaaaccggatttatgagagatagtaatgttatttacaatcatagagatacaagagaaattaaacgagctgggttctaaacttggcctatcaaagaattccatacaggcttttgatggccctcttggtgatggaacaccttatatttcgtttgaaaataatcggtacaatctcgttttttctgaaagaggaagtgaatttgaaagaaaaagaacaaaatcattggatgagttgttgtactggatgatgtcatctgttgttttgggtatggcattcagttatgaattggaaaatcgaattgaagatcaagattgtaggcggcttgcttttcctaaagctattgagttaatgaagcaagccaaccccgaatgggttcccaaaattgaggataagattaatcgtattctctctgaacatccttacgatgacgaaccaacaagagcactgcttaaattaaaaaacaaataattatgtacaaagcattctgactatcaaatttagtcaaaactgataaaaataacgcaatacataatgccaattcgtgaaaatatacgggctggcatatcttccagtgatagtcttttctaaccaaaaatagttaataatcaaaataataagacgcagcatactctttgtgtgaaacggattactattcctatgtgatgatctcatattggaacttcgctttaattgtccctgttctaataacgtctagaaacatcaaatatagataagttaacagggaaaaccacatgtcaataattaccacatctaaagaaagtcttattcgtttatcagaagttcaacgcagaacaggttatagcaaagcgtggatctatagacttattggagaagataaattcccgaaacaaattaaaattggcactcgctcagttgcttttcttgaatcagaagttgatggctggatagatcaacgtatagctgaatctcgcggcgtggtagcacaatgaaagcaaaaaagggtagtacagtgaatgctacccttaacttgctatcttttagagagttagttaactatcagatttattattggttggttcagccttttggctcgacacccagtctttctaattctttgcggcctaatgtttttaaccaattacctaaagtcattcctgcatcggacgcagcatcttcaaattgtgcttttaattctggtgttattctgatttggaaagtgggagacaaaccttttcctttttcagttttgtctctttttaagattgacatgtacgtacgtaaccttatagcatgtgatttattatgtacgtactttatcacggtatatgtacaaaaagaaacgcccccgaatgatattgaccgtatcaaacgagggctaaccaccaacgataactacaatatcgaggtagctatgtttcaatatacctttctaactggaaagggcaaagcacgtttacctaaattctttcctatgtgcctcatctccattctggaggtgagccatgtttaagctcattatcacaaccataaatcagcatactggcgagataaaaaaagaaacaatccgttacaaatacaagacattgcgcggcgcggagaaagccgctatgcgtattcgccattcttgcataccagataataaatctatcgacattgaaatagtcagaacgtacgaacgtcgagcgcctatttcacttactcaggctatgcacaacacggggctggcaacttctttattctacgtcattcttgaaaaagccaaggacgaatgctctatcgatttaaataacctgattgcgctggcctgtgatatcaatcaggacgtttaccatgcgcttcaagcggctgtttacgaggaataaagcatgagtcaatcatcttcatatggatataaagctcataaaagcagcgtagaaacccacccgataaacattatccgaacagtgaaacaatcagctatgaatcactggcaaagcctgttgccagcctgtggtgttgatgttccggcaaaggggaagcatggcgcttgcccgatatgcggtggcactgaccgttttcactttatagatgataaccatcacggcgactggcattgtcgccagtgtgatcagcccaatcacggtgacggtctggatttagtggcgagagctaaaggtatcactgttctgaccgccgctaagcaggttgcagatgtgctggcaatgccgttacctgaacctatattcaaaccagttaaagagcagcctctaacagtaaaacccattgcagaacggatcgcggtgctggtggcaaaatcaataaggggagaatctcagtatttggtgaaaaaggggctgcattgccccaatcagcggctactgcaagatggctctctattactggtgactcagacactaagcgataccaatacgggcgcacaaatcatcacgcctaacggcgaaaaacgccttgtttccggcacgcagaagaaagggagctttattccggtatctgagataactggaacaccggacaccatcatcattaccgaaggttacgcgacagcgctgactgtcagccagttacataatggcgtggtactggctgcgattgatgaaagcaatttactgaatgttgccgaattggtcagaaaacagtggtctgaatcaaaaattatccttgccgccgataatgattggcacgcacaaggcgaacgggacaaaaacggaaaattcaaaaagaacgtcgggaaaattgccgctgagaaagtcgccaaagctatcaatggttgggtaacactgccaccgacagggcataaggccgattgggacgattatcgccagcatcacggcatagaggcagcaaagcaggtattcagcaacggattatatcaggttggagagaaaaaactcatggaagcagaagcggcagtgatccacgaaactaaacccaaaaaggctaataacaatctggcacaaatggcagccagtcaacgtggggcactattggttgagcattaccaaaaaatcgcggtacatgctgaaagcgaagccgtttatcactataacggcccgacatgggaaactgtgtcagataacgagctgcgtcgcgcaatggtggcaatctttgaccagcacgacaccccttacagcccaaacgggatcaataacgctatctacgccatgaaattacaaattccggtcattggcgaacaacggtcagatttaatcgggttttgtaatggtgtgtatgagctatcgacacagaaatttactccccatcagcctgagcattggcttatgaatcataatggcattgagtttactcagcccgctatcggtgaaaacttgtcggatcatgcccctgacttttaccgctggttatcccatgcagcggggcagaatgaaaataagatgaatcgtatcaaagctgccctgtttatgatcctggcaaaccgttatgattggcagctctttattgaagtcaccggcgaaggcggcagcggtaaaagcgtatttacatatatcgccaccttactggcgggagagcacaataccgccagtggcaatatgagagcgctggatgaagccagaggccgttatcagtttgttggcaagagcttaattacgctgcccgatcaggttaaatatgtcggtgaaggggcaggaattaaggccattaccggcggcgacctgattgaagttgacgggaaatacgagaaacagttttctaccatcatcaaagccgtggtattagccaccaataacgaacccatgagctttaccgaacgtaacggcggcattgcacggcggcgagtgatatttccgtttaatattccggtcaaagaatccgagaaagacccacagttaccggagaaaatcagtcgtgaactgccagtgattatccgtcatttattaacagaatttgccgaccagaataaggctaaaaaactgctacaggcgcaacgcgactcgaacgaagcgttaacggtaaagagtcattccgatccgttgtatcgtttttgtggttatctggtatctgtcaatgatgtgaccggaatgaagatgggcaataagaatatcagcccacgcgcaccaagattgtacttgtatcacgcctatctctcttttatggaagcgcacggctttgaacgtccgctaacactgactaagtttggtgaatccatccccaagattatgctggaataccggaaagagtatcggaaagtgcgaaccaagaaaggttactcttataacgttgagttatcggaagaggccgaagaatggctaccgtcagtgcctgaatgccgagattttaagtcacctgtataaaactttgtgctttaagtctgcattccatacaccattttaaatatctaattgtatttaaaaggaaataatagatgtatagttattctttagctatacatcaactctacattatcttcattaatgtaaaaagtgggtgaacagatgatacagtcagtgaatatcatattaattgcatcaaacccagatgtagcaaggctttcagggtattgtgcagagggtgaataactgagaggatgaaaaagatttttaggggggcttctggtaagtaaacgaaatgaggtaaaccagagaaaacaaatacagatatgtaatctggttttttattttttggcactacctgaaattcacattaggtaattgtctgattttgtttaagcatagaggttaatcacaattttattgctgcatttgtattcactctggaacagataaataatactgttgtatcctgtttcattcagcatcattgggcatttattggaaaccatgtcacaggagacaagatgtcacatattatttacttgtcgttaaagggcaagaagcaaggccttatctcagcgggctgttcaacgcccgaatctatcggaaaccgctatcaggcaggccgggaagatgaaatacaggtactaagtgttagccattcagtgagccgtgaccagaacgcgaatcatcaccctgtcagctttaccaagcccattgataaatcttcacctttgttagcgatggcaatcgatggaaacgaattgctggaagcacgctttatgcactaccggacaagcccgatggggcaactggaattcttttatgaaatcaaactaacaggcgcgacaattgtcgaatttgcctataattatccccattccatcaatgataacggcgcaataccccatgaagtggtcatgctcgattataaatctatctcatgtcagcatattgcggcaggaacttcgggctacagcattacgcaattagccgggcgtgaagaaggcaaaccgcttttatccgggttctcgaatattaaaccgctgattgaagaagctgtcgcggctctatttagccataagttcatattgaaacaccaaggggatgcctgccaagatattgcgtatggtgtggaaacgggaaagggactgattgaaggaatatgccaaacatcaggaatgacaaaacagtttgataccaaaaaagaagaagaccttgaagttaaatatttatttcaaacaaaaatagggatttaatcatgtcgattttaaaaactaaaacagttaaaggtggcgaaaagacagatattgaaatggatatcttttatttaaaccaaatcccagatgcaatggaaaaaatgggatgggagatggcacctaagttaatgcggcattggtttaatacaaaacccgcctatacatttacagaagaagtaaagacaaagtatgttagagataaagcaatagatataccggatgaaagaattaatgcttctatcataaaaatggaatgggcgttaaaatataaacaacctcaagacgtgatgtctgtattaattaatggttggtctagtagtgcgggcatagatcaattaaaaatacaattaaaaaaagaaggcggaaagaaagagttagggtatgaaaaggatatgcgagaaatagatactttttcagtggttaactctagaaggtttggttctaaatttgatacgattgacgattggtatggtgccatgggtaattccaatatgaaggtggctgtcaaaggttatgtggataaattaaacggtaaagatgtttttgtcaccgaacaaattgggatgtatttaaaagatacctatgattttgttggtgctaatgaacctttaggcatttggagtaaaaatggtatattagataaaattagttccgttgattatgccgctctttatgcgactggaagctggatggccttatgggttaaatacaatggatatgttcctgtaattaatgatagctttaggaaatggcagaaaaaatataatgaaggcggcgatttcattgtttattccgatgttctatggatgaacccgctatcacaacataaaattattaacttatgaaaaataaatgtaattttttttttttagaaaaccatggttggttttattttttatcattatctttataatatggatattatttccatcaacattgctcttcggtaattggaataagtattttgaggagaggggtgaagatggtcaatataccgcagtggtatataagaagttgccaatatctccatattcaatgtggaggtatgtcattatgggagataaatattttattgttttatatgataataaaaacagagatatctggaagagttctccatttacatcaatatcatatgaggcattttttgcttcatttagccttccaaccactaataatgatgtttttatatacccaacagataatggatatcaaagcatccatctaaataaattaaaatgattttttgtaagttttctgttttcatgtttatctctgtttagcctctaagtttcagaggcttttttattattgtgtgattgaacaccatagcaaaccttctttcttattatttttcatgttgttaaatatattccatcaaaaataaatcgatataaaaacaccatgaaaaaactactcgaattacgtcaacaaaaagctgatttaacccatcaaatgcgttcactgcttaccaaagcagaagacgaaaaacgctcacttaatgccgatgaagccaaacagttcgacgagctgcgcaatcagtctgatgcgctcaatgcagagattgcccgttatgaggcgctgtctgatgaagaacgcagtcaggcaagcaaaccccaaccgaccaacaagaacctcagtaatgacgaactgcgccactatgttctgactggtgaaactcgttccctatctacgggagttccgtctgagggcggctataccgttattcctgaactgaacaaacaaatcatgcagcaactgactgatgagtcagtgatgcgccggatctgttcagtgaaaaccacacgcagcaacgaatataagcagttggtttcggtcggtggcgcagcggttgcacatggggaagaaggcaaggcacgcggtgagactggcacgccaaaaatggaagaagtcagcattaagctattccccatctacgcctaccctaaaactacgcaagagattatcgattttagcgatgtggatatcttaggctggctgacgtctgaaattgccgacacattcgtcgataccgaagaaaccgatctcttgagcggtgacggcagtaaaaaagcgaaaggcttcctgtcttatccccgtgatactcaagccgataagattcgtgcgtttggcacattgcaaaaactggaaactacagcgctttccgccgatagcctgattgacctgaaattcttacttaaaaacaaataccgtaaaaactctgtctgggtgatgaactccagtaccgccgctcaggtgcaaaaactgaaaaatggcaatggtgattatatctggcgtgaacgttggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccctttttccgaaagggaaaatttatccatttatatgtccactcaacataaacaagcattttgatattcatttcaaggtattacaagcaattaaatatccaagactcgtttgggacctatttacataagcaactcaagttgcatcctacaaaacaaaaatagtttgtaatctgaaatgaaatgagtaatacataaccaatgccgttgcaatgcagacatactttttggggagaaaacttcaaatgcccttgacacaaagagtccatcttatagatatttatccagatgctcatatgtatatttcatcaacctttcatgatggatacgtaataaatgaatttacaattgcttgtcatggattagctgtttttgatgggcggccggaaggccttgcaataaacggtcaactctggacttacgacatagtgaccagctacattcagtcaaacacaacggttgagacactgcatagaatccatcttcttgcttgcaattcagcgaattatgatattgcctctctcgcagcaaaagtgtcagcaagaataagaaatactgaagttaaaggatacataggttcagtttatataaatttcagacataacgatatttatcagtattatctaaataatgggagtaacagagtttctgtcgagcgctatcttgaacagattggaaatagtcgggttcacaccaataatgttcctaactattactgcatagtattcaaaaatggcattatggaaagacaagattacttatgaaattggaaaatattaggtaaaggatctacaaccctattaccccccttaatgacgaaggggaagtgcctcctgctgtctcttttcagaattgatattaagcctgaattcaataaactgctttcaacccccgcgccacatccatcttcctggccaccaacacagcggcctccagttcactgcactggtgctcacgcattagcgcccgccgctcggctttctcttctttttccgtcatgcccagagccagataaaggctcggcggcaccacccgaaacaacgcttcgatttttttcgccagtaccacgccctcggtataacagcggggtaatttactggcagagagcagcaccgatttttgctcttccgttagcttcttgaaacgggcgatctgctccacttcatccggtgacatggtcagacacagccaccattccgccatattcagcattttctcagcggtatccggatagtcggccaggttttgggtcgccagccacagccatgcacccagcttacgccacattttcacgaccttggtcatatagggcgacagcagcgggttcgtggtagtgatatgcccttcatcaatcaccagttgcagttcgcgatcctgatactggtcgcgttcggccaggttattgactttgttaatcagtgacaccattgccagtgccatctgggccgagtagttttcacgggccagtgtgcccagatcaatcagggtgacatccacctccggccacggggtgccgggacggttaaacagctccccttcaaacccctgggtaaacatcgacatggcgcccgccatttcatccgcccgtgcccgccggtgcgcggtgattaacggctggccgtgttcatcctgctggtgattacgggcaatggcataaagcgcattctgtaagtccgaggctatcatttgacgtgcctcgtcaaagggtcgtgtattcaacctgttgattggccatcaataatagaactcacgttcgatgaatgtgccaatgatcttgtcatgcatttcaactgacttagaataacccagcgtcttgcgattgagtcgctttagcctgttacgcaggttcagattttctcgttcaatacgttgagtataaagtttaccggtgatatgtttctcatcagccaatatgtcatatgccccgaaattatcggtgcaccagaatgccacatcaaaagcggataacttttccagcaacgtcctgagtgtctgtttgctacgagcgccaaaagcgtgagcgacaatacgtttcaagcgaggctcccacgcgtaccacagccagcgttgccgttttttgttactgatgaatgaccccatttcatcgacttcacagataagctgaagctcaggggtatccagcggcagcgtggttacacatcgcggcgcgcgttttttaaagtgcgtacaacagcgttaatgctgacatgaagtgcccgtgccgtatcacgaataccggcgttattcatggcaagcttgacgatttgctctttcatacccgaatggcaagcccggtaagtgtattcgagctggaaggttctacgacaggactggcaataatatcgttgatgcccaccttctcctttaccgtgttttttaacagacgtggtttggccacaaaaccgacacttcacttcaactaatgccatcactatccctcacgtatttaccctcattatacgtgagaaacaacgggatgaatacgtgatccggtattcttggcggcatcatatcaccactttgagaacaatccgcctcattcactctcacgggtgacgaactggcgtatctcttcacggattatctggcggatgtgatcgtcgttgattatttcagctgtttgtaccggaccaaagaccttgaagctatcggcagcaattccagccttagcacctgtatctactgacagtttcatacctgcgtcatagcgacgaccgttaatgcgacccacttgttcagcaatatttttcaactgtgatttaagttggttcagtgtgtcagtgtcacaattgaaatcaatgatgaaggtgtgttggggtactctgtgtcatgttctgttctccaaaaagaaaaagccacccgtgttaactgatggcatggggtattcctttaaccgctcaagggaatgggtaaaggaataaaaaaaccatcacgggatgcgatggctcgaaaaaatatcaggtatattgattagcaaattttaactcttaaggttacatattatgaattttagcgtcctactaggtatcttagtgttagtgtctgcctacctttcacagcgttcatcacagaaaaaagaacaagcgcggtatctttattctttgtttaaagatcatgagcagtttatagggaaaagtccggattacattattagcaaaacaatgaagccataccaatctggcagcgtggagcatggtgtagaatttacccaatggaggatcggaaaattagtcattgaagcttggttcaaaaatcaggtatgcactggtatagatttttatttaccaaaatggctcacccgcactgccccctaacatactcctgccaccccagtatcatttgcgctggggttgagtattttccattctccgattccataacttaattgcctcagagtcggcgacaccgacatcatcaaaccaacatgtatgagaacccgaagcatcacagttatagcaatttacccactcttcgtaatctttatcagcaaagccataatggcgttcagttcctacattatcactaccacaaaacggacacggtttaagttcattttccattactctctcttgcattcagtattaacgtaatcttgcaccccagaattatttactctgcgatgccaattatttcttcttctataagctgaacagcctctggagactgtttcttgttctgccagtgatcttctatcgcttcactcatgcgtcgcatccagtccgcgagtcttaacgccgcttctttctctgactgcagtctcggaaagttttcaaattccatttttgcagtgtattcaccgaattggtctttattaatgaggagtgtttggtcaagaattgtttctaagttgttatctgatacatatagcaaaatcaacataacctgacctattcaatatgctccgtaaacaactcatcaactgaacatcttttttgcctccttatcgcttttgctccgccccatttgtgttctatagggtttaaatccggactataagcgggaagccattccagttgacatctgctgtctgctatcgcttgtgtcgtgtcattccgtttatggaaaggcgcattatccatcactatcactgctccgtgtggaagctttggcagcaaatcttgcgtcatccacgcataaaaaacatcggcattaatattctcggtaaataagcttaaggtgacgaaggtattttcgagaatggcgccaatgacgttgatacggccttttacgtgccagtcatgcgtaccaaaacagcgtaaccctttttccgaatatccttgtttacgtggcatcgattgagcaaaaccactttcatccaaataaacaatgggtctgccagtctgttcatcatcgctgatacgctcgataaatgcctgacgagcttgaggatcagcgcgagggggttggagcgttttttttctgggtgatccgaagccgtttcaaggcgtaatgaatagccgattgtgagacacctaaacgttttgctctttcccattgatagtcatcagaaaaattttggacatccgcaatgagtacctcatcagggattttcgtggcgggtttatcgcgggtcatgcaaggttctattttattgcaccaccggaacaaggtacgcatggaaatctcaaaatgggcactcgtttgttcgaaagtcaacgaatgcttgtctttgtatgccagtactcgctttcgaaaatctaagctgtagcccatctcattttatgccttgttatcttagagttagatattatgtcatattaatatgatttaactatatatacctgccgttaaatctcagcaagttattattgttgagttttgtctatatttcagtcagttgtttcagtataaaaaaacgccctgtcagattagccggacaaggcgtttgtcgattttaatcagaaatgattatttattcgggcgcattgctgggaacaggatcacgtcacggatggtatggctatccgtgaacagcataaccatacggtcgataccaatccccaaacctgctgttggtggtaaaccgtgttccagtgcagtaacgtagtcatcatcatagaacatcgcttcgtcgtcaccttcatctttatgacgaacttgctctgcaaaacgttctgcctgatcttctgcatcgttcagttcggagaagccgttaccaatttcacggccaccgataaagaattcaaaacggtctgtaatgaatgggttatcatcattacggcgtgccagcggagaaacttctgctgggtattcagtaatgaaagtcggttgaatcaggtggctttcagcagtttcttcaaatatttcacactgaatacgacccaagccccaacttttttcaatatcaataccaagagacttcgcgatagcgacagctttatccatatcatccagatccgcgatattggtttccgggcgatatttgcagatcgcttctttcatggacattttggtgaaaggcttaccgaaatcgaattcttgttcaccgtatttaaccaacgtagtacccagcacttcctgagtcagagtacggaacagttcttcggtcagtacgatcagatcttggtaatccgcataagccatgtagagttccatcatggtgaactctgggttatgacgcggagaaataccttcgttacggaagttccggttgatttcgaaaacgcgctcaaaaccacccactaccagacgtttcagatacagttccggtgcaatgcgcaggtacatatcgatgtccagcgcgttgtggtgcgtagtaaatgggcgcgcactcgctccgccagggatcgcctgcatcattggagtttcaacttccatgaagtcttttttgaccatgaagttacgcaatgcagccatgatgcgggaacggatctggaatgtcttgcgtgattcgtcattcgagatcagatccaaataacgctgacggtagcgcatttcctgatccgccaagccgtggaatttatccggcagcggacgcagtgctttggtcagcaagcgcagttcagtacagtgaatggaaagttcacccgttttggttttaaacaatttaccgcgagcgcctaaaatgtcacccaaatcccattttttgaactgttcattataaatgccttccggcaggtcatcacgggaaacgtaaacctgaatacgtcctcccatgtcctgcaaggtcgcaaaggatgccttgcccatgatacgacgagtcatcatacggcctgctacggtcacttcaatgttcagcgcttccagttcttcctgagtcttgtcatcatattttgcatgcagatcttcagaaatgttttcacgacgaaaatcatttgggaatgcgataccgttgccgcgcagtgcaaccagtttttcacggcgagttttcagttcattatttaaatcaggagcctgttcagctccctgctgctgttgtgacattttagttcctcataggccggcttttaagctggcttcaatgaatttgtccaaatccccatccagcacagactgcgtattgcgagtttcaacgccagtacgcaaatctttaatgcgggaatcatccaaaacgtaagagcggatctgactgccccaaccgatatccgatttgttttcttccatcgcctgtttatcagcattcttcttctgcatttccagttcatacagtttggctttcaactgtttcatcgcctggtctttgtttttatgctgagaacgatcattctgacactgggttacaaggccagtcggtatgtgggtgatacgcaccgcagactcggttttgttgacgtgctgaccacccgcaccggaagcacggtatacatcaatacgcaaatcggccgggttgatttcaatatcaatgtcatcatccacttctgggtaaataaaggcagagctgaatgaggtatgacgacgcccacctgagtcaaacggacttttacgtaccaaacgatgcacgccagtttctgtacgcaaccaaccgtaagcatattcaccgatgattttaatggttgcagatttcaaaccagcaacgtcaccatcagactcttcgataatttcagttttgaaacctttggactcagcccagcgcagaaacatacgcatcagcatactggcccagtcttgtgcttctgtaccaccagagccagcctgtaaatccagatagcagtttgcgctgtcatattgacctgagaacatgcggcgaaattcaagctgaccgagtttttcttccaactgttccaactcagctacggcttcattgaaagtctcttcatcatcagcttctacagccagttccagcaggccgttcacatcttccagaccctgatcaagctgttcaatcgtttctacgatgttttccagtgatgaacgctctttacctaatgcctgtgcccgttccggttcattccagacatcaggctgttccagttcagcattgacttcttctaaacgttctttcttggcatcatagtcaaagataccccctcagaacgtctgtccgttcagacaagtcctgaatgtggctttttaccgggttaatttcaaacatattttgtgtcttatacgtagtggtcacatggatattttcgaactgcgtattctaacggatctgtcaaacggtttatagcatttctggagattggccacacaatcacttttggtcatgtggcaaagttttaatagctgatcataccattcaggccaattcagtaaggccagatgtgctggatcaaaagttggacatcgcgattaccgcgaaattcgttgatatccagtttataggctaattccactgttttgacgctgttatccggccaacgatgagtatcgatattaaacgcaatgccatccaacatcggcccaccgtttaatggttcaagcatgactttcagatgtttttcgccaacaatccgctgttgcagcagtttgaatttaccatcaaatatcggttcggcaaatgcctgtccccacgggccaccttctcgcagaatttccgcaatttccagcgataactcccctaaggccagttcgccatcactccagactacccctccaagctgggagatatccagccaatctgccattaacgcagagaaatggcgctgaaacagatcaaatttatcctgttcaattgacaagcccgcagccatagcatggccgccaaatttcaatatcagacccggatgccgggtatcgaggcgctcaagcgcatcacgcatgtgcaatccatttactgaacggcctgaaccttttaatgttccatcgcctgccggagcaaaagcaataaccggacggtgaaaacgttctttaatacgcgaggccagaatacccactacgccctgatgccactctggatgataaatgaccaatccgtaaggtaactgagtacaggtacgttcgaattgatcgcaaatctgcaaagcttcctgctgcatcccctgctcaatttcacggcgggtttggttcagtccatcaagttcacaggctatctgacgagcttgcaccatatcatccgtcaacagtaaagccacgccaacggacatatcatccagccgcccggctgcattcaatcgtggcccaagcgaaaaccccaaatcactggcagccagtttggttgattcccgtttggaaatttcaagcagcgcccgaattcccacgcaacagcgaccagcacgaatgcggttcaatccttgatacacaaaaatacggttattggtatcaagaggaaccacgtctgccacaattccgagtgccaccagatcaagcagttccgccagattaggcagcggaataccctgctgctcaaaccacgctattctgcgtaattccgccctgagtgccgacatcagataaaatgccacccccacgccagccagcgctttcgaggggaaagtacagtcatgcaggttagggttgataatggcatctgcggcaggcaatgtctctccgggtaagtgatggtcggtgacaagcactttgatgctatgctgatgtgctgctgccaccccttcgtgggaagagatgccattatccacagtaatgatcagatcagcgccttttttaacgacctcattaacaatctgaacacttaaaccataaccgtcttcaaaacgatttggcacaagataatctagattgcgatagcccatcgcccgcaaggcacggatacacaatgctgtactggttgccccatccgtatcgaaatcaccgacaataacaatgcgcgaatggtcgtacaatgctgttatcaataaggaaacagcctgttcaatgccattgagagattgataattgagtagccctttggctccacgttccagttcatccgcctgacgaataccccgcatagcgtataaacgacgcaataatggatgaatactattgggaagatgactgtcatccgccaccgggcggcggcggagttgtgtttctatattcactggaggttgcttcactgaatttgagtcattgacgaattattcactctgttgttccaaatcttctttcagcgcttttggcggcacaaaaccaccaagcacactgccatcctgaagtacaatcgcaggtgttccctgaacaccaaactgcaagcctaactggtattgtttcgcgatatcatttttacagcttttgatcggagaaatgttatcccctttgaaagcggcatccagcgctttattcggtgtcgcactgcaccagatggattgcatatctttggctgactgatgttgcagactatggcgaggaaatgccaaataacggatggtgatacccaaatcgttatactctttcatttcctcatgcaacttgcggcaataaccacaggtaatatcagtaaaaacagtcacgacatatttctctttcggtgctttgtaaacaatcatttgatttttcaaagcatccagttttttcaccagaacctgattggtgacattctttggtattttgccactaatatcgtaaacctggcctttgaacaaatacttaccatcgttggagatatggataataccctgatctgtcaaaaccgtgctcacgccagccagttgtgatggcttgatactttcggctttaagtcccatttttaccaatgagttattaaccgcactgtcattagcaaatacattgccggcaaaggccgtcaataataaggaaaaacaaaatgctaattttttcatcttttgttcctttatttccatcctttttcgcagttatccacgaggatgatgttgttgatgcagcattttaagacgttcagtcgctacataggtataaatttgagttgtggagagatcactatgccccagcaacatctgtacaacgcgtaaatctgcaccatggttgagtaaatgcgttgcaaaagcatgacgcaaaacatgaggtgataaacgttcggtatcaatgccagacaatacggcataatgtttgatccgatgccagaaagtctggcgggtcatctgcgttccccttttgctggggaagaaaacgtcagatgccgagccatttaataaccacggacgcccatactctaggtatttctccagccagtaaagtgcttcttctcccaaaggaaccaatctttccttgtttcccttacccacgactctaaccacaccttgacgtaagctcatatccgacaatgtcagtccaaccaattcagatacccgcaatccacaggcgtaaagtacttcaagcattgctttatcccgcaattcaatcggttggtcagtcaggggagtattcagcaaatccccaacttgtttttcacttaagtctttgggtaagcgtttaggcaacttaggggcagataaaagtgctgttggatcatccaaacgcattttttcacgataaagatactgaaacaaccgccgcattgcactcagcaagcgggccgaactactggctttataaccgctatctacccgttcagccaaaaataattgtagctcaatagattccacagaaagtaaatcgtgaccactatataccagccaattattcaaggcttgtaaatccaaccggtaagaagatagcgtattttcagccagatccttttccagccagatggtatccagaaattgctcaatcagggaattagccggtggagccggttccgatgacttatcttgcgatgcatagttttctgataaatcgtgtttttttggcacaagacttcctttatctctgcgacttccgatcggctattatgcctgaaaaagcaattcttctgttacaatgcagcccctgatattcgaaatgtcctggtaaataatgatgaaaattggtctcttttacggctccagtacatgctatacagaaatggtagcagaaaaaatacgcgatatactcggtgaagatctgatcgatctgcataatgtcaaagattgtgatcccaaattgatggaagattattctgtcctgattctcggcattcctacttgggatttcggtgaattacaggaagattggctggctatctgggatcagcttccatcattggatctgtcgggaaaaatcgttgccatgtatggcatgggagatcagatcgactacagtgaatggtttctggattcgttgggaatgttgtatcaccatttgctgcctgcgggtgcgcagtttgttggtttttggccaacagaaggttatgaattcaccagccccaaaccactgaccgaagatggcaaacaatttgtcggcctggctctggatgatgtaaaccagttcgagcaaactgatgaacgtttgagcgaatggtgtatgcagatactggcagaaatggaagcgctgttttaatcacgctatatcaggatactgacgcataagctggttcaaatgacgccacatctttggtggcacactgtctgatgccacccataaccgaattaacgaccgttggcggatactttctgttttgtcaaaggcgtgaagtgtgatcaccataccatagcggcttaaccacggtggcctagtgagtttccacgccgctttttgccaatgcattttctggccactgaacaataccagccttccctgacaccgcctaatgtttgtctgactccacacccagctcaccataatgatgacaaacaatggaagccagagataaaaaccattggaaggccacggagccaataacgcggcaagcataattgcaccatgcacacctgaagaaaacaggcggctatgacgggataccttcagttcacagtgccacagggccacgggcttggtttctgctctgaatcaattgcaccatgcggaatagctcatcatcttctggacgaccatgattcatgagccagttaaaaagatcaggatctgcacactccagcaaacggacgaaaagctgcttatcatcatcattcaatgagtcatattcatattcaaaaaatggcatgatagaaatatccagttcacgcattccacgacgacatgcccagtgaatacgcgctttattgtcaatatccatgtttaaaaagcctcttgattattttcattcgtgccattgagacggcaatgctgatgtcgcgaaagattaacaagtcacccgtcgtttcagacatgagcacggttgcaaaatttcacagtcaaagggaattatcaacgattctgggctgcttttcatcattcatgacagttgaatcaagatatatctataatatgcgaagagcatcgcaacaaatcatctttaactacccgtcagtaaataacaagaataactcctttgcattaagcctcatctcttttaccattagcattatttctcagatagtttactggcaggagctattatggctgaccaaattctattttctgcacaactcccatctccttcagcaacactttccctggctttaatttctcttaatgattgggggatgattagcgtaacaggcgcagatgcggaaaagtatctgcaaggccaagtcacatcagatatcgcctctctcaaccaaaaacatgtgttgagcgcacattgtgacgccaaaggaaagatgtggagtaacctgcggctgtttcaccgtggcgaaggttttgcctatattgaacgtcgcacagtattggattcccagctgactgaattgaaaaaatacgctgtgttttccaaagtgacctttgctaaagatgaagaaagcatcctgcttggtgtagccggagcaggaagcaggaacgcactggcagaaatgtttcccaccctgcccgatgccgaaacaaccgttattcaacacgaaacaaccacccttctccacttcgctttccccgcagaacgttttcttttagtcaccgatcaggctaccgcagcccagttaacggaaacattagtagggaagcttcaggcgcaattgaacgatagtcagcagtggttggcactagagattgaagcaggcttcccagtcattgactcagccagcagcgcccagttcattccacaagcgacgaatattcaggttcttgagggcagtatcagctttaagaaaggctgttataccggtcaggagatggtggctcgtgccaaataccgcggtgctaataagcgggcaatgtactggctggctggcaccgcgtcttctcttcccgttgccggagacgatctggagtggcaactgggtgataaatggcgcagaacaggctcagttctgacagcggtcagactcgctgatggttcaatctgggtgcaagttgtcatgaacaatgatatggctgctgacagtattttccgtatccgtgaagatgaaggaagttctcttaccattcaatcgcttccttattcattcgatgaagaaaaataatatttgaggttttttatgtcattagctgtaccccctgttgatttcggcccatttactaatgtcatcgcatttattatggagctggataagttaaaatcggttcatcgcaaaactaaactgctgaacaatcagcgtcatgaaaattcggctgaacatagctggcatttcgccctcgctgtcatgagttttgctccttatgtaggaaaaatgaatattggccacgttgtgcagatggcgctgatccacgatattgtcgaaatcgatgcaggagatgttatcgcattcgatttggctgcccgtgaagcaatccatgaacatgaagttaaggccgcccatcgtatttttggtttactgccggaagcgcagagagattattttctggcactgtggcgtgagtacgaagattctgaaacacctgaagcgatttttgccaaaacgcttgataggatcatgcctgtattcatgaacctgcataacaatggccaaagctgggttgagaatggtattcgctttgaacaggtttttaatctgctgcattttattgctgaggcttaccctgagctgtggcaatatctactgccacaattggaagcagcgaaagagaaaggttggctgaaagcgtaacactacgtcaggtacgccttctccttgaataagcaggctgtcagatgcaaggaatcatttactctgtcagccttaaacatatttattcgtcagacaacaacgtttcttactgcaaattttctacggttttctcagaagatacgataccatcaagactacacatcctgtcaataccactgtcagccagctagtaatatgaatggcgctggtgaatgaatgcgctgctgcacccatcaattgccgaccttccatttcaatcaatgaagctgctatcacataagctccagccaacgtttccaaagccaatgatgcttgttcctgagaaatacttgccggcaattgcagatttaaacgataaaacgccgtcaccaatccacccagaatcgttgtaccgaatacaactccaacttcataggccgtttcgctgattgctgaagctgcacctgccttggaagaaggtacggctgaaataaccaagtcattggaaatagaagctatcgccccgacaccaatattcaataatgcgaaagcgatcacgattgaagtcaggttactgccaacacaggcaatcaagaaaaatgcggctcccgacaaagccaataaaatgggtacgagccagtggataggcactctctgggcaatcggtacgatcgccatgccgataacgattgccatgatttgtccgggaatcagtgcaagactggcggcaagcggtttcatatcaagcacaacttgcaggtactgagtggcaaaaaagacaaaaccaatcagtaatccaagactcaataaattgaccatgatcgaaccagtaaatacaccattacggaacagggaaatatccattagcggtatttgcaagctctgttgcctacgtataaataacattcctgcgataagaccaatcgcaaacgtcataatgacactggtctcaaagccattactggcaaaatgtttaatcgcatacacaatgccagccatggcaataatggataataagacactatagccatcaatgatccctatctgctttttggccgattcaggtaacaacataggtgcaaaaatcaacaaaggcaccaatacaggcacagccaatagaaaaatggcttgccagttaaaatactgcaataaaacaccgcctataacagggccaagtgccgagccaacggtgagagtagtcgcccaaatagcgatagctaatcggcgctgttcacgatctgtaaaaagatggcttatcaaagccagtgtcgaaggcatcaacattgcaccaaaaaaaccaagagctgcacgcccagcaattaattgttctggcgaggtagataatgctgtcagagctgaaacaaccgtgaatcccaatgacccggatagcaatagcagacggtgaccaacacgatcaccgatacttcccatagacaccaacaatcccgccagtaccaatgaataagcatcaataatccataattgctgatttgcactcggttccaaagctctggtaatttttggcaaggcaaatcccaaaatagtgttgtccaccgtgaccaataaaaccggtaacattaagatcaataatccaaaccaagtacgaaattctgctcgtttatgagtactcacgattctatttaatgacataaccttaacttctcccgttataactgaagtattgaaaagatgtgccaacattcagccacatgtatatgaggccgttgtttcaatttatttttaaatttttggaaaattatttaatgaaaataatgaagaatttatgcgatattagacgataacttagcgtcattagtaataacgcgaacaattatgtctatgattgaagtgattttctaactatagaagaaataaaatttcatccaaacaggcatcattgttgaggttttttgagagagaaacgcctgtgaaagacgaatcatagtcatagtggcgatattcaaaatagttgtcatcctttgttggtttcaagctatttgttttaatagtacatttctacaacttaatcacattttcaagattaatgatattgaagttttcaaaataatcaattgactcaaaaatagcgatcttccatcacgagaaaactaccatatattgagtgaaaatggataattttcctgaaaaagcagtgtgaggaatcctcctcaacactgctttcgtcttctttgttaaccgagattaacgataatcttcaatcggtgcacaggagcaatgtaaattgcggtcaccatatacatcgtcgagacgtttaaccgttggccagtatttattggctttggtttctactgttgggaagacagcgatttcacggctgtatgcatgttcccagtcagaaaccagctctgcctgaacgtgaggcgcattcaccagtggattgtcttccagcggccattccccttttgccacattgctgatttcttcgcgaattgccagcattgcgtcaataaagcgatcgatttcgactttgctttcggattccgtcggctcaaccatcaaggttcccgccactgggaatgacatggttggtgcatggaagccgtagtcaaccaaacgcttagcgatatccatttcgctgatgccaaattcgtctttcagtgggcgaatatccagaatacattcgtgggcaacgtagccatcacgcccggtatagaggatttcataagcccctttcaggcgagctgcgatgtagttcgcattcaggatcgcaacttggctggcttgtttcagtccttttgctcccatcatacggatatacatccagctaatgggcaaaatggaagcactgccaaatggtgcggctgatactgcgcccaatgtggttactgtgtccatttccaccacggaatgccccggtacaaatggtgcaaggtgttttttcacaccaatcggccccatgccagggccaccaccaccgtgtgggatacaaaaggttttatgcaggttcaggtgggaaacgtcagcaccaataaagcccggcgtagtaatgccgacttgggcgttcatgttggcaccatcaaggtaaacctggcctccattctggtgaataatatcgcagatctgacggatggtttcttcatacacaccgtgagtcgatgggtaggtcaccatgatacaggccagttcaccacgatgtttttccgctttttcgtgtaaatctgtcagatcgatattaccttctttgtcacaattcaccaccaccacggtcatacccgccatatgcgcggaagcagggtttgtgccgtgagcagagcttggaatcaagcagacatggcgatgttgttctccacgactggcgtaataacgacgaatggcgagtaagccagcatattctccctgagcaccggagtttggctgcatacaaactgcgtcgtagccagtcagcaataccagccaatgagagagttggctgatcagttggtgataaccctgcgcctgctctggtggacagaaagggtgcatatccgtgaattcaggccatgtgatcggcataatttcagccgccgcattcagtttcatggtacatgagcccagcgggatcatcgcctgattcaatgccagatctttacgctccagactgtgcatgtagcgcatcatgtcagtttcgctgtgataacggcggaagttgtcatgcatcaagatgtcatcattgcgcaacattgaaaccggaatagattggctgcctgccgccatttcgttatcaagcgtatcaatatccaatatagcatcagagccagtcagaacctggaacagtgtttgcaagtcgtcgcggctggttttttcactcaatgccacaccaatcgcaccaagaatatcagtacgcaggttaatttgggctttctccgcccgaaccagtacctgtgttttatctgcaacttcaacggtcagcgtatcaaaccatgttttgtgacgcagtgtgatgcccgctttttgcaggccggtggccagaatgtcggtcaatcggtgaatacggccagcgattctcttcaagccttcagcaccgtggtaaaccgcgtacatgccagcaatattagccagcagaacttgcgaggtacaaatattggaattcgctttttcgcgacgaatatgctgttcacgggtctgcatagccatccgcagagcccggttacccgcagcgtcacgggaaacgccaataatgcgacccggcatggaacgcttgaattcatcacggcaggcaaagaatgcagcatgtgggccaccgtatcccatcgggacaccaaaacgctgtgctgcaccaaataccatgtcagcaccttgtttgcccggtgcagtcagcatgaccagtgccataaaatccgccgctacactgacaataatttttttctctttcagcttcgtaatcagagcactgtagtcatgaacttcgcctgttgtaccaacctgttgtagcaggacaccgaagacaccttccagttccagcactttttcggctttatcaacaatgacttcaaatccaaaggtttctgcacgggtacgaacaacgtccagcgtctgtggatgaatatcatccgccacaaagaagcgctctgcgcctttcaacttactgacccgttttgccatcgccatagcttcagccgccgccgtggcttcatccagtaatgaggcagaagcaagatccaatccggtgagatcaatagtaacttgctgaaagttcagtaaggcttcaagacggccttgggaaacttctggctgatacggggtatatgccgtgtaccagccaggattttccagcaaattacgcagaataaccggaggaagtaccgatggcgcatatcccataccgatataagattgataacgtctgttctggccagccatcactttcagttcagccagcgcctgttgttctgtcgcaccttcgcctacagcaggtggctctgacaatgcgatatcacgaggaacgattttattcgtcagatcgtcaagagaatttgcaccaactgtcgccagcatctctttttgctgttcagcagaagaaccaatgtggcgacgagtgaattcaccttgattttcaagttggattagtgtctgggtcattgatgataatttcctgaaactagctaaaaacggcacacataaaaaacgccccattcacaacgtgatatggggcgatagtaagtattattcttcttctgccaaaagtgactgataaccttccgcatcaagcagatgggtgagttcactctcgtcagagatcttaaggcggaacagccaaccctcgttataaggctcactgttgactaattcaggagaaccttccaactctgaattaaccgcggtgacttcaccactcaaaggggcataaatatcagaagctgctttgactgattctacaacagcacagtcattaccattatttacaactacaccgacttcgggcaaatcaacgaataccatatcacccaagagttcctgagcgtgctcggtaatacctacagtgtattcaccgtttccttccgcacgaacccattcgtgtgatgaggtatattttaattctgctggtacatgactcatcgttgccatctccttgtttttaattcattaataaaaatgttacgacccaaattactctacgagcgatttgcccatccgtacaaaacccggtttaaccacctgaacaagcatttcacggttacggatctgaacaatcgcctgttctccaattccctgaggaactcgtgcaagagcaatgctgaaccccaaagttggagagaatgttccgctggtaatgacgccagaacgcatttcacccgctttatcagtgaagtggactgttaaaccaccacgcaatacgcccttttcgcgcataattaagccaaccagttgttctgtacctacttcacgctgtctttccagcgcttcacggccaatgaattggcgatcttccggtttccacgcaatcgtccaccccatattggcagctaaaggcgaaatggtttcatccatttcctgaccgtaaaggttcatacccgcttcaaggcgtagtgtatcccgtgcacccaatccagcgggtttaacgcctgctgctaacaatttctgccaaaaatcagcagcctgttctttcggtaacgcaatttcataacctgcttcgccggtataaccggtcgtcgcgataaataaatcaccagactggacgccgaagaaaggtttcatacctgccacggcctgtttttgttcatcattcagcagggattgtgctttagactgcgcattcgggccttgaaccgcgattagtgctaaatcatcacgcaccgtaatttcgacggggtaattcgtggcatgctgttgaatccaagctaagtctttgtcacgggtcgcagaatttacaaccatgcgatagaaatcatcagtgaagaaatagactatcaggtcatcaataacaccaccggagacattcaacatgccggtataaagtgccttgccctgttcggtcagtttggtgatgtcatttgccagaagatagcggagaaaatcacggcaacctgtgccatgcagatccacaatggtcatgtgggaaacatcgaacataccagcatcagtacgcaccgtgtgatgctcgtcgatttgtgaaccgtattgaaggggcatcatccagccatgaaaatctaccatgcgcgctccgcatgccagatgttgatcatatagtggggtgtgttttgacattatttccctctttccattcttgacatgaaaatgtttttgacctgaaaaacatacggcgtattaaccgacagaggttggatcatgaatcaaaaaaagcggttaatgacgcaaacgataccttggtttagaagttatcactgaaaatagaaatgaaccataaaataaattagcagcattacagtaataacctgaaaaaacacttactatcatgcagaatttttatctaatttattgcgtgaaggcgctcaaaatttttaatgaaatacagaatacgttctttttttattagaaaaagactaaagtgtgaagtaaatcaactgaacacacttcagtcctacatgaggaaaactaatcttaaatgagaagcggaattagattttttcaaccgaagaggtttgagaaatcagccaatcagggagatcatttagccccatggcatgacgaagcaattgcgattttactcccggtaagtgatcagcgaacgttaatccaatatcacgcaatagctttttagccggatgattgccatcaaatagctgacggaacccttgcatacctgccagcatcaccgctgcactgtgcttgcggcggcgctcgaaacgccccagatagagatactgaccgatgtctttcccctggcggtgcaggcggctcagttctccaatcaactctgccacatccataaatcccaaattaacgccttgtcccgccaaaggatgaatagtatgtgcagcatcccccagcagggctaaccgatgggctgcaaagttacgggcataacgccccatcaatggaatggcctggcgttcactgactaattcacacagaccaagctgcatatcaaatgtaacgcccaattgccgattaaataatacagcgtcgattaccttgcgctgttgcgcagcttcagcaggcagtgaccagacgatcgagcataaatggggatcagacaatggcaggaaagccagaatcccatcaccatgaaagacctgacgcgcaacagcctgatgaggttcttcggtacgaatcgtggcgaccagcgcatggtgctcataatcccaaaaggtcagtggaatatccgcatgttggcgcagccatgaattcgcaccatcagcaccaacaaccagccgtgaagtcagcattcgctcatcggacagagtaatgaaagcttcgttttctccccacgcgacatttttgagagatgcgggggtaaaaatcgtcacatcaggcaaattttctgcctgctgccaaagtgcctgccggatcacatggttttcgatgatgtgtccaagatgtgtcagaccattttctgtcgcatcgaatttaatgcgaccaaaactatcttgatcccggacgtccatccccagataagcactggctcgcatcgcagtaatgtgctgccagacaccaagatgagttaataaccgttcactggctgcattgatagcagaaacacgcagcgcatgttcatcgttagcatgaaacgtgcctgtcggtggatgctcttctacaatcgcgatgcgcaaaccgctaccctgcaaaccacaggccagcgcaaggccaaccataccgccccctgcgatcaccacatcaaatgattgcatgtttttctttcctcttaatctgccttattctgccgatgaatgatgggcaacccaacccagtgtctgatgggcaaataagtcccgcaacggggacaacgtttccatcgtcatcaggccaaggttacgtcctatcttcaaagggaaatagtcattggcgaatattctaaccaacccatccgtgataccaatcgtcgtttcacgatcagtatggcgttgctgctggtaacgagccaaaacatcataagcaccaatatcttgccctgaatctgccgccgctgaaatgactcgtgccagtgtcataacatcacgcattcctaagttaaaaccctgcccggcaatcggatgtaacgtttgggacgcattgcctaccaacgccagacgatgactgatctgctggctggccgtaaataaagccagtggataactatgtcgttgacccgtttccagcatcttgcccaaacgccagccaaaggctttttgcaattgttgaagaaattcctcattgctccagccgttgatttccgtctgtttttccagcgggtggcaccataccaaagcgctgcggccttcagacatgggcaataatgccagcgggccatgttcggtaaaacgttcaaatgcctgtccctgaggatgttcagacgtcaggacattggcaatcatggcaacctgaccgtaagtttgctgctgccacgggatattgcacgctttcgccacggcagaatggcttccgtcggcagcaaccaacaactctcccgtgatcttttcgccattgtccagcttgaccacaaccgaagtatccagacgttcaacggaattcactttagccggacagtgaagtttgacattaggtgcctgtcttaacagattaaacagacgaatcccggcatcgtgcaattcaatgacattacccaatgccggaatagcatagtcatcggctcgaatgttaacgaaaccactatggcctcgatcgctgacatgaacgtgggtaattggggtggcacaatctttcagcacaggccagacaccgatttggctcaggcgctggcatgtgccataagccaaggcaatagctcttgcatcaaaaccctgatgttcttgtgttggttctgtcgattcaatcaaagagacctgtacctgcccccgacttaaggaagaaatagccagcgccaatgttgcaccagccattcctccccccacaataatcacgttcattatgatttcctgattacagtaattttaattctgtttcgcctgtgccatcagtgcttcaatttcatccggatctttcacgacatgctcggtcaaattctcattgcccgcttccgtaatcacaatatcatcttcaatgcggatgccaataccacggtattccggtggtacatcagcatccggcgcgatataaagccctggttcaacagtcagcaccatgccgggttccagaatgcgatcgcgatctatgccataatgcccgacatcgtgcacatccaaccccagccaatgacttaaaccatgcatgaaaaattgacgataagcattggtctcgatcaattgttctacttcgccatgcataattcccaatttgaccagcccttcaaccataatgcgcaccacatgttccgtcactttgcggatactggtacccggcctgtacagttcaaaagagacattgatagattgcagcacgatgtcataaatttctcgctggggacgggtgaatttgccgttaaccggaaatgttcgcgtaatgtcgccggcatatccttcatattcacagcccgcatcgatcaataccaaatcgccctctttcatgcggcgctcgttttctgtgtaatgcagaatacaggcgttttctcctgcaccaacgatggtgttataagcaggataacgtgcgccttgacgagtaaattcatgatggatttcagcctcaagctgatattcaaacatgcctgggcgacaattctgcatggctctcgtatgagccttcgcactgatgtcgcctgccttgcgcatgatgtccagttcggctgccgatttgaacagtcgcatctcatgcagccacggacgccaatctgctatcattgatggtgcgctgaggttacgacggctattttttcgcaatgtatccaaggcactgaatacgatattgtcagcatattcaaactccccctgggcatgataaaccacgtccaaaccattcagtagcaggtaaagctgtttactgagatcatcaaatggcagggcgcgatccaccccaagtttttccggtgcggcatcctgaccaagccgacgaccaaaccaaatttccgcagttagatcacgaacacggttaaacaacacgctatgattgtggttttcatcacttttgatcagaacaagaaccgctttcggctcgttgaacccagtcaagtaaagaagatcactgtgctggcgatagggatattcacaatctgaattacgcctcgcaggcggggctgcaaaaataatggccgcactggctggtgccatttttgacaataatgcctgacgacgggacaaatattcttgtttagtcattaccctctcctgcgatttgattattattagttggttaaccgccaatcagtgtagcgttggcttgtcattttttttcacgctatttgccgttttcggtgtcgccaaggcaatgtagcagagttgtactgcaacacggacgtactccaatacttcttccagagcttgggacagttcttcctgatcttcgtcttcatcgtatcccagcataccgatgttacgtaaatcagtaacgacttcctgtatttcctgtttttctgtcaactgcggattcgccacgcctaatcccaacaggaaatgatttacccatcccgccaatgcatcagcacagtcaaaaacactcgcctcatcatcaggaagcagtagattaaaaacaaaatcactatcatcaagtgattcaaaggtcgtttcgtataatgccctgatcgactgtgccaacgcctgtgaaaatgcaaggccatcattagtaagatcatgcattagtgtctgccagctactatcatgatttccaccacataataggccactgattagaccgtgcatttcggcggctgtcagcgcaactgactgttgatgcaaaatttcatcaaatgattgataattaggtaatgagttttgtatagacatgtatattgatcatcgttggcgatataagttcatgctatgctaccatcaaggggagtcgctataccagacagcacacaccgatataaggagggttgccttttggtattgtacggtaatggttgttgtcggccttgttttaataccaaaatctgcttttatgccagaatcaaggtatcggcacagtaataaatcaggaaggtgtcatgtctgcacaaccagtagatattcagatttttgggcgatcattacgtgtcaattgtccaccagagcaggtagaggctttgcaagctgccgcgaaggaacttgatcagcgtttgcataacctcaaagaacgcaccagagtaacgaacactgagcaactggtttttattgtggcgctgaacgtttgtcacgagttagcacaggaaaagatgaaaacccgtgattactcttacaatatggaacaaaaaataaaaatgctccagcagactattgaacaagctttgttagaacaaggtaaaattacctgacctcctagctgtcaataaactgatccttgttgataaatcaggcagtagtcactatacatgaatataagcagttgctttctccatttagttccatacaataggctctattgcgttgcttaaagcctgatgaatggagcctgacagataggttcttgacggatgaattcttaactaattggttttaagcgctacaaaatttctctgaggtgtgcgtgagcaggtaagtcccctgagccgatatttcatacctatagaatgtggtgctccgtttcttgtgagcatgcttggctagaccaagaagcctaataggggcgacactacgttcaccttgaaccaagggttcaagggttaccacctgccgcggcatcttggagaaccccttatttatctgttttgtatccttttctgcattttaataggcaggtttcatgcaatcagatccttttttatctctccgaaaatccataagaaaacaaattcgacagttgcgtcaaaatctatccccagagcagcaatcgcgatttgcccagcaagctgcccagaatgtcgtgtctcaccctaaggtccagcaggcaaacaaggttgccctgtatctctcctttgatggtgaattagacactcgcccactgattcagcaactttggcagcaaaataaacaagtttatctgcccgtattacacccattcagtcggcaccatctgctgttcctgtattaccatgctgggactcccctcaactacaatcgttttaacatagaagagccaccattagatgtccgacaggttctgcccgtctctgagcttgatgtgatgtttattccactggtggcttttgataacacagggcagcgtttaggaatgggaggcggtttctacgacagaacgcttgctaaatggcaacagcagaatttttatccgattgggttagcgcacgatttccaattagttaatctattgccaagtgcaagctgggatattcctctgccagaaatcattacgcctgaaaaaatatggcgctggtaataacagtttattcttttaaggggctattgtttctacgatagccccatttctcacggtattcgcccagacgatcagtaaagcaggcgagagcggatcgtgccagacagagctttcaggttttgcagaaccatttcagcctgagccggattttgcgtcgtgatatcaatgaccacataaccaatatctccgttggtacgcaggtattgtgcctcaatattgatttcctgatcggtaaaaacttggtttatgctggtcaaaataccaggacggttttcatggatatgcagtagtcggtgagtatctttggcatgaataggcagtgagacttcagggaagttgaccgctgacagcgtagaaccattgtcagaatatttgaccagtttacccgcgacttcgtaaccaatattctcttgggcttcttgtgttgatccgccaatatgcggagtcagcagtacattatcaaatttgctcagaggcgagatgaaaggctcattgttcgttgcgggttcactcggaaacacatcaagggccgcaccggaaaggtgctcgcactccagcgcgtcatggagtgcaggaatatccactaccatgccacgtgaggcgttaatcaggattgcacccggcttcatcaactccagctcttccacgccgatcatgttttttgttgagcctgtttcaggtacatgcaggctgacaacatcgctcatattcaacagttcggatagatgatgcacttgctgtgcatttcccaacggcagtttattttcaatatcatagaaatgaacatgcataccgatattttcagccagaatgccaagctgtgtaccgatatgaccgtaaccaataatgccgagcttcttacctcgcgcttcataacagcctttggcctgtttatcccatattcctctgtgtgctttcgcatttgcaataggaatacgacgtaatagcaacagtaattcacccagcaccatctccgccacagaacgtgtattggagaatggtgcgttaaatacaggaataccacgtttttcagccgctttcaggtcaacctgattggtgcctatacaaaaacatcccacagcaaccagcttttcagccgcttcaaaaatttcttcagtcaattgagtacgagaacggatacccacaaagcgagcatcacgaatcgcttctttcaattcttcaggctccaacgcccctttgtgatattcgatattgctgtatcccgccgcccgcaggttatcaactgtgctctgatgaacgccttccagtagcaaaaatttaatcttatccttttctaaagataccttgaccatttgtccgtcctatcgttgtcttaattttcagaatatccataatgaattccaccaaaataacaaaaaaaacagcaacagtaatacaatcgtttgctcacgcaacagggtaaatcgaagtaaaaaagttgttatacgtagtaatatgacttgttacagtctaaaaacagaattttgaggaattcttaggctaggatgtgatatatctcactaaattttaatttttttaaaaaacatggaaatattttaagggcagattattctgccccaataaacgattattctgcgatcgttttcacgccatccgctgtcccgatcagcaccacgtcagcactacgattggcaaataggccgaccgtcaccacgccagcaatgccatttattttattttccaacgcaatgggatcaagaatagcaagattatggacatccagaatgacattgccattatccgtaaccacattctggcgataaactggcgttccacctaatttcaccagttcacgagcaacgtaagagcgcgccattggaataacctcaaccggcagcgggaatttacccagcacatcgactcgttttgattcatcaatgacacagataaatttctttgcaacagcggcaataattttttctcgcgtcaatgctgcgccgcctcccttgatcatatgcatatggtcattgatttcgtcagcaccatcaacgtaaatatccaagctatcaacttcattacagtcaaaaatggggatgcccagattttttaatttttcagtcgatgcttccgagctggacactgcaccttcgatttgatttttgattgtccctaatgcatcaatgaaatgcgatgccgttgaacctgtaccaacacctacgattgttccaggtttgacgtattccaatgctgcccaacctactgcttttttcagttcgtcctgtgtcatatcaatcacagcctataatcagttacaaggaaaaatccggccaccagtataaacaatattttgcctcacccggcgaaaaaatatggcatagtgctgtgcagcacaaaaaaatatagaaccctatggcacagaaagccgagcaaaaatggagaacctgattttcaatgaaacgtcctgactaccgatccctacaagcgttggatacagtgatccgagagcgcggtttcgagcgtgcggcgcaaaaactctgtattacccagtcagcggtatcccaacgtatcaagcaattggagaatatgtttgggcagcctttattagtacgcaccgttccccctcaccctacagaacaagggcaaaaactgctcgcactattacatcaggtagaattgctggaagcacaatggctcggtgatgaaaatggtaacgatatcccattactgctctcacttgcagtcaatgccgacagtttggcaacgtggctcttgcctgcgctccatcctgttttatccgatgttcctatccgactcaatattcaggtggaagatgaaacccggactcaagaaagtttgcggcgcggagaagtcgtcggggctatcagtattcaatcacagccgctgccaagctgtctcgtggataaattaggtgccctcgattatttgtttgtggcatcgcctaaattcgctgaacgattctttccgaatggcgtcactcgttcagctttactaaaagcccctgcggtagcattcgaccatttggatgatatgcatcaggcatttttacagcagcattttgatttatcaccgggcagtgttccctgccatattgtgaattcctctgaagcattcgttcaattagcaaaacaaggctcgacatgctgcatgatcccacacctgcaagttgacaaagagctgcaagccggcgaattaattgatttaaccccagggctatgtcagcgccgtatgctttattggcaccgttttgctccagagagtggcgcgatgagaaaagtcactgacaccctactgaaactagggcgccagatgttacgtcaggaagatgaaattagttagcgttgcaactcaaaaactacttcaacctgatcagagaattcaatactttgtggttcataagtttcactggctgaatcctcggcgggagctgcggccataagcgctgacctgtatttcaggcggcttattggaaaaggcatagcttcaggggaacgataagtgacgctatacacagggcctaacttgctgttgaagccttttgccaatgcagtcgcctgctgaatcgcattttcaatagctttctgtctagcttcatcacgataacgctgtggattatcgatactgaactgcactgaactgatctcattcaatcctgctttcaatgcaccatccaataatgtactcagttgatccaactgacgaactttgacttcaactgaacgtgatgcactataacccgtaatagttgatttacccgtcttttgttcgtattgatattctggctgagtgcgcaaattggccgcatcaatatctttcttgtcaataccattggtttttaagaaatcaaaatattttgcgacgcgttcatccactttttgctttgcgtctgctgcacttttttgagtcactttcacatggatcatcaacgtcgctatatccggtgctgctttgatgatcgcattaccagaagtagatatatgtggggcggggggtaaatcagcagcagaagcagccatacaggacaaacttcctactgccatcattgcagcgaatatcagtgatttatgtttcacaaaacctccttcggatacaacaagtaaacaggcactttttacagtttacagtaagacaaagcgctttccagaaacattagcacactatctataaagtagtatgtaactcaataaaaaatctgtaatccctgtttgagcaaaccccatgcgatataccacatcacacaaccaacaaagaggttaatgattctttgtgaacgaggctgattgagtacgggtgaaaaccaggcagccagaattgataatgcaaaaaaccagcttatggatgccgtagcagctccaacggtaaaccacgacctaagttccgatgaaagtcctcctcccacgctacctaataccacaaaggtatccagataaacatgcggattcagccacgttacagcaaatagcgtcacgatgactcgactgcgattctggacgatattctcagaacgggagagttcgatattcgctgataacgccactcgaaaagcactccatccataccatagcaaaaatgccactccgccccatgttaccgcttgcagcaagaacgctgattgcccaagcaaagcacttcctccaaatactcccgccgtgatgagaacaatgtcgctggtggcacataacgttgcgctcattaaatgaaactgttttctacttccctgctgcatcacaaaaacattttgtggtccaagcgggaggatcatggcagcaccaagaaaaaagccctgtataaatgtcgaaagcatgcagaagttcctaataattactcaatcagctatgttatatatgcatattaggaaagatcgtatatgagtaaaaatgaataattcttattcatcattagataatttaataataaatatcaataatatagtcaaatatcagcatgatggaaaaggaaagcggtaaaactgcttaagcttggtgtgagaattttcactactcacaccaagctacttttattattcgtctaccttcttctgtacggcagcttgctgctgatgcagatagacatccatttgtgggaatggaatgctgatattatgctgatccaaagtacgtttgaaaccttccatcagatcccaataaacactccaagcatcaccattgcttgtccatacacgcacaatgaagttcagtgatgaaggtgccatttcgtgcagacgaatggtgatacctttttcatgttgaatgcgtttgtccgctttaaccacattacccagcactcttttcacttcatcaatatccgcgttataagcaacaccaaccataatctgagtacgacgattcggctcacgactggtattgatgatgtcattcgcaataatctttccgttagggatcactatgatacgatcatcaccgctacgcagcgttgtagagaaaatctgtacttgtacaactgttccttccacgccgccaataatgacatattcacccgtgcggagtggccggaaaattaccagaagaacacccgcagcaaaatttgacagcgatccctgtaatgccaaacctaccgccaaaccagcagcaccaataactgcaatgacagaggctgtctgaatacccaattttccaagcactgcgataattgtaaacgcgatgatggcataacgaataatcgcggacaaaaaatcagagatagttgcatcaatgccacgcaatgacatgacgcgcttaactgctttattagccagtttagcaacaagcaagcctacgatcagaatgacgatggccgacacaacattcaccgcatattgaatcaatagctcctgattgctggcaaaccaatttgctgctttatcaatctcacctgatagattgatctcttccataaaaaaaccaccttttattgttgaaacctatcttattcagtgctgttatcagctataacctcacctgataacataggctactatgcaaaaaacaaacggaaaaaccagtaatacaacatacaaaagtgatggagtatcgattatgtcaaaaaaccctctttggttgaacactaacacttatctttggtttttttgcaaaataaaatctttatagtcggctaacataccgataaaatcgtctgttccacaaaaagccagactctcgttatcatagtaactcattccctcttccaccatttctgtatcgaactggagttggttagccctaatcatgatttctccctcactcatcaataatgtgtattcatgaccgatcaattgccattggcgctcactgcctttgatgcccgccagcgctgaagttattttatccaatacactcaaatcacctttaacttcttcattcaaccaatgaccaatcgcttcatgatccatcgaaaaataagttgtaacgtgacccgcaatatcctgcgtaaattcatattccatcatgcaccccactatattgttgatatcaaccacatctggattttaaacatttctgctgctctcacctcagagacagtccacaaactgacacaaaatctaccataaaataaggaggcatctgcctccttattttttgcaatatacttttttatacagccgtttggaagatcacttcattcgctttttcggtgtactggttcaattgatcaaaattgaggtagcgataagtatctgctgcggtttcatcgactttgtccatgaattgcagatactcttccggcattggcaggcggcccagcaatgaagccaccgcagccagctccgcagaggccagataaacattcgccccagcacccagacggttagggaagttacgggtggaagtggacactaccgttgcaccatccgcaacacgagcctgattccccatgcataatgaacaacccgggatttcgacacgcgccccactcttgccaaagatgctgtagtaaccttcttccgtcagttgggcagcatccattttggttggtggagcaacccacagacgagtcggtaactggcctttatgttgatccagcaatttgcccgcagcacggaagtgaccgatattggtcatacaggaaccgataaagacttcatcaattttgctgttggcaactgctgataacagacgcgcatcatcaggatcattcggcgcacataaaataggctctttgatttctgccagatcgatttcaataacagcagcgtattcagcatccgcatcggcttccagcaattgagggtctttcagccaattctccataccgatgatacggcgttccagtgttcggcgatctccataaccttccgcaatcatccatttcagcaatacgatattagattgcaggtattcagtgataggcgctttatccagcttgatggtacaacctgctgcagaacgttccgcagacgcatccgccagttcaaaggcttgttcaactttcagctctggcaagccttcaatttcaagtatgcggccagagaaaatatttttcttacctttcttctcaacagtcagcaaaccttgctgaatggcataataaggaatggcatgaaccagatcgcgcagggtaatgccgggttgcattttacctttaaaacgcaccaatacagattcaggcatatccagcggcattacacctgttgcagcagcaaatgcaaccagcccagagccggctgggaaagagatacctatcgggaagcgggtatgggagtcaccacctgtacccaccgtatccggcaataacatgcggttcagccatgaatggataatcccatcgcccggacgcagcgataccccgccacggttcatgatgaaatcaggcaacgtgtgatgtgtagtcacatcgacaggttttggataagccgcagtatgacagaatgactgcatgaccagatccgcagagaagccaagacaggccaaatctttcaactcatcccgtgtcattggcccggtggtgtcctgagaccccaccgaagtcatcttaggttcacaatattcgcccggacgaattccctccgtaccacaggcacgacccaccattttctgcgccagtgagaaaccgccttcacttttttcaattgcttttgcctgacggaatacatcactgtgtggcaattccagtgattcacgggctttcgtcgtcaagccacggccgataatcaacggaatacggccaccagcacgcacttcatcgagaagtacatcagttttcagcccaaaggttgccagcaattcattggtgtcatggtgacggatttcgcctttataagggtaaatgtcaatgacatctcccatattgagattggaaacatccacctcaattggcaacgcacctgcatcttccatggtattgaagaaaattggggcaatttttccgcccaataccacgcccccaccgcgcttgttaggcacaaatggaatatcgtcacccatgaaccacaggacggaattagttgcagatttacgggaagaacccgtacccacaacatcaccaacataggccaaaggatggccttttttgttcagttcttcgatttgattgattgggccaacggcaccggcttgatccggctcaataccttcacgaacattcttgagcattgccagagcatgcagagggatatctggacgtgaccacgcatcttgtgcaggggatagatcatcggtattagtttcacctgtgaccttgaagacggtaacggtaattttttctgccagctcaggacgctccaagaaccacttagcatctgcccatgactggataatttgtttagcatgagaattgccagctttcgctttttcttccacatcataaaagctatcgaacatcagcaaagtatgagaaagtgctttcgctgcgatcggggccagtttttcttcatcgagggcatcaatcaaagcgtggatattgtacccgccttgcatagttcccaataattcgatggatttttcccgcgtaacaagaggtgaggctgtctcacttttggcaatagcggcaaggaaaccagctttcacataagcggcctcatcaacaccgggaggaacacggttggtcagtaggtctaacaggaaatcttcttcacctttaggtggattcttcagtaattcgaccagcgctgctgcttgagctgcgtctaatggcttagggacgatgccttgagctgcacgctcggctacgtgcttgcggtattcttctagcacgacttactcctcgctctcattgtcattttatatacccggctgtctgcacccggtaacgatcatcaaagaacaaccatcaagggtgtcaggtcagaggattttactcgcataactttaggattatgtcgagctttgggcgcttagcataccaaattttgaatggcatgttaattcattcacataaaagtaacattatgccatgataaaatgttggataacgagacacaaagagagtattacagttttatacaccatttttttctacttaagcctgaaaatgcctccatttctatctgttatattttcctgttatattttctgagtcagcggagctttcaaagctgctaacaaaccaggctccccttacagatattttcaccctgaaatacagatgaaaacctttaaactccgaacaatacaataaaatttacataaattaaaaacggccccctaaatgggagccgctcggcacaaaaatttaatatgctgcgaaatctaaagaattatttctttttctttgccttaggatttggcaaatcagtaatactgccttcatacatttccgcagccataccgattgattcatacagcgttgggtgagcgtggatagtcagagcgatatcttccgcatcacaacccatttcaatagccagaccaatttcacccaacagctcaccaccgttagtaccgacaatagcaccaccgataatacggttgctttctttgtcgaaaatcagtttggtcataccctctgcacaatcagatgcgattgcacggcctgacgcagcccatgggaaagtggcggtttcatagctgatgcctttctctttcgcttctttctcagtcagaccaacccaagccacttctggttcagtgtaggcaatcgatggaatcacttttggatcgaagtaatgtttcttaccagagatcacttcagccgcaacgtgaccttcgtgaacacctttgtgtgccagcattggctgaccaacgatatcaccgatggcaaaaatatgaggcacgttagtacgcatttgcttatccacatggataaagccacgctcatcaactgcaacacccgcttgacccgcgtcgagcgacttaccattgggtacacggccgatagcaaccagaactgcatcataacgctgtggttctgctggcgctttcttgccttccatcgttacatagatgccatcttctttagcttctactgcggtcactttggtttccagcatcaggttgaatttcttgctgatgcgtttagtgaacactttaacaatatctttgtccgcagcaggaataacctgatcgaacatttctaccacgtcaatctgagagcccagtgcatggtaaactgttcccatttccagaccgataataccgccgcccataaccagcagacgttccggaacagttttcagttccagtgcatcggtagaatcccatacgcgaggatcatcatgtggaatgaatggcagttgaattgggcgtgaacccgcagcgataatggcattatcaaaattaatcgttgttgcgcctttctcgccttctactaccaaagtgttagcgcctgtaaatttaccaatgccgttaacaacattaactttacggcccttagccataccgcccagaccacctgtcagctgggaaatcactttttctttccagagacggattttatcgatatcagtttgtggctcaccaaacacaataccgtgttgtgccagtgcttttgcttcttcaatcacttttgcaacatgaagcagcgctttggatgggatacaaccgacgttaaggcaaacaccacccagagtagagtagcgctccaccagaacggtatccaaacctaagtccgcacaacggaaagcagcagaatacccagcagggcctgcgccaagcaccactacctgggctttaatttcagtactcatcatgacctcttaattgtttgtccggcgggtcagacgaaaaaaaaccatattccaccgggacgtacacaccgcgagcagtttacagaattgtaaataacctgaaaagcgcgttaacgtgacagaaatcccaacatgctagatgtaagtctaaaatatctgtcacgatcgtaatcataaaggatagtaatcatcaggccggttattcaccggccttcatattacatcgccagacggcggatatcgctcatcacttcattaatataagtgataaagcgcgcaccatctgctccatcaatcactcggtggtcgaaagacagagacataggcagaatcagacgaggaacgaattccttgccattccagacgggtttcatagaagaacgggacagccccatgattgccacttctggtgcattcacgataggtgcaaagccggtagtaccaataccacctaagctggagatagtgaagcaccctccctgcatgtcggaagccgtcagcttaccagcacgcgctttcttggatacttcagccagttctcttgacagttccatgatgcctttcttattgacatctttgaacacaggaacaaccagaccattaggtgtatcaaccgcgataccgatgttgatgtattttttcaggatcagcttctggccatcttcagagatagagctgttaaaacgaggcatcgcttccagtgctttcgcagccgctttcatcacgaatacgagcggagtgatcttcacgcccagctgtttcttctcagcttctttgttctgctgtttacggaactcttcaacttcagtgatatccgcttcatcgaacaagttaacatgagggatcatgacccagttacggctcagattagcaccggaaattttctggatgcggctcatttcaacttcttcgatttcaccaaacttgctgaaatcaattttcggccaaggcagcatacctggcatgccaccacccgcagcagcagtaggagccgcttctgcgcgtttaatcgcatcttttacgtaagcctgaatgtcttcgcgcagaatacggcctttgcgacctgttcctttcactttcgccagattcacaccaaattcacgcgccagacgacgaatgacgggagtcgcatggacgtaagcgtcattttctgcgaattcgttcttaccttctgctggctgacttgcagctggagctgcttttaccgattcaaccgcaagagatggtgccgctgccagtgctacagcaggagctgcgcccaccacttcgaataccataatcaaagaacccgttttgactttgtcgccaacggcaatcttgatttctttcacagtacccgcaaatggagcagggacttccattgaagctttgtcaccttcaacggtgatcagggactgctcttcagtgatggtgtcaccgacttttaccatgatttcggtcacttcaacttcatcgccaccgatgtcaggtacgttgacttcttttgctgctgatgccgcaggagccgctgctaccggagccggagctgctgctggcgctgcgccagaacctgcaacttcgaataccatgatcagagaacccgttttgactttatcgccagccgcaatcttgatttctttcacagtacccgcgaatggagccggaacttccatagaagccttgtcgccttctacagtgatcagagactgttcttcagtgatagtgtcaccgacttttaccatgatttcggtcacttcaacttcatcgccaccgatgtcaggtacgttgactactttgctttcagccgccgcagatgctgctgctttctgctgcacaggcgcagcttctgctgcaccttttgcggactcgaaaatcatgatcagtttgccggtttcaattttgtcaccaactgcaactttgatttctttaaccacaccggcctgtggtgatgggacttccatggaagccttgtcaccttcaacagtgatcagtgactgctctgcttctacggtgtcacccgctttcaccagaatctcggtaacttcaacttcatcagcaccgatatcaggtacgttaatttcaatagacattaatctttacctcttatgccagacgtgggttaactttttctgggttgatgttatattttttaatagcttcttcaacgactttcacatcaacttcgccgcgtttagccaattcacccagagcagcgacaaccacgtaagaagcatcaacttcaaagtgatgacgcaggttttcacggctgtcagaacgaccgaaaccgtcagtacccaatacgcggaattcgcttacaggtacgaagttacgaacctgctctgcaaacaacttcatgtagtcagtagacgctattgctggtgcttcattcatgatctgcgcaatataaggaacacggggttcctctgatgggtgcagcatattccaacgctcacaatcctgaccatcacgcgccagttcagtgaaggacgttacgctgtatacatcagaaccaataccatactcgtcagataggatcttagctgcttcacgaacatgacgcaggatagaacctgaacccagcaactgaactttacctttcgcactgtcaaaagcttccagcttgtagatacctttacggataccttcctcagcacccgcaggcattgctggcatgtggtagttttcgttcagtgtagtgatatagtagtagatgttttcttgtttctcaccatacatgcgctctaaaccgtcatgcatgataacagccacttcataagcgaatgctggatcgtaagagatacagttagggatagtcagagactgaatgtggctatggccatcttcgtgctgcaagccttcaccgttcagagtcgtacggccagaagtaccacctaccagaaagccacgagcctgttggtcgccagccgcccagcacagatcaccgatacgctggaatccgaacatagaatagtagatgtagaacggaatcattggcaggttgttggtgctgtatgaagttgcagcagccagccaagatgaggcggcacctaactcgttgataccttcctgcaggatctggcctttggcatcttctttatagtatgcaacctgctcacggtcttgcggagtatattgctgaccattcgggctataaataccgatttgacggaacagaccttccataccgaaagtacgtgcttcgtcagcgatgattggaaccagacgatctttgatcgacttattcttcagcataacgttcagtgcacgaacgaaggcgatagtagtagaaatttctttggattgttcttccagcagtgagctgaagtcttccagtgcaggcatttccagtttttcgtcgaagtttacacgacggcttggcaggtaaccacccagcgcattacgacgctcatgcagatatttggactcttcagagtctttatcaaaagtgacgtatggcagtttttcaatgtgttcatcagacacaggcacattgaaacgatcacggaagtgacggacaccttccatattcattttcttaacctgatgagcaatgtttttaccttcagcggtatcacccataccataacccttgatggtctgagccagaattaccgttggttgacccgtggtattctgcgctttattcagtgcagcatagactttcttaggatcatgaccaccgcggttcagagcccagatttcatcatcagtcatatctttgaccaatgctgcggtttctgggtaacggccgaagaagtgctcacgcacataagtgccatctttggacttgaatgtctggtagtcaccatccagagtctcattcatcagttgaaccagtttaccgctagtgtctttacgcagcagctcgtcccaacgctcgccccacagaactttcagtaccttccagccagcacccgcgaaaataccttccagttcgttaacgattttgccgttaccagtcactgggccatcaagacgctgtaagttacagttgatgacgaagacaaggttatctagtttttcacgagttgcgatagtgatcgcacctttggattctggttcatccatttcaccgtcacccaagaaagcataaacggtttgttgagacgtattcttcagaccacggtgttccaaatatttcaggaatttagcctgataaatagcagaaattgggcccagacccattgaaaccgtagggaactgccagaaatcaggcatcaattttggatgcggataagaagacaggccattaccaccaatttcctgacggaaattgttcatctgctcttcagtcaaacggccttccaagaaagcacgtgcataaacgcccggagaaatatggccctggaagtaaaccaaatcgccgccatcattttcattgcgagcgcggaagaaatggttaaagcaaacgtcgtaaaaagtagcagaagactggaatgaagccatgtggccgcccagatctagatctttcttagatgcacgcagaacggtcatcaccgcattccagcgaatagcagagcggatacgacgctccaaatccagattgccagggtaagcaggctcatcctcaacaggaatagtgttgatgtaatcacgacttgcaacacctgctgcaacgctaactccacctttgcgggcctcgttcaaaacctgatcaatcaggaactgagcacgctcaacaccctcttcacggatgaccgattcgatcgcctgtaaccaatcgcgagtttcgatcggatccacgtcatttttcaaaatatctgacatggtgtattccttatctgttatctatttctaatggttgttttggagcctatcttctggtcataccttttgacgttttgccagtcatgaccggaagataggccctgctatatgttgccgctaaaactcttgaataaagagttgacgaactgtacagacgcagcagccaagatctgtacagctaagattataaaacctacccccatccgggagttttaattgtcaatgacgcccctgaggataggcatttattcctgatgttgctggagccggcgtagtgagcgttcacgacgagtatgctcacgagtcagatccaataaaacttcttcaataaaagccaaatggcgatgcgaagcctcacgagctttttccggttctctcgccataatcgcacgaaaaatctctgtcctgtggttactgacagctgctaacatttccttgcgggtatagataaattcgaagttgcgtcggatattttgttccagtatggggatcatacagcgcagcaaatgtagcaataccacgttatgggcagcttcggtgacaacaagctgatattgcaggactgcatctgattccgctttaacatcaccgccttgctgggcttcctgaatggcaaagtggcttttttcgatgcgctcgaaatcttcatcggttcccctaagagccgcataatatgccgcaataccttccagcgcatggcgcgcttcaaggagatcaaattgagattcttgattatctgcaataagccgggcgagtgggtcgctgaaactttgccagagattactctgcacgaaagttcccccgccctgacgacggaaaagaaaacccttggcttccaatttttgaatagcttcgcgtagtgaagggcgtgatacctcaaactgctttgccagctcacgctcaggcagcagcttttctcccgggcgtaacgagccttcgagaatgagatgttcaagacgctgctcaatcacatctgataacttgggttggcgaatcttgctataggccatatctgctgtaagccattcaatgagtaaatgttgcttcggattagtcatgagaaccgggtcagatcaactggatcgtgatcaattcagcctcagttaatcgggctgtagtcaattggtaataccaatttagaagacagggtcttaaagtaacaaagtattcattagctgtctataaagaccttgagctaaatcataaaaacctgcaaattttaacaaattattttaaattttatcagaaaatcgtaaccaaaagggattttcaggtaagaaaatttgatggggtttaatttttaaaaacgtgtagataggcaagttgaatcgttacagttagaaatatatagtatatttattcacatagcatatatattaattcaattaaatttgatagatgagtaataatcaataatagttaatgggtcaaccaaattaactgggctcactctttccaaacacctgaccaaaaaaattcccgccagcgttatccttaatgtcatgacgggaactgaactgtgaaaagtgctacattaatattgataatactaatatagataattcctgaatagttaaaatattccctaggttaaaattcctattatctacgttttatacatgtccataacattatttttattttcgggaaaatattatcgctataatactataatgttttttattaatagctattttattagctttaatgtttctatatcgttatatattctaaatatatagaaaacaattatcatggaatatcattcatctaattactttcactatatagattcataattcataattcataattcataattcataattcataattcataattcataattcataattcataaacttaaataataaataacgcacacaaaaaataaaatatattattaaccgaataatttaaaaagaaattaatattaaaaccagccccctttcacatttatatatccttcatcttccaacttgttgttttgctgatgactttcattcccccagtgactcttttttattcgttaagctaatgctccatagatcgtcaacaatgcaacaataatcacaatagtcaatgtcgcctttttcgctaacctaacagccgcaacaggagtttctattggattaagatgaggttccttacttaaggcaaactgagccaattgacttaccaccttatattgagatgtccgaagatcactgagggatgcaacccaagctggcaaggctttttccccatgccctaataaagcataagcgatccccgccagacgagcaggaacccaatccagacagtgcagcaaactatcaaccccagtttgtgcacgttgcacagtcgttccgtgttgtgccaaccatccttgataacccctcaaaaaaccgtatcccattaagattgcaggacctaattttcccatcactaccaaccagaaaatcggtgcaagataataacggaaatttatccagatcaatgcattctgtatctcacgcaatcgctcatcttttgtggtatcaggtagagttccctgtatcatcgtcaaacggacaaggtgattattttgctgatccagttcatcaagacgtacagctcgaagatattcccgatagtcataacgcaaagaccctgcaccaatacacaacaagctgatcatgatatacagcagaattcccggtacaccaaaaaccacatcactcaaaacatcaataagtttccaggtcagtaatgcgatcagtagggtcatacccaaactgctccataatgaaaataatttcatcctggcaaacaaaggggacaaatagcgttccaactgccaatggtcgcccatcttaaaaacacgttcccatgccagtactaacaatagaataaagagagtcattcaactcactccttcaatagttgccgataatgttcccaataaaaataaggccctgggtcggttttcctacccggagcgatatcactgtgccccgtaatattattgcggatatcaggaaagtgacagataagcaattgggtaacttccgccagtctgaggtactggatttcactaaatggctcataatccgtcccctccaactcaatacctatcgaaaaatcattacatttctcacggtcacagtagcaggatacgccagcatgccaagcccttttatcaaaagggacatattgcacaatttctccatcgcggcggattaagcaatgagcagaaacacataatccctttatctcattaaagaacggatcttcatctgaattcagcgttcccataaatagctgatcgatataaggcccgccaaacttgccgggaggtaaactgatattatgaatgaccagtaatgatgggatttcaccttccggacgcagatcataatatggagagattaccttccttgcaccatcaatccacccttcatgcagcttcattcttttactctcctcaatatctcaacagcaatattcccaaccaagtggaatggcaccactcaaagtgtaacaggttaacatgttagcattttcaatcgagtactatttctggtgtgtttttcatttgcgaaccagctcgaaaattcctctgtaaaaaatgtaacgaatagttattttttcgagctatttccataactattactgaagctattttatttttctctgtttttgtcatccttataaatgccgacatctatcggggatcatgctccataccatgagaaaacacacaaaggaggaagaatgaaccaacaagggtttacattaatggaattgatggttgttatggcgattgtgtctatccttggcgcaattgctattcccagttatcagggatatatccaaaaagcagcattaaccgatatgctacaaactattgtgccttataaatctggcgttgaactttgtcgttttgaaacagaaaactataaagactgtaatactggccatgcatcaattccatcaggtcataatagccgctatatcagcaccgttacggtaaaggacggagaaataatcatcgtcggacaacaaaatctcaatgggctcactactaccttaaaaccaacccaagataccaaaaccggcgttatctactggcgtaccatctgtgatactaaaaatgaatccttaaaattgaaatgtcaggaaacttttaagttttaaacagttaaattttaaaaccactctattttcaaacatattatttcgaaaaataagattttaaaattgcttcaacattaaaggaatatagaaaatgagaaacaaggaaaatgtattaatggaaagggaaatcaatgaactgtgtcaacgacatcaggccattattataaaaagagagatccataccatgactattgcctgtagcaaatcacccaatgaagatttcattgctgcattacgatttatttctggctcaatcattaatgtagatatttggccaaaagcaaaaatagaatccatgctgacacaaggaagttcattggtatcttgtacagaaaatcactgtgctgaaaatgatgatgaggaacattatcgtatcgaaaaactggatgtcccccattccagtcacagtgaaatacaaacaaacgatgcttattccgaagatatggacacgccagttattcaattaattaatcaaacgatatcaacctcaatacaaaaaagagcctcagatattcattttgagcctgctcaacgtggctatcggatacgtattcgggttgatggaatcctgcatgctgtatcatcaccttctccccaaatgaataccggtattccagcccgtttgaagatcatggcaaaactcaatattgctgaaaaacgccagccgcaggatgggcaatttgcctggaatgatagcaaaaacagttatgcgatacgtatatcaacattgccaactctacatggagaaaagattgtcctgcgcgttttaaataccatacaccagctatcgctggagcaacttggcctgccagagcctcaattgcaacttttaaaacagaaaatccacttaccgcaaggtatgatcctagtgacaggcccgacaggaagcggtaaaactgtcacgctgtatagctgtctgcaatatttaaatcaggcgaagaaaaatatctgtagcgtcgaagatccggtagaaattcccttaagtggcatcaaccagacaccagtaaacaacaaaattggcctcgattttgccaaagtcctcagagcattattacggcaagatcccgatatcattatggtcggtgaaatccgtgacaatgaaaccgccgagatatcgatgaaggcagcgcaaacaggtcatctggttttatcgacactgcataccaattcgacaattgatacgttatcccgcctgcaaaatttggggatttcaggctataccacagcatcgtgcgtgaaattgattattgcacagcggctggtgcgtacactctgcccccattgccgccagcaagataaagaatgcactgtcatcaatgtcgacaatgccgctattcctataaaaaaaaccgattccgtaaaacaatctatttctataagacaatggcttgcggttggctgtgaacactgtttttctggctattatggcaggacagccatctacgaatttcttgagctccagccaacccttcagcagactctgtcagaacactcgattgataaccttccccaattactcgctgcacaacagcattcaactcttttttccgcagggctggttttggtggaaaaaggcataacaacactggaagaggtttatcagattacaggtcaggaaacagcatgaaaatggaatatatttatcaatggcaagcggtcaataaaaaaggaaacattgtaaaaggggaaagcatcggccagagcagacaaaacgtgtttcaatatctgagccaccttgatttgcaaccttataccattaaatgcaaaaaactcattcattacagcgaaaaggaaatcgcttatcgcttacatttcattcatcaattaagcacattactggcatcaggtattcccctattaaaggggcttactctcttattacaggaatgtaaacaaatgctttggcgatgtgtattaacggatattattcaaaaaatcagccaaggtgagtcattttccacgacattgggacactatccccggctattttcgcccctatttcgccagcttatcgcagtaggcgaagaaaccggccagcttgaaacctgctgccaattaattatcaaccgattggaacaacaagatatattacgtaagaaaatccagaaagcttaccgttatcccttaatcgtagcctttgtaactattcttgtcattttactgatgctgatttttgttctgccggaattcaagcaagtttattcttcgtttaatgcctcactgcctctcttaacacagtggattttatccgcctctgatttactaattaatcacggtgtattacttttggcaatagcctctctattgataatcagctacctatggctgcgccatcaatttcccaaactaaaaacaagggaaaagatgttccttctgaaactccctctttttaggcaactcacaatttatcaacaaaccaaccagatatttcatattctgtttatgacacaaaaagcaggtctaacactaacaacagggttggaatgtgctctgaacgcgactcaccaccctgtattcatggcagggataaaaaatctgtacaggcaaattcagcaaggtatacccatgagtgatgctttaaagaaagagatgtactttccaccattatgtcagcagtttgtcatgataggtgaagaatcaggagaattagaattatttttggggaatctagcagcatggtatcaagaacaatcaatcagccttgctgatagtctagtgcaattacttgagcccgtactgatgctgataatggcagtgattgttggtttattattgctggctatgtacctgcctgtttttcagttaggtacgatactaacgtaacagttcatttacatgttccactgcctatcttcgaggatcttaaagcaggaattatacccgtttgtttatagcccatagaactcccttgagttacaatttaaatatgctatcagaaatattttaagggatagaatgagttatattattgcactcacaggtggaattggtagcggtaaaacgactatctctaatgtgttttcatcccttggtgtcccgcttattgatgcagatattatcgccagagaggttgttgctccgggttcccccgccttgcaggcaatcgcagagcactttggttctgacatattgctgccggatggcagtttaaatcgcgtctttctgcgccaaaaaatttttgcagttccagcagaaaagcagtggatcaatgcacttctccacccgctgatacacacagaaacccaacagcaactaagtcaagtcactgccccttatgccatttgggtcgttcctctgttaattgaaaataatttaatgcatttggcagatcgtattttagttgttgatgttccccctgaaatacagatcagccgaacaatgacacgtgacggagtaagtcgtgagcaagtcgagaacattctggctgcacaggccaaccgtcatgaaaggctggaaaaagcggatgatgtcatattcaaccatcacaatgagcaggatatcatctcccgtgtggccgaattacaccaacagtatttgaaacaagcagaatcagtcagacaggaaaatcgtaatgagtgatgcaacctccactattatctttgaacacccactcaatgaaaaaatgcgttcatggctgaggattgattcttcactgcaacaactggaaaaacagcagtatctagattcatcggcgagttgtctcgcgtttttccgtacaattgctgaattaatcgaaatactggaacgcggtgaagttcgctctgaattattgaaagagctggatcgccaacaggcaaaattaaagcaatggctcggttcgcccgatgttgatacggcgatgatccacctactgatagagcaactcaaggaacggagcatcgccttgaataaggctccacgtctcagccagcacattaaagaagatcgtatcatcaacattgtgcgtaaacggcttagcatcccgggaggatgttgcagttttgacttacccacgttacacctgtggctacatttaccacagtctgtcagagataaaaccgtcaaatcttggctggacagcctacacccattacagcaagcactggaaagcatcctggggttaatacgccaatccgccatattttctccaaaaatcagccacaacggtttctatcagggaaatgctgatgagtctgatttattgagattaaagttagatgtcgtactggatgcactggtctatccacaaatatccggtcacaagacccgttttgccatccgttttctgccgatggatagcgagcacggtgttgtacctgcacatttgtcatttgaattagcctgctgttaacatagccttcaaatcaagcaggagaaagtaaagatgtctgaagtattgaccgtcgcatgcccgacttgcgctaaaacggtaatatggggagaaatcaacccatatcgcccattttgcagtaaacgttgccaattaatcgacttaggcgaatgggccagtgaagaaaaaaaaatcgccagtcaggacgacagctcagaaaacgatagctggagtgaagaaccagatcggtaataaccaccaacgtagcgccgattgtattcggcgctaccgttaattatttgttttgtttaatgagatccgcttttgttcagcaaagccactatgctgcggtttgctggcggaaactcatcagcgatcaattcggtttgcaaaacccaacgggaaggctgcccctctttaccaaatggctcatttttccattgatccacaaggtaaaaatagagtgtgatgtttctgtcagaaaattcatgagtgatggtttccaccaattcacaatgggttaccgtgatccccacttcttccttcaattcccgaataagtgcctgctccggaatttcttcctgttcaagttttcctcccggaaattcccaaaagccgcccatatgtgagtcagcatgacgctgagtgataaaaatctcatcattggtatttttaatgatgccggccgcaatatgcagatgttttttttccataatagtctttcttgcagttgattatttaatcaatgtgattatttcttgcggactataataaacagtcatatgagaaagaaacaggattaatctcatgagagccgtaatcacgtcttattgctttttgccaagattcacccaaataaaagcgtattatgtggacacattttggtaagcggtatctgacattagccgacaaatagaatccgacatagaaagcataaagccgtactttaaagattaaggaagcatcattcatgcaatctgaaagccaaccattgatcgaagcaaagcaaatcgcctatcaattttctggtgaaatcattcctctgttttctggtattgatatggttttgaacgcggaacaacacgctttagtcggtcgtaacggtattggtaaatcttggctagcatcaatattggctcggcaaataccaccgacagaaggcagtgtgaaccatttccgtgatgttggttatctgtcacaaggtctaacatccttttcaggtaatgcggctgagatgttaggactaactgagatcatgaatgccaatgaacgcattctagcgggcgtcggtgatgtgacagattttgacatcatggaaaatcattgggattggcaatttcaagcggagtccctattggcagaaggagaattgcgccctgaagtattaaagcagccttttagttctctcagtggtggagaacagactcgcctcagactgctggcactaaaatatcagggagcggagtttatgattttggatgaacccagtaatcaccttgatcgacaagggcgtctctggctggctcaatggctgacaaatttcagtggcggcattttactgattactcatgacccccaattattacaacatgtgtctgttgtctacgaactcagtgggttagggctatgccgcagcacaggtggatgggaaacgtggttagaaagtaaggaacagctacggttaggtgtacagcgcgaggttgatcagacgcgtaaaaacctcaaacaagccttgcgtgataagcaaaaagatcgagaaaaagccagtaaaagacaaagccaaggtaaacaacgacgggaaaatgccaatcaaagtaaaatcattcttgatcgggaattagggcgctcagaagccacgttgtcacgacaggctaaacaacatgaggaacgattacagcgaagcacttctctggccacagatgccagagcaagactggaaatcatcgatcctctgtcaatcacggttgctgcgccgcaaatagcgcctgctccgttactttatctgcaaaatgtcattttgccttttggttcaggctctcccatcagtttaacaatgaatcatagtgatcgcctcgctatcacgggaaaaaatggcagtggaaaatctaccttgctaaaagtgatggcaggtttatttcctaccaaacaaggcacttgccgaataacaccttcctatcgtctgatggatcaacatttttcatttcttgataaaaaccaatccgcactgcataactttcagttacagtcacccggttggcctgaagatcgttaccgtacccggctggcacaactgcgcattcgtggtgaagaagccttgaaaccggtaggctatctgagtggaggagaacaactcaaagtcgctcttgcctgcttgttttgtgggccttatgctcccgccctgctgctgctggatgaacctgacaatcatttggacattgaatcacgcgaactactccagaaagcgctgcatagttatactggtgcgatggtactgatttcccacgatgctcagtttattgcaaatattggcaatatgcaggaattactattgggtagcagcgaggattttcttcataaaaaaaccctcaaatcattctctgagagatgagttttgagggttttatccaatcagccaacgacaatgaatcgctggctctttattactatttttattataaactgccgtggcaatgcttaaattttttgcctgagccacatgggcaaggatcgttgcgtcccagtttacgtgcgccactcgccatctgtgcttctgtttctgacattaaagcgccttgctcaacttcatggctcaaatgctgtttctttgccaaacgctccgcttcttcacggcgctgattctcaagcgcttccacttcttccggtattctgacctgaactttactcaatgtactgatcacttcatatttcagcgattccagcatattagcaaacatggcaaaagattcgcgtttatactcctgctttggatctttctgtgcatagccacgcagatgaataccttggcgcaggtagtccatcgcagccaagtgctctttccacagcgtatccaaggtttgcaacatgatgcctttttcaaagttacgcatcatttctgtactgacgatttcttctttctgtttgtaaacttcaatcgccttttcaagaatacgttcacgcagcgtttcttcgtgcaattcaggttctttgtccagccactccttgatcggcatatccagatcaaagtcgtttaccagacgctcatgtaaaccttctatatcccacatttcttccagagattgtggcggaatataggcgtcaatcgttaccttgaagacatcttcacgaatactggcaatggtttcgctgacatcacccacatcaagcagatcgttgcgttgggcataaatcgcacggcgctgatcgttggcaacatcatcatattccagcaattgcttacgaatatcgaagttacggctttctactttacgctgggcattggcaatcgctttagtaacccatgggtgttcaatcgattcacccggctgcatgccaagtttacgcatcatgccagtgacacgatcggaagcaaaaatacgcatcaaggagtcttccattgagagatagaagcgcgaagaaccagcatccccctgacgtcccgcacggccacgtaactggttatcgatacgccgtgattcatgacgctctgtaccaataatatgcaaaccgcccgctgcaagtacttcatcatgacgttcttgccatgcagctttaatttgctcgattttctcttggcttggttcttccagtttggcgatttcagactgccagcttccgcccaacacaatatccgtaccacgtccagccatgttagtcgcgatagtaaccgtgccagcctgtccggcctgtgcgataatatccgcctccattgcatggaatttggcattcaagacgttatgttcaatgcctgctttggttaatgctttagcaatgacttccgatttctcaatcgaaattgtccctaccaatataggctgaccattattggtgcgttctttaatgtcttcaatgatcgcatcgattttttccgcttcggtcatgtagaccagatccggcaaatctttacggatcatcggacggtttgtcggaacaacgatagtatccagtttataaatagaactgaattcaaaggcttctgtatcagcggttcccgtcatacctgccagtttttcatatatccggaagtagttctgaaatgtaatagaggccagtgtctggttttcattctgaatttcaacaccttctttcgcctcaaccgcctgatgcagtccatcagaccagcgacgtccctgcatggtacgcccggtgtgctcatcgacaatgatgacttcaccatctttgacgatgtaatctacatcgcgagtaaacaaaacgtgggcacgcagcgctgctgttacatggtgcatcagcatgatgttggtcggcgaatacagtgattcgccttcatccatcaatttggcaccaaccagcagttcttcaaccagaaccagaccacgctcagtgaggttaacctgacgtgttttttcatcaaccgagaagtgaccttctccctggaatgcctctgaatcttctttttcttggcggatcagtttaggtatcagtttgtccactttgatgtaaagttcagaactgtcttccgctggtccagaaataatcaacggggtacgggcttcatcgatcaggatcgaatccacctcatccaccagcgcatagtgcagtttgcgttgtactcgctcttctgggctaaacgccatgttgtctcgcaggtagtcgaaaccgtattcattgttggtgccgtaagtaatatctgcggcataggcttcgcgttttgcaggggctggcatgtttggcaggttaataccgacggtcagaccgaggtattcaaacaatggccgattgttttcggcgtcacgctgtgccagatagtcgttcacagtcacgacatgaacaccacgtccacccaaggcattaaggtaagctggcagtgttgcggtcagagttttaccttcacctgtacgcatctccgcaatacagcgttcgttcagcaccatcccacccagcaactgcacatcaaagtgacgcataccgaatacacgcttactggcttcgcgtacagtagcaaaggcttcaggcaaaattttctccagtgattcacctgctttcaggcgtgcacggaattgttctgtttttgcttttaattcttcatcggagagcttctcaaaatcaggctccatatggttgataatctcaaccgatttacgcaaacggcgtagggtacggtcattacggctaccaaaaatcttagtgagtaatttaatcagcataattaatacatctcagataaggccaaagttgcggccaaccaattgtgtcttctagactgtccaagcaaagctgtctcatcaaaaaataaaaagtaagacaggtgagttagttaaagcaaagataaatggttagctgttggccccgcgcgaattccctgagttttagctacccagagtgccggtgtgtgggaatcaggaagaatagtcgccgtaatttcaatatcaaggatggattcaaattgtgacggtgcttgtatcagcatagcatacaacgtatccagcataagttgttgcatgcatggagaagaaaatcgaatgctttcttttgctacttcgtgttggatagggccagtaatagaaaaagtaaaagaaagccgacgaataatgttgcgaacagcatgttgctgccagtaattcaaatgattcgaaggttgacgctggacactttgtaattgaaataagtgatcaaatgaggaaaatacctgattttggttcttttggctggaagaagtattactatgaggaaggctttctgttattccagctaaaacagcaggaacaccaattcctgtggcgaccatgcccagtaaaaggtgagaccaaaaataacgcctaccaaattgtcgccaaagatttaaaatactcattcacccttcattaataaatactggaactacctttaatatgcgagatagccgaccacaatcactggatacgctatttgaagatgaggcagctgtcggtaaaagccctcttcaaatcattcaacaacatgctattgcacttttgaaactcaaccgtgccatgctcagtttattgcccgcacaactgcatccatggtgcagggtcgccaattatcgcaaacatattctggtactggaagcaggaaatgccagttggatgacaagacttcgctatgaagtgcccgttttgctttcgacactgagaagcgaaattctaccatctttatcctctatcgacatcaggattaatccatcattaatggtcaaacgtagtaataatgcgcaagatttcgcaaaatcgtcaacaacagcacctaataataataatcagaatttaccaaagcgccaattgagccatgaaagtgcagaaacattaatgatattggctgaacgcagccctgagaaattgaaaaggaaattagagagattggctgcgctggccggagagggtaccagtacagccaaaaaaaagtgctagcgttgaataaaaaacatcagcaaaaaaagcgagacagataacataactctttgattaaccataggaatgttttcagtacactttttggctactatgccatcactgttgatggagcacggaaagccagcggcatttcagcctcatcttcaaacgtgacaaattcccaagcactttcatgcgccaagactgcttgcagcaacttgttattcaatgcatggcctgatttgaacgcagtaaacgcgccaatgatgttataaccacacatgaacagatcaccgatggcatccagcattttatgacggacgaactcatcttcaaaacgcagaccatcttcattgagtacgcggtagtcatctaccacaatggcgcaatcgaagctgccaccgaggcacaggccctgggattgcaggtactcaatatcgcgcataaatccaaaagtacgtgcgcggctaatctggcggacaaacgaatccgcagagaaatccaaactataacgttgtgaactggaatcaatagccggatggttgaagtcaatggtaaagtccagactaaaaccgtgatatggtgctaattcagcccatttatctccatcttctacgcgaactgcgtctttcatacgtacgaatttcttcgcgacattcagctcttcaatacctgcatccaacagcagaaaaacgaacgggctggcactaccatccataatagggatttctggtgcatcgacgtcaataacaatgttatcgatacccagacctgccaacgctgcgttcaagtgctcaacggttgaaattcgcacattgtgttcatttaccagacaagtacagagcatggtatcacgcacggatttagcattcgccggaaaatctaccggtggattcaaatcagtacgacgatagatgaccccggtattagccggcgctggacgcattgtcagcgtgacttttttaccggtgtgcaaaccaacgccggtcgcttgaacagtccgttttaatgtcctttgtttgatcatcattatatctcgcaatgttacccatcctgccaattactataaaacataattggcaggacagtttagcacaaaaagcggagaatcctatcttttagctattaatcagcctgtttgcgcaaaaatgctggaatgtccagataatcaggctctttgcttgtctgcgcattttgatcattgaccacttttgcagcagtttttttctcttcagacaatgacgggatttccacagaactctgccggtaccgcgatccatggattgactgagatacttgtggtggcaca

SEQ ID NO: 14968 - DNA, 62940 bp, Xenorhabdus bovienii
  unsure (1)..(62940): unsure at all n locations
  Genomic contig Name=Xb4151_4152.C427
tcaattcactcaacagtgtcaggcgattaattctgacttgttgatcttcatccatcaccatcacgttgtcgaagaacgcatccaccacttcacgcagagaagccagttcaaccagcgcatcctgatagttgccttccgcaaacagaggagccagcttatctttcaacaccacaagatgggtcgccagttggatctcttctgcggctttcaatacagaagcaagaacacagtcattcaacttctcttctgacttcgccagaatgttggaaacacgcttattagcggctgccagtgaaaccgcttcatccagtgtgcggaaatgcgttaccgctttcattcgggcatcaaaatctgccggttgagtcggacgacgcgccagcactgcctgaatagcatcaacgctgtaaccctgctcctgataccaagtgcggaaacggccgagcatgaactcaaccacatcatccaccacgttttcattggtcagtttgtcaccatacaaacgcacggcttcttctgccaaggtctggagatcaagcggcagttttttctcaacgataatacgcagaacacccagtgccgcacgacgcagtgcaaatggatctttatcccctttcggatgttgaccaataccgaagataccagcaagggtatccattttatcggcaatcgccacagcacaggaaacggccgtggatggcaactcatcgccagagaaacgcggctgatactgttcattcagtgccagagccacatcttccgcttcaccatcatggcgagcgtagtgcattcccatcacgccctgagtgtccgtgaactcaaataccatgttggtcatcagatcacatttggacaacagacccgcgcgggtcgcatgagtgacatctgcaccgattttttcggcaatccagccagccagagcctgaatacgatccgttttgtcacgcagtgtacccagctgcttctggaacagtaccgtttccagacgcaacagattatcttccaaacgctgcttgcggtcagtcttaaagaagaattccgcatctgccaaccgtgggcgcaccactttttcgttacccgaaatgatctgctgtggatcagacgattcaatattggcaacaaaaataaagtttgccatcaatttgccggatttatcgtaaaccgggaaatatttctgatcgcctttcatggtgtaaaccagcgcttcggcaggcacttcaaggaatttctcttcgaatttcgctgtcagaaccactggccattccaccaaagaagtcacttcttccagcaggctgtcggtcagatctgccacaccgccaagctgcatcgctgcctgctctgcatcacgtttgatcaacgctttacgtgcataataatccgcaataacacggccacgttcctgcaaaatcgtcgggtattgctctgcattatcaatcgcaaactccgcctcgcccataaagcgatgaccacggataatacgatcagatttgatgcccagaatttcaccgtcaatcacgtcactgcccagcagcatcgtgaccgtatgcacagggcggacaaactgggtttctttatcgccccagcgcatcagtttagggatcggtagcttgcccaacgaactgctcaccatatccgccagcagttctttcgcttcacggcctttaacctgcgcacgataaagcagccattcgcctttatccgttaccatgcgctcggcttgatcaactgtgataccacagccacgcgcccagccttccgcggctttagttggcttgccttccgcatcaaatgcctgagcaatagccgggccacgtttttccacttcgcgatcagcctgtgccacagccagatttgccactttcagtgccagacgacgaggggctgcaaaccagctaatttcaccatgacccagattggcgtttttcagttctgcttcaaaattggccgcaaaggactcagccagcgagcgcagcgcctttggtggcaactcttctgtgccgatttccacaaggaaagtctgttgaatcatgatggcctctcaattcttcttacacatagggaagccaagcgcctcgcgggaggcataatatgcttcagcaaccgatttggtcagggtacgaatacgcagaatatagcgctgacgttcagtcacggagatcgctttacgagcatccagcaaattgaaggtatggccggctttcaaaatacgctcataagctggcagtggcagtggtgcttccaacgccaacagctcctgtgcttctttttcatactgttcaaagcaagtgaacaggaaatccacatcagcgtgttcgaaattataggtagactgttcaacttcattctggtgataaatatcaccataagtcgttttacccagtgggccatcgctccacaccagatcgtaaacgctgtccacgccctgaatatacatcgcgagacgttccagaccgtaagtgacttcaccagtaactggtttgcactcaagaccaccgacttgctggaagtaagtgaactgagtcacttccataccgttcagccaaacttcccaacccagcccccatgcgcccagcgttgggttttcccagttgtcttcaacaaaacggatatcgtgaacggtagggtcgagccccaacgctttcaacgaaccaagataaagctcctgaatgttgtccggagatggcttgatgatgacctgaaactggtaatagtgctgaaggcgattcgggttttcaccgtaacgaccgtcagttggacgacgggaaggttgcacataagctgccgcaatgggttctggccctaaagcgcgcaggcaggtcatagggtgagaagttcctgcgccgacttccatatccagtggttggacaatggtacagccttgacgcgcccagtaatcctgcaatgtcaggatgagcccctgaaaggttttggtatcaaacttttgcatgttgaatccacacgcgatacatcacgcgatacatatgaatttaaacgaaagcggtcagtataccctttgaccgtaagatatacagcactgatcacccgccaattttgccgcagtataaaaaaatcttatccgagcctctttacttgtatatttatacagttaatataagttcaattattcaccatcgtctgtgggagtaaaaatatggaatttatcaacaaggaaagtattcgctgtggttgggtcaccgccgatccggattatcttgcctatcacgataatgagtggggcaagccactgaagaatagccagcagctctttgaactgctctgccttgaagggcagcaagcggggttatcatggctgacgattctaaaaaaacggcagggctaccggaaatgcttccatcaatttgatccggtcaaaatcgccggcatggatgaaaacgatgtcgaacaactgctcaaagatcctgctattgtgcgcaatcgtaccaaaatcaatgccattatccacaatgcccgtatttacctgcaaatggccgatcaaggagaggatttcagttcatttatctggcattttgttgatgattccccactcattaatcactggaaatcacggacagacgttcctgtcagaacccccatttctgatgacctgtcaaatgcactgaaaaaacggggtttcaaatttattggcagcacaacctgctatgcgtttatgcaagcggcaggtttagtcaatgatcacctcacgagttgcctgtgccgaaaaattgaaatcaatgcataaagataggtgataaatttactttaaaatataaagctggagaaattcaaaagacccagtgtttaaattcaatgaatattcaatgaatcatcatattataatatataacaacacagagaacagactttaccccattgcgccccaataaggggcggggtatggtgtccccttctcctataaaacaacagacgcaaacgccgttatgaaattttctcaattcggaaacaaattcacacaagattcaggaattacccgcctgatgaatgatctcaaccaaggcctgagaacacctggcaccattatgctaggtggtggcaatcctgcccatattcctgaaatggatgattatttccagcagatattggctgatctggtgtcaagcggccaattgaccgaaaccctgtgcaactatgatggaccacaagggaaaaatacgctgatagcggcattggcccaagagttacaggaaaagctcggttgggagatccatccacaaaatatcgcattgaccaacggcagccaaagcgcctttttctacctgttcaatctactggctggccgcagtgaagatggctcgatgaagcgagttttattccctcttgcacctgaatacatcggctattccgattctggtctggatgaagggctgtttgtcgccaataaaccaaatattgagttgctgcccaatggccaattcaagtatcgggtcgatttcgatcacctgaatatttccgaagatatcagcctgatttgcgtctcccgtccaaccaaccctaccggtaatgtcattactgacgaagagttactgcgcttagatgggctagctcaacaacatcagatcccgctgttaatcgacaatgcctatggtgtaccgttccccggaattatcttcaatgacgcgacaccactgtggaatcccaatattatcctgtgcatgagcctgtccaaacttggcctgccgggttcccgctgcgggattatcatcgctaatgaaaaaatcatcagtgccgtcagtaatatgaatggtgttattagcctcgcaccgggcggtgtaggccccgctatcgcgttggaaatgatcagacgcaatgatttattccgcctgtctcaaaatgtcatccagccattttataaaacgcgggtagacaacgtgattgagatcattcgtcgccatatgtcagaagatctctgccttatccataagccggaaggtgcaatattcctctggctctggttcaaaaacctgccaatcaccacggaagtgctttatcagcgtttgaagaaacggaaagtgttaatggtgccgggtcatttctttttcccaggtctggagcacaactggccgcatgcccaccaatgtatgcgcatgaactatgtacctgatttggaaaagatcgaagagggcattcgcattctgtcggaagagattgagatcgcacatagagaagcgacccgctgatttgggcacaaaaaaaagctccctcatttagggggagggagcaagatgataacgaggacttttacctgtgaacaggacagtagttattagaatccaaaaagaattcttcacacacaattaggaaaggaaaacaatccctgtttatactctttccctgaactgagtctatttaatcagaaaagtaagaatctaataacttgaataagaaagttttttttgccttaaattgcctttactatgtgaaattgagacgattgagccatattgtgtgatctaaagcacatttaatgaatcaagaaaatttccttaattattcaaaatcatttttaaacatcacatcgcctagaaaataatcgccaatatttgaggtaacataatcatcaaaaacatcaccagtggataaaccatcgtatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtataaataagttttcaaaatagtagatcacttgaagggaactcagcccggtttttgcgatctgattaatcgccaaatcaaaaaaatcccaaaatggactgagtaatgccaatcatagcacccataccccgaagtgaacgacgtcagatgaaaaaatttattcataaaacccgggataaagattatgcacgccgactcatggcactcttaatgttacatgaaggcaagaccgtttctgccatctccagaacccttcattgttcacgttcttcggttaatcgttggataaattggtttacattatatgggctggaaggattaaaaagtttaccgtcaggaagacctgctatctggaatttagcgccactttttagtttgctgtcgttcttattacagcactccccacaggattttggctgcctgcgttcacgttggagcattgagctgattactcgaataatcaatgaattattcggtttgtcgctttcgcaaagtacgttctatcgttatttctgtcaggtcggtattgtctggcgaagggcagcacctaccgtcaaaaagcctgatcctgagtatgacgaaaaaatggcaaaaatcactgaagctttatccagcgtgtcagaacaacatcctgttttttacgaagatgaagtcgatattgaccttaaccccaaaatcggggcggactggtgtctgaaaggacaacaaaaacgggtcatgacgccgggaaaaaatcaaaaacactactttgcgggctgccttgacgcccaaacaggccaagtgacttatgtcagcggtataaagaaaaattctgatttatttatcaacatgttaaaggaactgaatggccaatatcgccatgcaaaaaacatcacgttgattttagataactatggcattcataaaagccggaaagtcagggcatggctacaacaaaatcctaaatttaatttgttgtttttaccggtctattcgccatggataaataagattgaacgcctatggcaatcattgcatgaaactgtcacacgggatcattgttgtcagtatatgtggcaactcttgaaatgcgttgaagcgtttattaacgcattttcatcagggcaacaaccgggaatgagaaaaatgagtgtatcactattatgaaaacttatttatatccggcgtcatgattggctcatttgcctgtgccatgatgtcattcgcaccctgtttccttatcactacataggtctgttcagagtcgaaagatcgaggatagacaatcccggccgcttttgggtaatacctgaataagtgcgctcaagtagcaggtcacgctcaaattctacaacggcagcaatcacctgcatggtcatttttccaccttatccagaagacgaacaaatcctggtctttttttcatggcaacagggctactgatctattgtattcagcaacgcctgtgaggcatgatgattgattatgtttgaattgagagtatctcattattacgagaggtatgacacgaatgcgttgtcattatctgttcagtaactgtaggtgctgaatgaatatcagcaccacaaaagaagttgtttctttaagaagatttaagcacttctacacgcgctttattgtaggtaaggaaacctgaaattaccgctaatagtaatgctgtagaggcgagcaggccgcccactaaattgagtgaagcgtaaccataattagcggcgataacaatcccgcccaaccatgcgccgagtgcattgcctaaattaaaaaaaccaatattgactgaggaaacgagattaggcgcaccggcttcttgagctttatccatcaccagacgctggattggcgatactgtagcaaagccaaacgccgccatcagaaatatactcaagcaggcaatgaatggattgtcgccataaagccagaaaataaataaaactaaggcttgtaacccgagtgtccaatataacaatggcatcatcgccttgtccgcgagttttcccccgacgatattgccaaagaaaaatcccaaccccaagacgacaagaatccatgtgattgcactttctgaaaaacctgcaatatgggtcatcaacggcgcgatataagtaatagccgtaaagaatgcagcagggcctaaaaccgtgatccccatcgccagcagaacatggatatttgtaaaggccagcaattcctttttgatgctggtaggcgtttgttgtgtgaatttaggtaataattttaaaataccgagtaatgcgataatgccgataaaggtaataattgcaaaagtgacacgccatgaaataattttgcctatccatgtaccaagcggtataccaataagattggcaagcgtcattccactgaacataaatgcgatagcgcttgtcttcttattttctgccaccagttcggccgcaataatagcgcctattcccataaaagcgccgtgggtaagagatgttactatgcggccaacaattgccagatagaatgtgggagctaaagcagtcaaagcatttccaataataaataacatcattaatatggcgagcatcttttttctttctacctgtctccccaatataatcaaaacgggcgcaccaacaaatacaccaagagcataactggttgccatataccccgccataggtattgaaatattaaactcggttgcaatttcaggaagtaatccggcgataatgaattcggttgtagcaattccaaatgttgctatggctagagcccaaatagctgcaggcataggggaaactcctaatgagtgatgagaaatggggttattgttgaaacattctgtctttatctttggatgttgtctctgtagtaatatattcctgcggcatctcatttggaagcaattataaatcagttagatcaagacaaacgggtgacatgttcccaaaaatgtgaagataatggacaaaaaagctattttttctggaaagtgttttgcccaaaagcaagtgcttttgagcacattagttttgtcatgccaacgatggagtaacccataaatacagcagcaatcaatacaaagaaaatgaccatggcgcaagctttggtcaaatttctcaatcagcaatttattgacgtggatggagaagaatatccttttatccgtggcgttgctactggttttgccaagcagaaaaaacgccggcagatacctttgcctgccgccaaccctagccgtaagtggttatttacatgggaaaaagatcatcagtgggttaatggtgttgcgtatgtggaaaaacatacccgccgttaatctggcaaatcagtcgatggtggatgtttcattgggaaggtttcctttctgccgactttcgtcgagcattttgcgatgggtacgcaggatatagtaatcaactaacaacatacccatatgaacggcagccacacacagcagggataaacgctgttcttgtggctcgggcttaatggacagtgttcaattttgagcactatcatcgttcctcgatttgctttagataaagaggacgcctttttcaatgaggcgttcaggaatatatctatctaattgaaattgcatacaaaactcttcaaattgctgggtggagtggacattagctttctgatagatggtgtatattctgttttctatcgtcttatggctgacattgtatatctgggctatttccttatttgaacgtctttgcaacataaaaaagatggtatccagttcacttttggtaaatagatctgttgtagcttctgtagtgagaacacttggtttttggcgattaatatattttagaggggagagagtactcattggtttggcattccaaactatcccgatgcactcttttttatcgttgtacacagggaatttctcactgatgaaaggcgctaagctgttttttccataccaataatgtgtctcaataatagaaactttgtctttagattcttcagtcctcctatcatgttcttttagatcttgtgaaaattgatcttcagaccaatgtgtcggaaattcacagtcaagtttaccctctatgtcaaaatcttctggtgtgttggtgtaaagatatgcggctttattcatatagatatgtcgggacgctaaatctttaattccccaaggatcgcttagatgctccatcatggcgatcagtcccttgaaatagggttcattatttttataggaaaaactcatttttatctcatataatttataaatgttaaattttatattaaaaataataactgttgtatctatgtatttattaactcctgatgtatgaatactaattttttttgaaaaatgatgtgtttaaaatcaaaagtatcaatataatcgatatcctcactattttttgactgttttacggttttttattatccatttcctagtgtgtctattaaaatataacctattgatgaaatattttctatataagacaattttattgtaatattatataattctattcaaaaataaattgctatcactttttatgttttacgacaagggtgtttttcactctttccagacctaataaaaagtgtttaccctaaaaatccatgtaaattaactggttatatatttttctgggcgttgatatgtataaaaaacaaaaaatggaacacctgagaaaaaatttgcaatacttacttgattccagaggagagagccgggtatcgatctgtgatcgaaccgggcttaaccgcacaactatttataatattctggatgggagagttcaaaacgttcattcttcaacgatacagaaagtatccaacttttttggtgtgtcgtatagggagatagaaacgatcgatattgcagaaaaggaacgtattgatgctattgtttcttatgaaggaaacatgaatccctgtgccgttccgctatttatgcaatctgagtgtattatctctggtttttttgacagtaaaataggctcgctgattgttgaaagaaaactcacttattattttggttctggcccgaatatcgttgctattctacttgagaatgatttcccgggtaaatataatgctggtgatttattaataatcaaaagaggtaattaccagaacaataacccaaagttatgtttcgatcaaagacagcaactgtttcatattaaagaatttaatagtgaagttacgacaaatttgatggtgattggagatataatggaagagcggttcggatatgggaaaaaaatataaattactgggatttaacggtcaggatagtacagcgaatgtattaattttatcaacaggaaaaattttaaaaataaacgtaaaggagcttgagaaaagtgaaatagcagacgatctagacaatcatgaaataaaatcactttatagaaagatatattctagctttccaaacgtcccctcagtctatgaaattgaagaacgtaatgaaaaatcttgggttgtttattcatttctcgcgttactactgacaattttctacactttcagtaatatagcggcagctaaacccgtttacattgattatcttgatatcattgttaccccaggtactttcatttatcctttttcatttttagtcattgatttactgagtgaattctatggattcaggctagcaagaaaagcgatatatatgtcattggcttctaatctgattattgtatccttgctgagtatctcgacaagtctacctgccatcgcaagctgggatttaaatgatcagtacaatgccctgatgagtcatattttatcggcgatctttgcttcttcgctgtcatttctagtttcagagcttgttaactcctatatattatgtaagctgaaggatgtgacaaactcccgatttttagcgttaagagtgttttttagtacctttatcgcatcaattcttgacagttttgttttctgtttcatcgcattctatggaaaacttcctgtaaatcaaattgttgtcatgatgattgttcaaattttaattaaaattttctttgcattatttaatattttccctgcttacggctcacgttatttatttaatcggtgggttggtaaaacagcaaattaatgaatggcatggggaacttctccatgccattttttgataaaaccctgtcttattttgttttgcgtcgtcgtcatgtgatgggttgacatttttgctatgtgtcactatttgccattcactccgttattgtgattctgctaccatttcgattttttatacagtaaccctactcatattcatgttatctatccattatggcgggtgctttaccttgttttttgctgcacagaatggcttctgtacttatgtataaaatttaattaaatatcaattacatatgtattttcgtttgttattttgttcatgatgaatcaaataatgacatgaatattcatcactaaaatcaacatttatgtttttatatgttgattttagcgtgtgtctggtgtattaatttgatcgttaaaatataagttataattaagtttttgtctggatactgataaaggaagtctaacttccctttaaacagacaaattattttcattattttgaatagatgatttctattcgcccaacaccagaatattagtacgttttttattcttataatagtcagtcccttaaccagatcttttggttaagggactgaaaaatctactatacccaatagatttcaatttacagttcagcggcaagttaacgcagctaacaacgaagatgaagggtatcagctcagcaaacccattcagaccagtatcttggcagataggcgatagatcttctcgtggcctgtcatttcgccaaactctgctctaactatcatcccttctataaatgtcatcagggcttctgttttgatttctgcatccgtctgattggcagagaaaatggaagataagagtgattttaaccatgtcttatgccgttgagcctgtttgacaatcagctcatcgtggcctttgaactcggctaaggcatgcataaataagcacccttgaaaatcggctgatctgaaccatgagaagtgccagtcaaggatagcattcagcttattttccgttcccttagtggcaaataccaccgtattgagttcctcttcaaatctcttatgtcgtctgattaacatactctctatcagtttgtttttggaaccgaaatagcggtacatggatgtttttgacacattcgccttatctcggatcagatcgactcctaccgcgttatagccgaattcattaaacagggattcagcgatatctaagatatgttcttttttgctcataatattttcttcttgtttattctaattagttctaatgatcgtccatattcctgacaaatcgaacgttgcctttatgtgtacagatctgtactatttgttgctatgtacagaactgtacacttagagtatcacattgactgagtcatatcgcaaacgaatcatagggagactaaagcatgagtaaattaagaggaggaggtggattaccacctaagccggatcttgttcaactaacgaaagggttatcaggcggctttttggggatcttgttgctcagttatttaagccaaacaacggaatatccttggttaatggcgccttttggagcgacatgtgccattttgtttgctgcaccaacttctccgcttgctcaaccacggaatgttattggtggacatttactcactacggcggtggggcttgtcgcactatatacattgggtaattccatgattgtgatgtcactggcagtcggcattgcgattatgctgatgcagttattccgggtagttcatccgcctgcgggggctaatccgttagtggtacttctcgcagggcaagaggccgtgggttttgattttcttttaacacctgtattaacgggcagcttggcactggtcatcattgcatcttttcttaataacctaggaaaagagagttgttggccattatattggtatggttttaccaaaagaaaagatagctgacgctcattcgaagtgtgatttatttaactgtgctatataacacgataataaattggattaatatttaatattctctgttttcgcctgaaggttaaagaatatatgccattgggcgatttttacttctgtttgttaaagtaatgtttaaatttctgatgccggtaaaaaagtaaataacgggcagatgtaaagcacattatccaaatatgctattttattccctccataagtatcttattttcccgctctcccattgatattaatgttcaccaaattctctttatcggagatgaatttaatgatgtgatatcaatcattctattgcttgttattccatattgtaattctcatactaaaaatcactgaaatatataattacaaatgttatttttaatattagttaatattattatgatgcctataatacgtaaaaatagttatttttcttatattgctaaatattttatgactgttgtgttatttaaaatgatatttatttaattttaatatgaaagtatattattacgaataacttgcttgctagttaaatcttcaatttaatgtgaatatctaataatatttgaatcttatttatttacttctgaattaactccgctatgcagaataataaaattattaccgtgcgaaatgttatctattaataacattaagttaaatttcccgtctgttactataatcataaataattgtttttaaagaaataattaagtaatcagggaagcctttaattctatgcgccgttatatcaaggacgaagactaataaaaaagaggcagtaagaggccatatttaatcaaataatgggctgaatatgtctcgaaagcaggatgcctgcctaattaaaaactccgataacgacgataactcacgatatctatctgtcagccaatttaggtatgaaggtagctgaggcatttcttttccaatttatcgccaggactgattcaaaaagtcattacctgatatccggtcaggtaagcaaatttttatttaataaaaaatccgaagggagtatcgatatggataacattctggcctcgccatttacacgcctattttggaatgaatggattcttgaacctgattcagttaaatacaatatggttatggatcaaactatccaaggtgatttggatgaaagtaaattgagatcggctatacagggattgataaatcaatatccattatttcaatatcagcttgatgaagaaaatggggaattatattggaaaccgggtccgaatagtcttaataccctacaaatttttgacagtgaggaaaaactgcgtcagtttgccttgcagccctttgatttaaggcaagggtcactgattcgatttgggttatttcagcaggcagagcgacaatttcaattagtcattgtactacaccatattgtggtagatggcgggagtaccgaagagttttatcactccatatcggatctctataatcagcgccccctgcgccacactcctctgacactggatcaaattgcggaaaagtttgcacaatatcgtcagcagataaaaacactggaagagcatcagcctgaacagttctggaaaacatgtttgacggaagtggcagcaactaatccgctaccctatctatcagaactggcggaagacgaacaagagttagtgggagaagttcgtttcaatttgccattaaatgattggttacaccttaagcgttctctccggcactgtacgccatttctggtgttcaaaacattgtgggcggcactgattgctcaatatatgcctgatggaaaggttcacgtcagttatccggttgccgtgacaggaggagaatcgctttcattgggtgcccaaatcaacaccgctgtttttcccttacagttggatgatacggtcagctttgcttcgctttaccgacagacgttacattacacctcatcattgaaggcaccctccggcctgcgtttctcatattggccgctttttaaggtgttgccctttacgccgatccgtaagttaaatgttgttgtgaatcaagcccacttcaaggatttctgtctggaactggagggttgtgaagtccattacaatcaccgtttcgacaacgacttagcagattcggaatgggcgctggaatatcagcagcaggatgatcaatggtctttccgtatccgctatccccgccgccgtttccatcctgaacaaattactgccttggccgaacagttccagcaactcttggttaatgccctgacaaatccagaaaaaccgatccgacaatttccgttcctgacaccggatcagcgtattaccttactgaaatgcggtcatcagggagaacagggggatgttcccgaaacaacgatccatgaaaaatttcaacagcaggtttgcctgcatccacaacaaatcgcgttgattgataatcagcagcaactcagttatgcggaattggaacaacgtagtaaccaactggctcatttgatacgggagcgttatctgcaagcgactggacaatcgctgtccccggacaccctattgccgatttttatgaatcgtggggttgatatggtgattgccatgttggcggtgatgaaagcgggagcggcttatctgcctcttgacccgcaagtcccaacgcaacggctggcctatatcctgaccgatagccaatcccggctggcaattacagacatgacgcatcaaaccatattgcgcgattacgggcaaaatctggctttgttgacattcggaaacgactgggatgattaccgtgatcagccagacagtgctccgcaaacagcctcagagccgagttcattagcctactccatctatacatctggtacgacaggccgtccgaaagggactctgctggagcatcgtggagtattactcatgctggatggtctatatgccagagtgattgagggtattgaacggccacaacgctggttgcagtttgcttcgctggcatttgatgcccatgtgtttgaaacttttatggcactgtgtttcggccatacattggtgattgcttcagaagaagagcgtcatgatcctgagctgctgaaaaaattaatcgaaacttatcaggttgaagtcgccacttttccccccaccttgttgaaaacaaaaccggcgttgcctgcccggttacaaaatattctggtgggaggcgaagcaacacctcaaaccattctggatcactacgccatgcagggacggcggatattcaacgcctatggccccacggaagccagcgtatgtgtcactatgcaccattatcaatgggatggcgcccaaaatattggccgtccgtttcccggcattcaggcttatgtcttggatgaacagttgcagttagtcccgatgggcatgagcggtgagctttacctctctggcgctgtgctggccagaggatatttggggcagccggaattaacagccaaggcgtttattgccaacccatttgctcaacataccgatgatcagcggctctatcgtacgggagatcaggcgcgttggttgccgaatggggaactggaatatctggggcgtaaggattttcaggtaaaaattcatggctatcgcattgagctggctgaaattgagcaggtatttattgcggcatccgggctgagtcaatgcgcagcgcaggtacgcggtcaggatcgctcgcatattgtgctctactatgtgtcagagattaccttaaacgaagataacctacgtcgtactttgcagctttccctgccggattacatgatgccatctgcattcgtgcaactggcatcgctgccgatgacgattagtggcaagttggatgctacggcgttaccagagccagattttaaacagagccgctatgtttatcgtgccgcagaaacggagttagaacaccggttgcaaaacatctggcacgggattctgggtttggacgaaatagggattgatgacgacttttttcatctggggggcgattccatttccgctatccggttggtttcggaaatgcgtcgccagcagttgccatgcagcactaaactattatatcaatgccgtacgattgctgaactggcggtacaactggctaccactcctgattcccagatgatgcattctgaacagggaatactacagggtgattttcctcttcatcctattcagcattggtttttcgaacaggtatttgctgagcctcatcactggaatcaggcttttctgattcgggtaccgcctttacaaccgcacaaactggaaacagcgattcaggcactggtggaacggcacgatatgctgcgagccagatttattcccgctgaacgccagatttatctagatatcaatcaggtcgcaccaatggcgctggaaatttgccattatgatccgttgactgatggcgcactccatgactgtctggatagctggcaacgtgatttcgacattacggctggcccactatggcgttttgcttatattgatggctatccagatggttcagcccgcatttactgtgccttgcatcatctgattgtggatgctgtgtcatggcgcatcctgcttgatgatttaaaacagctttatcatgataaaaacctcggcgccaaaacagccagctatcggcaatggcagacagccttgactgaacaactttccggctttgaatctcagtgtgaattctggcagcagcaatgtgtttcacaatctgattaccggccattattggaggccagccacactcgtcaattcctgcaacaatctttagaacctgccgccagtatccgactgctgagtgtgaccacaggtgcggcaagttttgcgcctaatgaagttttactgactgcgttcctgcacgtattgggtcatctcagtggaatagcgaaccatacgttgcttctggaaggtcatggccgccatctgccatcggtacagttggatgtgggtcgtactgtgggttggtttacggctctctatcctctgcatttttctgctgaaggtgaagaggcgatttcattgcagcaagttcatgccacccttggcggcgtacccgattcaggtatttcattcggggcactgcgtcatttgggggctgaggcgtcggcattgtctctgccatattccggggtgatattcaattatctggggcagttacaggcgcctgaaaatgactggcaaatcagtgcagaatcggccggacaaaccatcagtccgcgcaatgttgattccggtttacttaccctcaatctctggcttatcggccaagagctgcactatcgttgggatggcttactcagtcagtcgcagcttgctcagttggatcacggtttccaaacagccttgatatcgcttatcgacacgatggcaccatccgccagtaagattcagcagacagtggacgatgggattgataccgcactactggcccgattaccggcaggattgacaccagtggttgcttatccggccaacagcctacaacaaggatttatccatcattatctgagtcatcccgataactcgacttatcattttcagtttgtcctggattacgaacaaccgatcgatctgaatgattactaccgcgcttgggaatacgcccagcagcgatatccggtgttgcgtacaggctttgactggcaggaacagccacagcaaattgtgttcaggcaggctgaattattatggcaataccatgatctcagtacctgttctacacaggagcaagcattgactgcgctttgtcagcaacaataccaccaatctttcgaactgaataaaccagagctgatgcgggtttgtttcgttaaactggccgccgaccgatacagcctgatccacaccagtcatcacattattattgatggctggagcagccagatattgctggaatatgtccatcgtacttatcagcagctacaggcgggacaaatgccggatacccgtaccgatacagcttatctggcgacccagcgttattacgcgagtcaaattgcggagtgtcgtcaccactggcaacaacggaatacccggcattgggaaagcacggatatttccctgttgtttaaccataatttatccaataccacccgcaatgacgttcctgagactcaagccaccgcgcatcacacattacctcatgctgacgctttgtcattacaggaaaccgcccgtaatcatggactgacactcaatatcatgctccagttcgcctggcataagctattgcatctgttcagccaacaatcacagaccatcgtcggtatcaccttgtctggccgcaaccatcccgtatcaggtatcgaacatagtgtcggattattcatcaataccttgccactggtaatggactgggaaccgcaatcgacctgtctgcaacagcttcgcacgcttcatcaacgcatgattgatttggatacctacagctatcagccactggctgaattgcagcccgcaggtgaaaagttgttccaatctatttttgtctatgaaaattatccaacgacagcattggataccctgcggggcaatctgcggactgccagtggcaataataccgactatccgttgaacctgatcgctgagggtaatgtagagcaaggattgacgctatctctgtcctataaccagaattgccttgatgctgaacgcgccaatgccattttgcagatgctgggaacattgctggcgcgtcttccttcccatcttcactatccacatccgcagttattagcgctgagtgatgacaaacgccgacaactgctagaagaatgggcttttgcggttgatcaaggcttggaattgatgactctgcatggtttgctggaaagacaggcacgattgacaccacaaaatccggtattaatggatgatcaccggacattgagctatcaagaattggatgagatcacatcacatcaggctgttcggttgcgggcggcatatcgtcgtctttttcagcgtgaattagcgtcaggtgagctgataggtctgtgctgcgggcgcagtatcgacatggttgtagcattactggcgattctcaaagccggggctgcttatgtgccgatggatacaaatgttccggcagagagactgaattacatcctgcaggatagccaaatcaggttggtactgacagaacccgatttagcacctctgtttgagcgtcccgatctacaacagctatatctgagcgaattggcggatacagaggcaacggatgatatcccacaaccgttgccgcaggtggaaccaaggcaattggcttatgttatttacacatcaggcacgacaggccggccgaaaggtacgctggtagaacattgtggctctgctgctatggcgcgtagcctgtttgccagaatggaaatggaacagtcaggtgttcgcttcctgcaattttcttccattgtgtttgatgcccatctgatggaaattttcccggcattggttgggggacactcgctggtggtagcatctgacgcacagcgttatgacttacaggaattacaaacgttattgcagaaatggcagattggttatgcgatgttgccgccagtgctgcttaaactcaaaccgacgttgccggccagcctgcaatggctgatagtgggaggagaagccacgtctcaggatgtgttcgatcactatgcggatcagggaatcaatgtattcaactgttatggcccgactgaaagcagtgtctgctgcatcgttaacccttatcgttataatggcgcgcgcaacattggcagaccattggcgcagtgtgcggcttatgtgctggatagtgatttgcagccgttgccggtgggtgcgcctggtgaattgttcctatccggcgtagggttagcgcgtggctatttgaatcaaccagaattaagccgtgaaaaattcattcctaatccattccaacagcacccggatcatgcccgcttatatcgcacgggcgacattgtgcactggctggatggaggctcgttggaatatctcggtcgtaatgacagtcaggtgaaaattcggggacatcggatcgagcttggagaaatcgagtgtgtgctcgccaatattgagggtgtcgatcaggctgtggcgatcattcatggcaaggaatccccaaagatcgtctgttattatacggtaagcccgttaaacagtagtaatagcattgattcgtctgagatccggcagatattggcacaggtgttgcctcactatatgcaacccagtgcgttgattccattgccccgtattccgatgactatcaatggcaaactggatcgccgcctgtgtcctgcgcctgtttttacggatgtacagcaggagtacacggctgctgagacgccgctgcaacagcagtgttgtgatatctgggcggcgttgctgcaatgtgaacgtatcggcatagacgataactttttccggctgggcggcaactctattatagctatccagttgagtaatcgtttgagccagttattgcagtgcaccatcccattagtggcgttaaaccggcatcctaccgtcagatctctgagcgcgttcctgtccggtaattgcacgcaccttgaccagataccccaagcagggttgcaacgggggagcctgtcttttgcacaattacgcctctggtttatcgaaacgctgatgcaggaaaacaatgtttaccacattcccctgctattccgcttgcagacagatatccagacggacagttttgtccatagcttgcaagccgtggtacaccgccatcagatattacgttgtacctttgaacaagatgaacacggaaaatctttcctgcaagcccatgatgaggcactggctgttgtccatgcggaagtgcaggcggatgaatggcatgattttctgcaaaaagagatcttccgtgtatttgatttacgctgtgaataccctatcagagcgacgctgttacaacggactgaatcagatgggcaagtgtctcatttctgcctgctcaacattcatcacattagttttgacggctggtcgttgaatgtgttcttaaaggagctggccgagttctatggcgctgaattgaataaccgcccacccgcactgccgccgttatccatccaatatatggattatgcagcctggcagcagcagatgttgtccagcgataaactggaacagttaaaacaattctggctgaaacagttacaggattgtcctcagttggaacttccctgcgactatccgcgccccgatatttttgatcatcgtggcagcacgactttcttctccctgactcctcagttaagccaccagttgcggcaactggcgcgccaactggatgtgactttacatgcggttttgttgactggcatgaatctcctgttggtcaggtattgcggcaagcacgatattgtcatcggtagcccgatagccaaccgttcacatccgcagttggagccattgattggcatgtttgtcaatatgctggtactgcgtaatcaggtatcgtcagagtggagcgttgctgaacaaattcgtcaggtttttgccagcacgattaccagccagcagcatcaagaaatgcctttcgaaaaactggtcgaatttctgaagttaaaccgtgatttatcacgccacccgctgtttcagatctctttctcgctggaacagaaagcgacggatgttgatgcacctttcagcatgcaaaatctggcggagttatatgatgtcgccaagtttgacctcagcttcggatttgaagaggggaatgatgcgctgtccggcaatattaactacgccaaagcgctgtttgcaccagaaacgatcaatgaaatggtcaggcacttccagaatatattgatgcagatggtggctcatccggaacaattagtgcaagacattagcctgtattcaccggaagagagaatagctctgttgcaaccgccaatggaaacgcaggatgctgctctctacagttatccattgtatcaggggcttctcgattggactcggcagcagccgaatgatatcgccctgattgatactctcggtcagtgcagctatgccgaagtacttcaggctgcgcagacactggccgcgcagatccatcaacatccgcgtaatcaatctgagctgatcgtcattcaggtaagcaaaggtagggcgcagattattgctgttctggccgtcttactggcgggacgagcctacgtccccgttgatatttcatggccgcagcagcgctgtcagcagatcattgatcagactgacacgcagttggtgatcagcagcaaagcgtgggcaaccgaaacctgcggcatcatccaacttgatccgtacggctgcgccattaacttaactgagcctcagccgatgtcattacccgtgccgatcgcctgtgacagtctggcttatgtgatcttcacctctggctctacgggaacaccgaaaggcgtagctgttcggcatgacacggcctgtaacacattgatagacatcaaccgtaaattgaacgttgtgcggggagataccttactggctcttaatgccctgtgctttgatttatcggtatatgacatgttcggtattctgggcgtggggggaaggctggtgatcccaagcgaagagcagcgataccagccagagatcttactcagattaatttgtgaacacagtgtcacgatctggaatgcggcaccggcgttgttcgaattgctattgcaggaagtagaaaatctggcagagcggcctactgttgcgatggatcgcgttctgttatccggcgactggataccggttaatcatataccgcgctgccgtgactggctccccggttgccgcgtctttagcggtggtggcgtcacggaaacttcggtgtggtcgattctattcgaagtgccacaaggcgccggctatagccagagcatcccttatggcaaggcactggttaatcaatactttcttattctagataaagatctggaacctgtacccgctcaggccatcggtgagatgtatatcggtgggataggtgtggccattggctactatcgtgatccggtacgtacagaagaacgttttctgtatcatccgatcagtggtgaacgcctgtaccggacgggagatttagggcgttggctaccggatggcaacattgaatttctgggacggatagacagtcagatcaaaattaatggttatcggatagaactgggggaaattgaaaatacgctgatggcaataccgggcattcgccagtgtgctttggttaaagtcagtggcttatctgatagtctggctgcctattatgtcagtgacgaaccgctggatgaaaccgatgtgcgtcagcatctcgcacaagtgttgccgccgtatatggtgccgtctgtgttgacgcatctgccaaaactgccgttgaatgccagtggcaagatagaccgtaaacaattgtcggcattaaattacattgcgccaagacagcatcagtatcaaccgcccgagaccgaacaggagcaacaactctgtcagttatggcagcagaaactggagctggatcacgttggtgtaaacgatgacttttttgaatgtggcgggacttccattctggctattcctgtttgtcagcagatgtcggtcttgttgggacaggcggtcactgtgatggaactgttcaagcgacgcagcatccgtggcattcttgcaagccttgaatatcaactgatccaaccattgaataacggttcagctaaagaaacgttatggatgatccatccggctatggcgggatgtgaagtttatctggacatcgccagaacgctggatggcaaactgacgtgtctgggtgtggataattacaacctgtaccaccggccgttaatcatgtcactgcgtgacatagccagtttctatctggagcagatggaacggtatcagccattgacacaaggcccggtacgtattctgggatggtcaatggggggattaattgcgctggaaattgccgcacaactggaagccagaggaatacgtgatatccatctctacctgctggacagcttctatcgggtcagtctgggggctttacatccaagctggcggcagatgctattacaggagctggggctggaaggggatgcggcggtacgagcgctggaggccggccctgcggacgatgcgatttgtcagcatgagcttttgcaacctctacaacatagcccggtcacgctattcaaagcgactcagttgccggagttccacgctcaattaaacgagcagggaaaaatcccggcagcattgcacgctgatgataaccagataggacaggcttgccggcatctgtctgtcataccactgccttgtgaccaccacaatattatcgaactgaaatcacagattattgaaggtgtgttggagctggtggattgagctgatttgttgtgaaaaaacggcgcaatttttatgtcaggtatattgattgcgccgaatgatgatgagaacaggctcggtttattgatgaaccgagccttaataaataactttactttggtatgaacctgcgattctgcttattccccttttccgtgatcccactctaattagaaaaggtcagagtgggttccagttcgttcggagcgaagaacatcagtaattttgtagataagaagccaatccggttctatataattatccctataccccttgtagtttccttgtatacaatttcaatagaatcgaaattaattatcattttatatttattttacatgactacgaatgtaattacattaaatgcatttaattagctgaggataatattaaagtttatccattatctcattatatttaaaatctaattaatatgattaagtaataaataatctatttatcttcattctgatataaatgaaaccacataaaaagcaaaatgcataaaaagcaaaatgcattattggcaatttatttattatgaattttttggcacgattattatcgatgtaagaattatgtgatcacagaaaattaaaaatgatattttttcattttgtggcggtagctttcttcaatatattgcctttcatcatatattaaccgtgacgaggttataactcttgatcacaatcacttagtctgagacaaaaattatgaatatagcgtctgttttctctgatccatttaaggaagataatgatcctaatctcgcatttctatttagccaactggaacgtatcgatcttgtactgcaataccatttccattgtataaccgatcagcgcagtgacctccttgatgaatttctgttaagcgaagaagacgtcatagccaggttagataaaccgctgggtaaacctcattgggtcaatgatgattatttggcaataccccagacagtcaaccccgtggcatcccgattaactgacttgattgcccgttttgatctgacagattttgaaagggatgtgttgctgttaggtttattgccccatttcgatagccgctactatcacctgtttgcgttgattcaaggagagcaacaatcccgactcccttgttttgcgctggcattggaactgttttgccactcgccgctggagaaacaggcgcagcaggccagtttcctgcatcgggcacctttgattggctgccaactcttatccgtcgatagccgtcaaaaaaccttgacctggctccagaccgcctttgtgactgacagcggcgtgtatcattttttacttgggcatcactatattacaccagctttagaacattatgctgagtggataacgcccatagaaactggtggttatccgacaggcttaaaacaggcattgggtaacttattgttacctgaccacgaggatattcgatctattgttttattacgcggcactgccggcagtgccagggcccatgtcgtcgccaatatgatggcgtcggaaaagcgacaaacgctatgggtggatatcgctaaattggctgatggcgatgataaaacaactcttttccagataaagcatattttgcgggaaatccgtatgcgtggagcttgtttattattacggaatttctgtttattagccgagaaaaataaacagctactggattccctgtcagcgttattgaatcagcctgaattaagggttatctgtctggtcgaaccgtattctccactgatatggttgaaaaaactcccgacactactggttgaaatgcccgttttcacgtcagtagaaaaaaacagactattaacggccaatttaccgcataactgttcagaggatattgatgttatcactttaagccagcgttacgcgtttaaccctgaaaccctgccattgattttacaagaggcgcagatttatcagcagcagcgagatccttcgggtattttgcagcaatgtgatatacgcaaggcactcaatttacgtgcccagcaaaatttcggccaattgggacagcgcattacccctaaacgttcattaaaggatttgctggtatctgatgaagtggctcaacagatacaggagatactgatggcaattaagtatcgggaacagatcttggcgggagggtttaaagataaaattggctatagcgccggtatcagtgccctgttttatggtgattcaggcactggaaaaaccatggcggcggaggttattgctgactgtattggcgttgatttaataaaagtcgatttatctaccgtcgtgaataaatacgttggtgaaacggaaaaaaacttatcccgtattttcgatttagcaaaacaggatgcgggcgttttattctttgacgaggcggatgctctgtttggtaaacgtagtgaaaccaaagatgcacaagaccggcatgccaatatcgaagtctcttatttactacagcggttggaaaactttccgggtttggttattttatccacgaataaccgtaaccatttagacagtgcatttaaccgacgttttacttttattacccgctttacttatccggatgagaaaattcgtaagaaaatgtggcaatcaatctggcctaaaaatataaaattatcaaaagatatcgatttcaataaattagctaaagaaacaagcgtgacaggtgcaaatattcgcaatgtcgctttgttgtctttatttcttgctgctgggaaaggtaatgatgaagttaataacgaaattattgaaatggcattggtacgggaattagctaaaatggggagattaagtttttgaaaattacagcaataaaagcactaaaatattaaataaaattattaacagattattatctgaatggggaggctaatagtgtggttattatcacaatcaatgattgcaatatctatcttgaaaagatatatacaggtaatatttttggggttgaattcttctttatttaaatgaaacttatgaataatgacttttatttattattgtgatttaacattcaattattatttaattagtatttgttattttaaagcataatttccctacggagaatgatttatatattcaattgttgacaaataatgatgtctatatattattgttacatcagtaatgagatcgttatgctgaatagctgcgtaaaataatgtatttaaggtaagggaacaatacatccattaacagcttatagcgttatgaatagctctatcatattaaaaaaactctatcattttaaaaaaggagttcagatgtttacttcaaaagaattactaaattttattgctgtagctaaaaataaatcaataaataaagcaacacaggagcgttttatcacacagtcacccatttgtcgtagcttaaaaaaattggaattttcattaggtgtcaaactttttcaaagaaaaagccacggattagttttaacagaggaaggagaatgcttatataataaagtttcaccaatttgtgagcagcttgaaaatattgaaaatgattacaagaatcataaattaccctattgttctgtttatcaaaaatagatataattatgtaatgtgaaattataaaatctctactaacataattactctaagtatttatgatatgatattccctatatcttaatttccactaataatcggattaaaaaagaaacacaacatgcctttttattttaaagaaacagcagaagaaaaaatgtggtcaatgcagccattcattctattgatggggatagagacagcgctacatcagaaatagtctggaactcgaataatatgtttagaagcagttgttagaactttgcttggcacggggattggtacaggaatcaatcttcttggtaatatggcggttgacaaattagatgagaaattgaagattgcacacccttaccctaaaacaatgaatatgatatttgatataaataattatgataaaaattttgttactaaaaccattaaaaataattttcaaaaagataacctaaaagacaccgttggcagcgggatagtatcaggaattgcaggtaaattaagtccagtaaaaatccccatatataaaatttccgactttggctgtatcacataataaatcatcataaccaatgaaaaatgataaagcccaacatatattagattttactcatggtattactgaggttttaaatgaaagccattcttcatcgtcttcttggcctaaaaatattaggttgggcgtattcgaatgaactctctgagaacaatgaaagtagtactgaaagacatacaagagggtatttaagtggtaattcagtatcaattcataaaacaggacggcagaaatgtttatgtcatgttgagtgatatagcggctattgacaccccgaatgcggatataaaggagatgttttcgggagaaaaatcggtgtaacgtataaatatttttcaaaataatcaattaattgtaggagattcagtctgatttgtgcgatttgataaattgtaaaaactaaactgactgagttggtagagtacaactttgccaaagttagggtagcgagtttgaatctcgttttcactccaaattcaggatgatagatttttatcaaaatctgcaagtcacaaaaaaagcgcctcagggcgctttttttgctttcaggatctctgaccaaagctaaccaccacatgaatatttgtgtctgttctgtcagtgttatattgcggttgactaatctcaaaaccctctgttagattaaatacacctgatatagtcaccttcataaacaaatctaacgtaatctctttaaagtcagaataagcacataacgaaagcattttccataacttagctgtcagcaaatcatctctaatctgtccctaaggatttttaggggcgatttttaggggtatttatctatcaacgcgcaatgtgaagaggatagaaccgatgaattatgatgtgattgttgtaggatctggtgctatcgcaggttcaattgcttatgaacttgttggtcgccaattgaaagtatgcaggttggggcgtcttgatcgtagcaatgcggcatcgagagccgcaggggcaatgaatggttgttttggtgaagtgaccagtggacttattgcgagcgattacggaaaactgaaactcaaaatggaccgtatcgcgaaggatcgctggtcaacatgggcacagcgtttggccgcttcttcgggagatactcgccctctgtttaccgcaaaagggactcatgtcattcttaataccgccggaatggaggttgttgatagtgttaattatgatgctatagagagtgttcttcgtgaatataatgagccttatgaagttattgagccgcgatcgattaagggaatgaaacctaacgatttggtgcgttcgcttaaagggctttatattccagaagaacatgcccttaattcccatctattgcttgaaatgttggatgcggcattgctccgggaaggtggagaaatcgtcgataacaacgttaaacgcgttctcacagaaaatggaatcatagtgggcgttgaaactgtcgatggagtacgttttaccgcaaataaagtgattattgcggcaggtgtgcaatccctcgatatattatcagaccagacttctattgtgcagaaaattccaccactctttgccggctatggtgtgtctgttttactcaaagttaaaaatcctgatgagttaccgacatccgttattcgtacacctaatcgggcatttgcttgtgggttgcattgtgttccgcgtagtgatggtgttctctacgtcggcgcgactaaccttttgtccaaccagcctcgtacacatgcgacagttgctaccatacagttccttttggagtgcgcttacaaccagataaatgttgatctgtttgaatcagagatccttgccattcaggtgggtaacagacccatctctgcggatggttttccattaattgggtcgtgtggcatagacgggctgtggcttgtaacgggtacataccgggatggcctgcatcaatccccgcttttagcggattatgttgcgaatgcactcatggggctacctaatctggagattgatttggcggattttacacctattcgccggcctttagtggggctgagtcgagatatgaccatttcggaagcggcaaagcaaacggtagcgatggggtatgaatttatctggaatcttaaaccagggtgggatgaattaatctataaatctttactcaatatttatggtgcacaagttgaatctattgatgctatttatacgcctcccccggatttggttgcattctcttgcaaggatgaacagataacaaagcggctacgtgattactaccgttgttggaagaaataagtcgccggaaatcatctgggacatgaaaaaaatccttttaaatgcgctgcgatgcatctttatcgggaaatgataaagatgctcgtaatattggccgcatacctctccgccatcttatttaggctctaaataacgaatcagtgtgagcgtattttagaatgcttctcataaatataatgaatttaatattatttgttttattgacgcttatcgtttccatttgatttttcttatttaaaataaaacagattgtgattaaaacaccgttttattattaatctacaatataaaaatacataaataattatatatttcaaaatgaaaataatatttcactcagcatagccttttgaaggaggaaggtatggaggcttttcaattttattaccactgggaattagattatctgcggcaactcgaaaaactggtcggtgaggaaaagggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccccggattatgtcaaagattcggttagagaatcgattgaagatcatgctaaaagtcgtaatcatccagatgcaacactacaagataaaggatttgttactctgagtaatgatgttggcagtgatagcgaaaataatgcagcaacaccaaaagcagtgaaagcagcgtatgatttggctaacacagcaaaccaaaatgctaataatgcaggagctaatgccaatactcgtttagccaaggagcagaacggggcggatattcccaatacgccggagtttgtgaaaaatattggcttagataatgcgctaaaggttggggattatggaataggaggccctggtatcacagtagaaccaggtcaaactgtggaggatttggcaggaaaaacaggattttatcagagggggtcatcgccaataccacctgattccccgcgaggaacggaggcaatgaaatatttgtcaataggacccggttggtgggctacgcaattggcattcgatgcatatcgtaatatagcatggatacgctccagaatagcagcgagcaaatcttttcaaaaatggagccaattctccatattgggagtaaacaccttcatggatgcaaatggtaacttcaagttatcctcatccataatcaatctttggagtgatgggaaatttgaaacaaataatgagtccaaaggagctacagtagaacgtatttccgagggtatataccttattaaaggtgttaagggatttaatatcgatggaacaatgaataatatagagatcccattatgccagaacaagctgccattaatttgggtcaaccatgaagtactctccgatggtactgtcaaactgatgacctaccaccgggaacactccgacgcaccagcattcgccagaaatacacgagaaggctactctgatggtgatttgattgatattcccagcggccgatttgtctctgttcgagtgcaaatgccagccactgaggataaagaatcacaggcttaattcttttgtcactttcaaaacataatgattggaggtaatactatgtacgattggtctggaagtgttcccgcgaacgctgaacaaggtcaacccaccggacttattcttctaaaaggggatataatatctatcattgccaagggatggataaagttcgggagtgcaaataatgaatggagtgcgccccaaggtgatacaagaagcattccaaaaataagctatgatctaagagcaaaaattgctgacaaaacttacgggattggtaatggggttcttcataaaacggttccagtagatggcgagttaatccttttatatgatgattcccccggtgaatataataataactctggtgaatttcacgtcaacgttataatagagtcccgatattctcctctcgaagaaataaaataaataactaaaattctaacccgcaactttctgcgggttcatatccacctcattcttccacctccccctgccccaaatcccccaacgcccgcccacaatttccccaattcaccccactacccgctagtctcccctattggctatttattgacagctgaatacgtccgttcgcggcgttatatcatcgcatggggctgtgttttgtctggatcttaggtagttgtgtctcaagctggttcagtgtgtcagtgtcatatttgataccaacagtgatgtcatatgttgctgtgcctgtactttgtgtcatgttctattctccaaaaagaaaatgccaccagcgttaactgatggcatgggggattcctttaaccactcaagggaatgggtaaaagaatattgactttcattttaatcgttgattaattattgagctccagtggattattgttaggtggaattaatattattaagcttattaatatttctataataatgttacacgtggagagtattatgagaaaatatattctttcttgtctactggcaagcacaacgcttttagcttcaatgcagtcttatgctctttgtcgttatttcccccaagatagtcaagcatggaaagcttgcatggaagtctgcaaactggcgcttaatcccaaaatttgtttaaaataacatcaatcaggacggttcattcctgccgtcctactcatatctcaccaacaccgccccctaacacactcttgccaccccagaatcatttgctctgaggttgcagtttttatttctcatcatgcagtttttgtttgagcaaataaccttctaatgaccaaatcttattaactgcattttgacgggcaatcttacgacccatttcggcatcgaagttttcagggcttgcgcatgcactttcaccggtgacagtgaagccgtttttcagtgtaagaacacaaaaagtgagagtctttgcgtttattctcactccaataggagcatacaccgcatctggattgtctttagctgaagcagagaatccatcgtaagcagtgaaatacatttcataagtaatagtatcttcaatgtgctgcggagtaatacgcggtgctgttttgcctttttcttgagtttctttttcaatatcttggtttgtcatttcttcacctcataacattcagtattaactaatcctgcaagtacttcgtctgccgctcgttctccgccatcattcggaggagatcgtaataatcttgtcgagctgcttctgtaagttgtggggttcctgcgtcgcccatgctgcgggaggaagtggtttcaggcactgggcagacggcttggacgcgcaacttgcgacggccagcggcaatatcagcccgaagagtgtcaatttcagatttggcattggtgagttcctgagtgtgcttggtgtccagttcagcaaggtgctggatgcgctcttgctgattggtgatgatggcgtttttctctgatagctgagtagtcagtgactttttctcatctgtgagccgtccattttccacatacactgaatagatggaatatgcagccgaaccaatcagaacgataccgactaccactgaaacagctttaactttccacttcataaaagctcaaacgctttctcaaacgttgcctctgaataaggttgcttgccgttctcgtgccggatgatggacttggccaacacaatcaacgtcactttatcgaccgtaatcacctgatgatgatcgacacctaacgccttggtcgtaggccatccagcacaggagttcactggcgctcagatcccgttgcagctcatacagggttttgccgagccgcagcgccagtgtcatcatgaagaaggtcagtggctctttgactttttttccgcgtcggcctgtgacgtcatgagatccagtgcctgatgcagtaagtgcattgaacacctccccgtatttcaggaaaaaatgtcaggcgttatcatgccacaatggggcgtacggctgtagtactaggggctgttgacgttttgtgaagggaatttgaacagcatgatgagtctggtatcattgtcttcgcgaaaaaaccattacccagaccatcataccaagaacaatgttatcaaaacctttatggaataagctaacggcaatgtcgctttaacggcggcaagttagcaaaagtggtgttgccgcatgtttccccaaatgggaagttgcgccctgatggggagaaactgcttggtcaggtctgattatggacttctattattttaataactcaccagtgctaacgactggagatcatgtttaccctcatgaaccttcaaaaaaggacaatctcatgaccatgaccatgaccatgaccatgaccataagcattaggcttactgttgcagtaacactgcttgctgcaacgctgcctgtattagctaaaatgccagaaaactttatttataccagctctggtgacctcgaaacagcgtctgtcattatggcgcgtagcgacattggcggtgcgcagatcgtttacaattggcgtttactcgaacctgagaagaacaaatacgacttctcgcagattgagagggatctggctcgcctcaaggtagctaataaaaaacttttcatccaaattcaggaccggtttttcgaacaagatgcccggtacgttcctgattatctgatgaatgatgccaggtatggcggtgggatatcgccacaatttgataatcctggcgaagggaagccaattgggtcgggttgggtagcacagcaatgggatcctgctgtgcgccaacgttatcaggctttgttggcagcgattgcagagcgtttcgatggtcaagtctatggtgtcaacttacccgaaacagctattgattttgacaagaaaaagctacccaaaggattctcctgcgataactatttcgcaggagaaatggaaaatctcacctttgcgcgaaaggtgttcaccaaatcacatgtagtacaatatgtcaatttctggccgtgcgaatggaacaacgaccacaattacatgggccggctgtttgagttcgccagtgccaataatattggacttggtggcccagatattgttcccaaccgcaaggcgcaaatgaagaactcatacccgttcttcaataaatacaaaagcaaactggcactcattgccatggcagtacaggagccgaccttgacctacaagaaccctaatacgggtaagccatttagcaaggatgagtttgtacaatttgcagaagattatctcggtgcagatatcattttttggagcacgacgtctccctggttagctaagaaataggtaacagtcgcgagatcatactgtagggtcttttccggataaaatcgcggcagcagtcggacaataggggctgttgatgttttaaggtcataattcaatcaacccacattggcaaccagacaataataaacgccagtaccaatgtgctggtgtaattccgttcaagtttatcgtatcttgttgctattacacgaaaatgcttgattctggcaaaggtattctccaccaaatgtcggtaacaatataaacatttgtcaatcttttgatccaattttcgattattttttcggtagggaatgactggtgttgccccttgttgttcgatatcagttctgaatgcctgacattgtacccccttgtcagctatcacaacgcccgaaggcggtgactgcaccaccaaactttctgcatgaacaatatcgtgaacttgccctccggacaattcaaaattcaccggcagtccataactgtctacggctaaatggattttggttgagcgtcctccccggcttttcccaatcgcttcatctttctttgatgttgcgcctgaactgtgttgatgagcgcggacaatgctgctatcaatgaacagccattccgtatcagagtctttagataattctttgaataataaatcaaaaacacctttctttgaccaggcatcaaaacgctgaaagacactattccctttcccgaattcggaaggcaggccgcgccatggaatgcctgttttcatacgataaagaatgccttcaaatgtttggcgatgttttgtgttaaataagtccagtatgttgcatgaatgcagatagcttatcccattgtgtatctgttaacatagtttgcagcataatggtaaagttgagttattatttggcgaaaacgattatacccaatcatcatgctgttcaaattcccttcacaaaacgtcaacagcccctagtataaaattaggtattgattaaaaatgtggatcaattaattaaaaagaggtgaagttaaatggatagtcaactgtctggaatactgctgcttttggttggattatttttttctgcaaccgctatggcgatgccaatacaaaacgacgagatggcttcattggttaatcagcgtttgtcttacatgaaggatgtagcaggatacaaagcgaacaatcatcttgccattgaagatttacgtcaggaagccaaagtattatccagctcagtgctcgaggcagaaaagttggggttagatggtgagtcggtaaaacccttcatacaagcgcagatggatgctgccaaggcgattcaatatcgctaccgtgctgactggctatctatatcggaaaaaggttggcaacctgagccactggagcaggtaagatcaaaaattagcgtcttaaacaccgacattcttactgaggtcagtacgagattaacaacgggtgatctatttaccgacaaaactgcctttactaaagtacttgaccaaactcacttaaaagacggcgataaagaacgcctatggtcctcaatgaaacaaatcactttgaaaaagtagttcgcataagccatagacatatcccactatgcattatggtcagcctatctatacaattcgccagaatcttattaatcttgagtaatcaacttaaccttatactaattaggcaaattggtagatcggaatttactgaatgtgtgaaacctgaatgtagttacataattgattgtttttaaatgggattgtattatttagatgattatcaggtagcgttatgatgcaatctaaaggggacaatcctcccatttaacccaaccccttgatttaattaatctctggtacagtgacagaattaagtaaagtcaacaagttatctaaaggtgggaatttctcaccttttaattcaatccttccgtttcaaacggaatgcctactttggttttatactcacggtgagggtatggggattttcaccatacctttgtggattattgcttaaatacctggctgcgatgccaggtaataaaactttctaaaggtaaataatctctgtttttgggaagtaatatcggctgttttgcaaaattccaaaaaagttgttttaccatcgggccaccattaatactttctgaaactaataatttcatattatcgtcaatactgattgaacccatatcaaatgcggaatggtgcagtgaacagagggcaagcccgttattgacggtacaggggccgccgtattgtttccatttgatgtgtgccgcctccagcccaacaggagtactgtcatggcgcagattgtagccacatattgcacattcgtagttataggcgcgcagtatctgctggcgaaaatgcggatcacgtattttgcggatatcacttaaagaaaaatccaattgattagcgagaagctcctgtatgctgtcagggaagtgttcactcaggatttgttgtgccagtttattaatggtagtgggtttcttgcgtagtaactgataactttgttggtcgaagccccctttgacgccaaactcaatcaactcacgttttggcggctctttgctacctttttgtggcgtacagcgttcgctattttgcaattcccaaaacccgtcgccgcgtaagcgccagaaaggcaaagagggatagtggcttttgcgtcttgggccaaagttattgagcaacgccagtaatggctggtggatctcctcaccataatcaaacagtcgctcatggcctttctgatattgagagagcacataaagcaacaacaatggcttatgtggtgcgcgttgatcgcctttgcgccaaatagaaaggtttgagatagcgacttggagttctttgatggtggacatataagctgtttgattaatgggtgatggtattgcgatcatgctcgcaaaagtggtggagggcaagtggtggatttggaaggggttatgacttgttgaataaggtgtatgagtaatagaacgtaagccatacaccttttatttagaatgacatgtaaatgagattcatatggagcaagaatcctattcgattcgcgaaccaatagatttcgctttcaatgcagtaaaataatttttcctgaagaaagtgaatcgttatgatctttagggactccaattaggtggtaatttgggaagttttattccagtgagttcaggccctgaataatattgataatattctaatacctcttgactgtatttttttccatacactaaaccagtaaaaacttctgcaacaaactcattagaattctgtttctctatagcataaccgctcacttgttcaacaatttttgccggaataatatgtatattgttttgatcaatccttttggctagccaaaatttttcttctgattcagttcgttgtgcatgaatgatatgtccaatttcatgtacgatggtagcaatgacctttgttgagttttcggagttcaattccaatgacttcctgcttactgatatagcttcgtgatgaagttgatctggtacaccccatccaatttgatttgttatattcttattccttctccagaaggaatattgaggagattttatttccttaacttttttagcatttatatgaagatgggggaggccaatacctactgtacctcctgtttttgttatcgatgtattatctgctattttgtcttctcttgctggccatctaacttcagtttttcctttttcctcttctatataaatgtgaatacttctcactattttagataagttattaacttttgcatgaattttattaatagcgtaacaaatgggaagaagaaactccattttaatttgtttagaatgttcttcatccttggaatgttcttcatccttgccgaagattttgagcttaatgccacaaatataactcttggataagataactttattatcacgataacaatctgtaaaatccatctcctgatgcagggtgatttctatctttttatttctgatgggatctctcagggaaattactcgattatctctcttttttttctgtttatacaaaacgacctcctatatagcattgtcgggctaggaaaatcaaacttacaccattcaagagcaaaaataaaataacaaaaacacataatcacatatgaaattaattttttatctattattatgaaatataatgatatttatatccgataaatttaaagctgtcgttcgcaaggcggtcgcttatgaggcgaatccaataataacaatatcttatatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtatatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccaaatattggtggtgatatataaaagaggtgcgcacaattctggagaaaaggaatgaaaatagcatttgtcttatacgataaagcgttgcaaagcgggataacgttagcatcggatatgttaaacagtgccagcagcttgagaagccgggtacagcagagagaagaacctttctatatgtctgttataggtgatgtgaaggaaaataacgaacacatagcgcagattacgctacatacccaccataaattttcggatcctgtcgattttgatttggtttttttacctccgatgtggggaaatccgtcaccttctatggctggcagggaagatattatcgaatggttgcgtcggcaaaaagaaaatcaagctattattgttgcgactggcaccggggtatattggctggcgaaagcgggattacttgaagaaaaaactgtaacaactcattggtctttctatggcaagtttgaacgtcggtttccgacggttggtgtaaatcgtaaggcaagcatcacgtattgtgacaacatttattgtgtgagaagcattaactcccaaaccgaactacttgtttacttgatcgcccagtttttcagtgcaccgattgctaagatcattgaaaaacatttcatgcatgaagtatcaaattttcagtcagagccgttttttcaagtgggaggcaacacgcaatttgatgaaatggtgtcgatagcacaaagctatattaagcagcatgtgacttcacaaatcacgattaaggatattgctactcacgttggtgtgtcggagagcaccctgatacgtaggtttaagggacaggtaggtatctcaccacataaatacatgctcgatcagcgtttattaattgccaaacagcttctgcaagataatagcctgactttactgtatatagcgcaattagtgggcttcaaggatccccattactttagtaaagtatttgagcaacactttaaactgactcccgttgcttaccgtaaactggtgaaagccaaagttttccattcctgatgttaattatctatttgccggaatagtgtcagaagatcccttacaatattggcctcaaagcgagttctgaatacaccagattttgaacgccaaaataacggctccgcaggtgcgggcaaacggattagcgttttaagaatattttgcaagtaatattttccctgtctagccgagacaaaatagtaaagagcctgtattaagctcaattcaacccaaggccacgcaagccgatgatgttcaaatccgcagccgtaaaacgacctttccagttcttttcatagtgttctttgggaaaatcggccggagatgtgccatgttcaagagcatctgcaacgtggtgagcataagccagatttctgtcacacagtggtgccgccgggatatacatcacattgccccagccttgctgatttttcaccggtgcgacggagtggataaggtcacagtgccaccatacagaatcaccagcctgcaatgatggaatactacacaatcctcggacaagatgaggatgccatttctcggagatgggaagcgccttattgggggcaacaccacacagttcgtcttcggggacatcattcagcagtggccgtaacagaatgtatgccatcgcttctggcacaggaacaacatgcagaagtccttgaccgagggtcatatcagacagcgccgtccagccctgaaatgtcctaaaaactgagcattttgttgtgttatcgtactcggttacttctggacggtaggctgcatcccaaggatcgtattctccgaatcggttggtgaaaattttattaaacactttttggtaggcgggttgcagccagcgctctaaagtacccgaatctgtatgagcacctagccctcttgatgttgtgcctggtggccgacggcgaatgcggtcgggataaatcatgttgatatcgggatcaaaccaacttatgccgtttgactcaaatttccacaaacggtttagaaaagactgtacccgcgcaatttcttcactttgtctggcctccatctgtgcatgagaccagtaaatggggtaaatctctgggcgagatgcttcaaggctatcgaagaagttatctcccggcccttgataaacgcgatcgaagttattgatagcgaggtaatcaagcatggactgatcccatgccagtgctttatctcgtggaaagttctgtctgacgaccaaacatccacgacgtttgatcttttgtagggtttgttctgttactttgcgttccgccacatcactcccgtgtatttccggccaagcgctaccgatgtttttttcatccacacgggtggcggcgatctctttttctattctgtcgcatacctgagcgaacaggctttcaacatcgcctatttgtttgcgcatggcttgtttcatccggcgaattttttgtcggtaatcatcaggaaaaactgtagaggtgaaagaagtattcatagcagactctttctgttaatcgttttaattttcgtatgaaagtaaatttgatttatgtaaattttataaacgaaatattaacaaatttacagcaaaaggttttaagccaacgcacagaatttattctttggcgttcccactgggaagttttcccgtttcgagaaacgcctgtagaagacgttcctcattttccttcggaaactaactgattatttaataatgagtttatggggattctcatccaaataatctgttcactgcgctgtttcagacgttacttttttatacaccactaaatttttatttttatcattcggccgatgtccagaccagaacaacgccatgcctgtcggagcggattcaatatcttcggataaaacgataagccagcggcatgtttgtggaactgcaaaatctttctgtctttgatggagtatatgggcgaaataataaagcattggcgcctctgattcgccgatagaataagatgacatgcaatcatcggttttatattcccctgctaaacgctgcttaagatcagtaaatacctctttatagcctttggtataatcaatccagccgataaacaaggtaaataccaatccccaaacaacagcaatccctaagagccagttttgtgcggtatgcaaaacgggagattttgacagtattttgtttttagttacccagataatggtaataataacagcgctggtgaatataaaaccggaaaaatgcatctgatagcccattggcagccattttccaaaaggtgccaaccaatgtttgtaatcagaagagagtgatagtaaataaactgaccatacaaagaggatcagaatagaccacagcattgaaaaacagagactcagaacgctgtacattttttcgggtaatttagtaaaaatgcccgtggctaaaatagccatcggggcaataaagggtaacaggtacagcgcacggctggaggctgatatttgtaacaggatgataccgagtaatataaatgctgcaaaaataaaataccgttgatcggtaagtgtttttatcgggtttttaacaataacgatgaaggctaataggcctgccgggaatgcgaataataacacagcttctggaattcgacttggagcagctcttgcacccaaatcttcaacagaaaaccctaagaagcggccgatattgttatcccaaaaccaaactttaaataagtccgggtgttcaactaataacatggctggccacggtaaaattaaaatgagagcaatcacccctgcgaaaaaggcatttagccaatattgtttagcccgacagctttttagaaaaaccggtgttaatagtaggcaaatccataataacccagggatgaataccccctttgataacattgtgatagcagttccaatagccagccataatatggaatagcattttttttcgtttttaatcaaccccaataaaccatataacccaatcgtcgtgccggtaatcagagaggtatcggtgaacatatcgtggctatgacgaacgatccccggagcacaggcatacagtgcaaaggcgatccatatgcgactattggtgaaattctgtacattaaatgcacggcgagccagaagaatgaaaaatgaaaaattaattatggagaaaaatagagtggctgttcttgcggcgtcatacataggcagccattgagacaataaatgaataaatgtagtagctgtccaataatatagcggtggcttttccatgaaaggctcaccggcattggtgggaactagccaatgacctgtttcatacattgtttggatcacaccaaaactataattttcatcctgtttccaaggagtatgactataaattcccggcaataaataaagtaacatgaatgctacaaataggaataatgccttgatatctgcgttagaaaatctatgaatactattcattattaattaccaaagttaagaaatatagattttaagaaatatagattaactaaattgaatgattattcagtggataaatataaaacaataatggattcgatggattaatgcaatagtgttttatatcatttaatttgatgttttgtgcgtatatagaatggttttatgaggggtaaatatcgtttcttattgagtttattgtaaataattttcatttataactgttacgtaaaaaaatagttattatggtatatttttttattgataattttattaatgaaagtcttaataataggtgaaattaatattgtatttgtatgttgattcttgtatgaattaatattattaatagagaattttacattttttgttttaaattaaagtaaattacttaagtgctcaaaaaattaattgaaaattgattgccataatcttcaaatagagtatttagctcatactccattgtatcctgagtccaggtgataaaacgccgccagtgataattggtttgtttccagatgatttcaatcagattcagctttgggctgtaggcaggaagataaagcaaaaacatgttacgttctcgtaaccagcgatttctgattttttcctcaattccatggtggatacgcgcattatcctgtaactcgaagacagcatcctatctcagcggtgatctgaggcggttcgcctcttctggcaagcatgagtaatccccgttcctcgcgtacggatgtcctggtgtgggtgattcaaagtaagttgttgcataattttgggaagtgattcgccgaacttggtcagtgtaagcggtcgttcaaagccgtgtgcttccataggtggccgatacaatcctgcttactgcaatatgtcatacgggtcagagtcaattcatattcaggtaaagccagcaatgattatctttctgtcggcgaaagaatcggtttccttgatatatagtttatataactattattagttaattgaccagagctagaaatgtatatcgcttaaggatacactcaggtgctatagatagaatgtggcggcatcgtattagtgaaataacatcattgacttcgatgtgtgatgaaatcggatagaagtcctcttgctgagtattctcaaagatcattgtttatctcgactgtagaaaagaaacattctggttttcttgaccatgaatcttgtttttcacgggcagaaatattgtaactggagaaaccatggctaatccttaccgcgaacttctcacaacccccggcgtcatggggttagtgatcgcgagttccattgtccgtctgccacaggcaatgataggcatcagcatcattaccatgttggtgcagaagacaggtctttattggctggctggctcaatcgccggtacatttgccctgacgaatgcgcttatcggcccacaggtatcgaaactcgttgatcagcggggtcagggtcgagttctgccctttatggccgccttcagcattggtatgttgctggcgctgataattgctgtctatatgaatgcgccgactctactgctttttattcttgcggtattggtgggtacgatgccaagcatgcccgctatgataagagcacgctggacgcagcttttccgtggtaagccacaattacacacggccttttccctggacactgttctaactgaactcgcttttataatcggcccaccactcgccattggcctgagcaccagttttttcgccgaagccggacctcttgttgccgtgttgcttctgatcatcggcgtgacaacatttcttctgcaaagggagacagaaccgaagatcgccgtaggtatcaggaggaacgcaagctcgaccttacttatccccggcgttcgtaccatcgttctggcgcttctggcgatggggacgattggcggatctatcaatgtggctgtggttgccttcgccaacgcacaaggctggccagcgtctgccagtttcattctggcagcctatgcgctcggctcaatgatcgcgggtctgatgttcggcgtattaagggtttccttaccgattgaaaagcagttcttcattggtgtactggtaacttcagtcacagctgtattgactattttttcaccgaatgtctacatcttgtctgggatgctctttgtggcaggcgtgtcatttgccccaacgatgattatcgtcatgaatctcggtacgatcattgtgccaccgtccaggatcaccgaaggactcacgtggatgacgactggcttcagcatcggcgtagcgctcggtagcatatttacgggcattgtcatcgacgtctatggcgcgcggacagggttcggtgtagccattgtcgcgggattggtcatggtggttattgtgcttttagggctgcgtacacttcgtgccacgtcatcggctggcgccgagccgaccttccactaatcactctgaatcaggccgcccgcgctggcagcgggcatagtgccgtgaatctttcactggagcttcttcaacctaattggagaaacttctacacgtaaacctgctgcttgccatcctgggaatccatctccaaggcgtagggctttgaatcctttggatcgcagtaatgaaaccgcctgagtagagagcacacaatatcgcccaccacaataagcgagaatatcctgattgcgaggcagttctccaagatggtgtacgagagcgtctgttggaatattgatggctcccggaatgtgccctgcggcgtaatcctcttccgagcgcacgtccagaagtagtactccttcctcctgcctgcggagcagttcttcaatagagacaccttctaagtgctctggatgatgaatgctgtcggagacgacacgctgaatctccgtttgctgataagcaagatagtctcgtaacgcagccagtatatttgcaactgggccgtcaccaatccgatacaggacatgtttgccttcgcgacgggtttggacgaaccctgcacgtcgcaattgctgcaaatgttgtgaagtattggtgatggataggccggatatctctgccaaatgctccaccgagctttcgtgccgaaagattgcctcaatcaaggtcaatcgatgtgaatgtccaagtgtcttggcgaaatccgccatttcgctaagagcatgagaggtacgattaatcgtcttcataaagtaaaagcttcaaatatcaacatttgcgacatagataacataattagtctaatcgcgccattgatccatttattgctggaatgatagattgatgagataagctgaccgcagattgagcgaattcacgcatataccgtactggactccgtggtcatagacggttctggtcggtgtctgatttagactcaaccgtgatttttgcttcaccgagaagatgtcattcttgttgtttgtactggcaggttgcggtttttttgcgaagctgttcctacgataggcgtagtaatttatctattgccaaccatcgtggctaaataaaatacgggttgactaactacgagggacacagaatgaatgaagctcaaatcatcttaacactgaacgcatctgttcggacccgcgtcaaagttcctatacatcctcgtacccgtcaccagaggtttgaagccgagatggtaacgttatctggcccttgcgacaccagcgagtatcctgtgatcgtctttgaaccgctcggtaactcaccgcacgttcgcatgcattccgaatacctaacagacgatgtattcggctctgagcgttgtgactgcggcagagaactccaatgatcactcatcatgcaccgatcagcgggattgccgcgtaccgcgataagtacgttttaacagccggctacgataaccagatcattctgtgggatgcaaaaacccagcgtccgctcgcccgtgcgatgcacgatcaccttgcgaatcagggcgtattctcacccgatggtgcttacgccgtaacgtcatcatccgattatagtgctcggctctggactgtacccgacctgcggttggtcgccgtgttcgccgatcatgaggacgatgtagaaatgagcgtatttcatcccgataagcctctggtcgcaaccgcttcacgcgaccatcatgtccgggtgtacgatttcagtggcaagctgttgcagacgttcaaaggccattcagctgacgtaatctcggttgaatggatgcataatgctgacgagcttgtctcgtcaagcgacgatggtacgatcaagcgttggtcacttgagaaaaactgcctcgtcgctgacatcgatctcggtggcattgagaccgatactatcgctatcgcagcagacggacgcatcttcgctggcaacgacgaaggagagataattttaatcggtactgacggctcgcaggtgacgttcagggcgcatgatgcgggtgtgaagcgtctcgtgcttgaccacaacagggggcttctggtgtcactgtcatacgaccgcacaatgcggctatggaaagtggagccatttggacagttagaagaactcgtgagcgcgtcgctgccgcctgaagtatggccacgttcatgttccttcgaaggtgacgatcacattgtgttcgcgactttccaagcaagctatcgtctgtataactggaagaccgatgaatgggatttggctgaactcgcgccgacactcgtcgtcaatgcagccgcgttagtcgacggccaacaatggacgattggtgatgcaggcatcgtgtggatcgaccagcgtgagcacacacacacgggcagtctgtgcaactttcttacgcccgtaggtgacgtgatcctgacaggtgggcagctcggtaaagtgtttgatgcgcgtactggtcacgaattgtaccagcatcgttcgccactaaactgcggcgtgtcattcaagcgtaatggcatcgatcatgcggtgatcggtgcatacacgggcgaaggtattgtgctgcgtatcgatggttctcaggtaacgcacgtcgctgatctgccactgcatgataacgccgttaagggcgtcgctatctctggtgatctgcttttctccattgcggcagacgcgtcagcggcttggtatcgcgtgtcaacacttgagcaggtgtatacgcttaagcgcgcacacgagaagatcgcgaatggctgtataggcctcggtgatggctattttgcgtcggtgagccgcgatctgaaattgcggatatggtcaccagatcaccaggcagatgtcatcgcgactccccacacgcactcgctcaaatgtgtttctgcgggagttaacggtcgctatatcgcaactggcagctataacggccgtgtcgctatttacgaccgtatcgatgacctctgggtgatcaatatgtgggtgacgactgcgggcgtgtcatccctcagctacgatccgatcacacatgtgtttcttgcgagttcatatgacggcaatgtctatcacatcccgatggagcccatatgagcagtaacaccaaaccacattatattgatgctcagcggacaatcgttcctgttgacgttccaagcacggcaccgcgtgattatgaaaaggtgttacgctcggattttgtgtcgagttataacgaagggcgcgatgtctggaccgaagaggctgcaatgcagcaggcaagtgcaatcttgcatgctcatctcggtcgttcttccgatgtcctggacgctggcgcaggtcgcggacgtgatactgggttcttactcgcgcaaggtcatcgggtcactgcggttgacctcgtcgaacttcccgagtggacacaactagtacagaactggggtagccaggtgcaattccgcataacgccagtgactgaactagacggtgagaacctttttgatggtgtgctcgacaatggctgcctacatcatcaacatccagacgcctacgttgtgtatctcaggcgcatccacaagcttttacgcccaaccgggctcttcacaatatcagtgtttgagtcgaaagagccgggtcggctgtacgcaaataaaatgcgacggctttatcgcgagttcaccgattctgagcttaccgagttgctgcgcgccgcgcatttcactcttgtcagtgtgcaccgagtaccgcgcccaacagccggactgaactatttggttctgacagttagaaaatcttcttcctactaaggcgaggccatacccatgaaacctattctcgccgacaaccctaaccatctcagtgaccgtgcagcgatggcgttgcctgaaaatatattcgttgcccgcatgcccacgacggtgttttcaatgcatctcgatctactgcaatctgagccggcagagtggatcgcaatcgcgcagaatccgtccacatcatttgaacgccgttacgcagcgggtacattgctcagcttttcgggcgatccacgtattcgtccgtttgatccagaaatgtgtgacgtacccggcgcaagcgtttggctcggcactgcaccggaacgggttccacagatcgttgctgaatggcagcgtgtcggtgtaatcgaggaatggatagctaaggaatgcccatgctacaacgtggaaatcaaggcattccggattatgcgttatcctgtcaccaatctcgaatatcggctctttcttgagcagacgcgagcgccatggtttccgacatcctggcccttcggtgtctatccagtcgaacgggcaaatcatcccgtctggtctgtccctccggaagcagcagaagcgtatgcagattggctgagcgaggctacaggtcggcgttttcggttgcctggagaagccgaatgggagtacgcagcttctggaggcactggttccgagtatccgtggggtaacgagttcgatccttacgcagccaatacggtcgaagctgggcctttgtcgacaacgcctgtcggtatctttcctcttggtcgtagcacgtttggcatcgacgatctcgccggcaatgtcgaggaatatgtcgccgacgattactctccctaccctggcggcgaagtcattaacgatgacctcgcaagcactcagggtagctatcggatcgcacgtggtggcagcttcacgcgctttggtgatctgacacgctgtgcacgtcgtcacggccactaccagcgtgacatctacgcgatgggttttcggctcgtggagtcgctttgagcatggtcaggattgtgattcgaccgcgttctgactgtagtgtgaggtgtaccggtttcccaaaaaccatattatttaacgagggacttcaatgagcgagctagccactgagacaatctatgagtcgacaaacgataaagttgcactgacttcagtcgtcgacttggttaaattgtccgatcaataccggcaatcggcagtcctgcactatgccgttgctgaaaagctatttgatttgacgcaggaaagctgcacgtcagccaaagttgccgggaatctcggcatggtcgagggtaaggtgttaatcctgttaaacgcgcttgttgctctcgggcttctgaagaaggctggcaacgagtttttgaatactgagttgactacgcgatacttgacaagtaagagttctgattacataggtgcgattgttgagcatcagcatcttcagtgggacaactggccccggcttggcgaaattttacgcagcgaaaagcctctcgatttccaacaggaaaaccgtttcatgcgcgatgaacgcgctcgcgatgcgtttaatgacgcgatggtacgtctgagccagcccatgcgtgatgtcgtaagcggcctcaatatcttcacgaacgcgaatacatcgatcgaccttgccggtgggcatggtacctaccttgcggaggcgttactccgtcatccacagctaacaggccagatatgggatctacccacgacccgcgacgcggcgcaaaaaacgattgaagcatacggcctcagtgggcgactcaagttttgtgagaaaaacctgcttgacgctctcaattttgagagagccgccgccgacgtcgttatgttgaacgattgccttcactactttaatgaaacagaggcgcttgcggtgatccgtcacgctgcctgtcttgtgaagccaggtggtgcactcttgctcctcacaatgacaatggatgaaaatcgtgtcacgcctgcgctatctgctgacttctcgcttcacatgatggttaataccaatcacggcgagctacatccgacgcagtggatagctcgcgctgtacatggaaatggcttgtctatcagtgagctatcaattggccgctacacacttctcatcggtcaacgccctgccagtgaggtataactatgcttaccttcaaactgatcaatcttgatattaatcccacagacgcagaacagatcactcgtgtgttatccgagcaatgcgcagcggccggctaccgattgagtatggcagaggtggacaatacaacgccggatgggatgtttgtgctttctcatggtgcgtcgactgcgataaataatgagcgactcgctggagttgggtggattgctgtcgcgcagatcggtatcgatccgaaaaataccggcggtgaagcttctgcgatatggcacgaaaatcctcagggcgtgttctgctatcctctcgcgcttgagatggaatctgtgggtacgtcatctgatgtcgtacgcgactggctcgcaggcttcgctacgtttactgcctgcatcaaaatgtggcggcgcttacgcgacaaacctgaagatggcaggccgcacgagctacgtgtgaaccatatcaatatcctcgcccgggatctcgacaaatctgtcgatttctaccatcgtatcttaggcgcttcctattgctacaacctaggtccaaagaaggttgtgatggagctaaacggattcgatttctttatcgaacaaacagatactgttacctacccacccggctaccattttggtgtgcgcacagaccccgaaggtgtcaagtcgatcgcagcaatagtaggggcggacggtggtatcaagatcgtaaagggtaacggtccaactattggctaccatactgggccggatcgtgtgcgtaccgctttctactttgaagatccggacggtcttgtcatcgagatctattctccggaaattgaaatgcttgagagtaacccgcatctcatctcacagcatttttcgcaggcctgatgaccattattcaacctatcaacagacgaggtagtccatgagttctaacaatgccccctcttggggggaactgctttccggacgcaacggcttgctttcaatcgcgcttgcaggaggagtcgcgctacatgcgatcaatatctatatcgcgacgacaatcctaccgtccgtcgtacgagatattggtgggcttgagtactatgcatggaacaccacgctgttcatggttgcatcgattattggcgcgccattgtccaaaaacgtgctaagccgtttcggaccacgtgctgcttatctcgtcgctctcatcgtgttttgtgtgggaacgctcgtgtgtgcaagtgcaaaggacatgttgtggatgcttgttggacgatttgtgcagggcttcggcggtggcattctgtttgcactcagctacgcactcatccgtatcgtattcgacgggcggttgtggccccgcgcaatggcgatggtgtccggtatgtggggtatcgcaacactctgcggccctgcaatcggcggcatctttgcgcactcagacacttggcgtcttgcatttatcgctcttttgcctgttgccgccgtgcttgctgtgatcgtactcgtccagttgcccgcctatgagaaatctagtgcacagacggatcgggccgcaattggcaaaatcctgctgctcggtgtatcggtacttatcatatcggtcgccagcctgtcgaaggagatttttgcaaacatcgccggtgtcgcagctggactcgtgatcgtcgtgttgattgcgcgcgttgatcgtaagtcgaaaattaaactactgccgaccggcgcatacgatgtgcgcgcatctcttggtgcaatttatgcatgcatgagcctgcttgtaatcgggatgacgaccgagatattcgtgccgtattttctgcagaccatccacggctatcagccgttaatcgccggctatgcgactgcactgatggcggcgggttggacagctggctcgctattcagctccggacgcagcgcacatactgcgcaggcgcttgtgcggcgaggcccaattctcgttgtgcttgcgctcatcatgctcgcagtcatcatgccatcgcagcatctgctcagcccggtttctagccttacgttgatgtgcatagcgctcgcagcggttggagctggtattggtgccgcctggccgcatctgctcacgcaggtgtttacaaacgcgcctgctggtcaggaagatcttgcgtcgacgtcgatcacgacggtgcaactgtatgcgacagccattggctccgcatttgcaggcatcgtagcgaatcttgccggattctctgacccaggtggtttggctggcgcgcagaatgccgctatgtggctgttcgctgtctttgcaattgctccggtgctcgctacgtttgtcgtacgccgtgtacgcctcacatagacgcgccgaacgtctccaattaataaggactcatcatggatccgataaccggaattgctctatttaaggctctgcatgcgttcgggatagccggatgggcgacaataggcatgatcaataatgtgcagtcattcacagtgacgacgggcacagtaggtcgcatgatgagcatgacgctgctcaaacaggaaccgcccgtgaataccccgttgctgcgtcgtgcaacaacatcacgggcgatacatagcgctgcgcttgccgtcattgtgatattgcaggcactgaccgctatcgctatgtggatcagcggctatttgctactgacaacggctgcatcacacccggacacgctattatggctcagcgtgggtattaccggctttgctgcgtgcgcattcgtgctgttactggggggattgtggtatggctactggatacgccaagaaggtctgcaacttacacacatcgctatcatcatctggtcgatagccgcatttttgttgttccatctcagtatgacatccgagttgataggagacattcgatgataaattcccttcctcttcacgacggtgattgcttcgtgcaggttgatgatgacgttgccgctaagctcgatggatttgaactgcggcttctcgcaagccgcgttgtcgcgatccgtgacaatcaattcttcgatctacaaaacctgattgcgggaggagggaccattacacgaaacggcaatccatacgacctacgacgccaaaatcttgcagtgctgtattacgatctcagccgtcatggcgaacttgaatggcgtgagtctgatgctgacggtgctcgccttgccgtgctcacgccgaaagttaccgttgcggcctcgtcatcacctatccaagcagtacggttatcgcccagcgatcgcctcgctttcctgccgttcgaagagacgcgcaacgtgccgaatatagcagccgacgcgatccataatacagccacacggcttacactgtcgcactggccagcgaaccggactcccgcacgctaccaagcaaacctgtcgactgagagcgtactgcgctttttgcctgacatgtcagagtatcctgatgtgcggcacgtgacgaccgaccactttgatttagacgggctcgcatctgtctacgcactgatcgcgcctgaacatgcgcagagtcatggacaacttctcgccgacgtcgcacggttcggtgatttcgcgtgtggtcatagcacgaaggcgcgccgactcgcattcgcgctgaacgcaatcactgagcaagcattgcacgccgcgggaacggtaccaaacgaaagtgtgcgcattacggcacttttccgcacgctgctgccggcattgcgtgacttactggatgcttctgtgatccatgatgcgctttggcgtgacgccgagcagcatcatatggaaacggaagtgctactcgacagtccgaacgtgatggttgagcagtatcctgagattgatcttgcggtattccgtctacctacttctaatgtgccatatgtacgcgtaccgcaacgttacttcggactttcgtctattgccttccacaaccgcacgccattatcgacgattgcactcgtcacgcagggcgacatagtcgtccatcagcgttatgaaggatgggtggagttacattccgctgcgccacggccgcgtcgtgatctatcgattttagcgcgggcgttacagtcagccgaaacgaaagattgccgctggcactacgatggtgtgcaacacattatgccacggcttggacgcgacggcgcatcgctgagtagcttgtcggtagagacgatagtatgtgaactgaaacgcttcctcgcgattgcaccggccgcttggtcgccaagtgtgtatgctgcgccaaagtagtggaagttggcctagctaaaagcatttttcaggtttgtatctggctgttcaatcgagctagaaatcgtatatcanaatgctacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacctgcggttggatcacctccttacctgaatgatagtgattgtgcagtgtccacacagattgtctgatgaaaatagagtatcacggtataggcttgtagctcaggtggttagagcgcacccctgataagggtgaggtcggtggttcaagtccactcaggcctaccagacacgttgactcctggccctttccagggggacccggggcggatgccacgggtgttatctgccgttgaaacggcgggcgggggaacggtctgcacagttgtctggacaggccggtgataacctggatggggctataactcacctgggagaacgccgccttgcacg

SEQ ID NO: 14969 - DNA, 75570 bp, Xenorhabdus bovienii
  Genomic contig Name=Xb4151_4152.C428
tgaggctgcgtatcttacgctttcctcgccgggtgtaagcctttattttagggcttttctcccgctgtcctcggcggcgtgtcttcgctcagcgtcggtcagtggtggcgcattatagggacttttccgtgcctgacaatagtttttttcataaaagattatcgtttgctgcattacacagcaaaaggctgatttatacctacttatacacaaatttatccacaaatggatatttcggtaaaatttgtcgagcatcacgcaaacgttttcgttacaattatcgcaggaaaaaacaccacgtgattttttctgattgttttgaaatgttattgcgaatgccattttttctctcaatacccggtttttttctcaatagcacagtcttgttttatgaaattcaagggatcacaccaatgcaacagcttcgtccaatccgtcgtgccctgctgagtgtttctgacaaagcggggattgttgaattcgccaaagccttatccagtcgcggtatcgaactgctttcaacgggcggcaccgcacgcctgctggcggaagcagggctgaatgccactgaggtttctgactatacgggcttccccgaaatgatggatggacgagttaagacgcttcatcccaaagtacatggcggcatccttggccgacgtgggcaggatgatgaagtcatgtcactacaccagatttccccgattgatatggtagtcgtcaatctttacccttttgcacaaactgttgcgaagccagattgtcctctggaagatgctgttgagaatatcgatatcggtggcccaacaatggttcgttctgccgccaagaaccataaagatgtcgcgattgtggtcaacagtcaggattacggcaagattattgaagaaatggatagccatcaaaattccctgacccagctaactcgttttgatttagcgatcaaagcctttgagcataccgcggcttatgacagtatgattgccaattactttggcaaactggttcctgcttatcatggtgagacgaatcagccatcaggccgtttctcccgtacactcaatctgaacttcattaaaaagcaggatatgcgctacggtgaaaatagccatcaagatgctgccttctatatagaggagcaaattgccgaagcttctattgccacagcaacacagttacagggtaaggcactctcttacaataatattgctgataccgatgctgctctggaatgtgtgaaaacgttcgccgagccagcctgtgtaattgtcaaacacgctaacccttgtggcgttgcggttggtacagacattcatacagcctatgaccgtgcatttaaaactgatccaacctctgcattcggtggcattattgcttttaaccacgagttggatgccgatactgccaaggcgattattgagcgtcagtttgtcgaagttattattgcgccttctattaatgaaaaagctctgccaattctggcaaccaaacaaaatgttcgtgttctggcgtgtggcgaatggcattcgccagttgctggtctagactttaagcgcgtcaatggcggcttactggttcaggatcgtgacttaggtatggtggcagaagctgatctgaaagtggtttccaagcgcaagccaacagaacaagaaatgcgggatgcgctgttctgttggaaagtagcgaagttcgtcaaatccaacgcaattgtttacgccaaagataatatgaccgttggtattggtgcaggccagatgagccgtgtttactctgccaagattgcaggtattaaggctgccgatgaaggattagaagttcaaggctgtgccatggcatccgatgcctttttcccattccgtgatggcattgatgcggctgcggcagtcggggtgagctgtgtgatccagccgggtggttccattcgcgatgatgaggtgattgctgctgctgatgagcatggtatcgccatgattttcactggcatgcgtcatttccgccattaataataggagcgccagatgaatatattgattattggcaatggcggaagagaacatgcactggcatggaaagcagcgcaatctcctttggcagataaggtttacgttgcaccgggtaatgcaggtactgcactggaagcaaatctggaaaatatagacattgctgcgacagatattgctggattgttggcttttgctcaaagccaacatatcggtctgactattgtggggccagaaactccgctagttatcggtatcgttgatgctttccagcaagcagggctgaccatttttggcccgaccaaagccgccgcccagctggaaggctctaaagccttcactaaagattttctcgcccgccatcagatcccgaccgcggcctaccaaaatttcacggaaattgagccggcattaacctatctgaaaaagatgggagcccccattgtcattaaggcagatggtctggcagccggtaaaggtgttgttgtcgcgatgacaatggaagaagcacagaatgcggttaaagacatgctggcaggaaatgcgttcggagatgccgggcatcgtattgtcattgaagaatttctggatggagaagaagccagttttatcgtcatggtagatggtaaaaacgtagttcccatggcaaccagccaagatcacaagcgagtcggtgatggcgataccggccccaataccgggggaatgggagcttattcacctgctccagtggtaacagatgaggttcaccagcgtgtcatggagaaagtcatctaccctactgtagaaggaatggctgccgaaggtcatacctacaccggctttctttatgcaggtttgatgatcgataagcagggagagccaaaagtcatcgaatttaactgccgctttggtgatcctgaaacgcagccgatcatgatgcgcctgcgttctgatctcgtcgaactgtgtctcgctggagcacaaggccagttaagcggaaaaacatccgaatgggacacccgtccggcattaggtgtcgtactgtccgcaggcggctacccggccaattatgtcaaaggtgacgttatcagcggcctgaatcaggaaacggatacagacgaaaaggtttttcacgcaggcactgctttcaaggataaagacgtcgtaacagcaggaggccgtgttttgtgtgtcaccgcgctgggcgacgatatcgcagaagcacagaaaaaagcttacttgagagctgagaaaattggctggcaaggatgtttttatcggaaagatattggataccgagccattgcccgtctgaaataagttaatgcagaaccgatagaataaacaaccgacgaaagtgacagaattacagtttatctttcgtcggttcccaacgacaaaaatcatcattggctaccaatagtaactgttttccttctggcgcatccagccatgcaatggtcaatatgccagcactattcttttcccttcccttgagccatgcccgatcttcaggctcaaattgaatggataattgtttctccgaacaagtagttactttaccatcctgccaatgtccctgtaccagatggacatttccggcaattaaagcgtcactgatttcttttatccgtttggcatcaaaccgcaaacggacaatctcatcgttggaaagtggttcattgtgttcttttgtctgccgctgcataaaaataaccttgttatctttatcaatccgcaatgtttcttctattggatgactatcaagtacagagcggcggatctgccacaaattaccgtaacggtattcatagaaagtcacagaggtatctgtattacggtaagggctgtaaacactcataatgacttgaggattactgttttgatcattcaagcgccataaacggataacacctccgtctgtaataaaaccactggcactgaagagtggaaccttgggttgaaccgagcaggcgctgagcaatgagataaaacccaatgctagcagcccctgtagcatcaacaaaaggggcgttaaattcccctctatcttcttttttcgcaatacgattacttaactgcgtctttcagtgctttacccgcagagaaagcaggtacgtttgctgctgcaattttaatttcattaccagtctgtgggttacgaccagtacgttctgcacgatgattaactttgaaagtaccaaagcccaccagttgcactgaatcaccatttcgcagagattcagtgattgcattcagagttgattccagagcagtttttgcctgagttttagtcagaccagcttgttctgcgattgcatcaactaattcagtcttattcatagattatccttacagtgtgtttatcgtttgcaaagcatcgagtgcgacggatatgccgatttgacagcacccctgcatacacgcaccgatagccacttcttttcacccccaatgtagaacagagtgagggtaaatgtgaagtctttaaatccggcaattcaagcactaagtcatgttttctgagttattgctccaaatttataccgatgttgctaaccttagtctcgcgaaggtcagcccttaatcctttaattaattctatatcccgttcttcgcagtctgccaataaacggtaaatttcccattgaatatcccattcctcttcaatggcaggcaatgcctttaactcatcctcagtcatttctctaccggcctgcgtcatttccagcatagcaacggtacggatagatgtttcactgacggctattgcatgttctaacgttgcaccgctcaaacgagaatgaatgacttcacttaatgcaatgcacgcatcaattgctggatacacaccataaatatcatagctatctgctgatggaataatggtctctaatttttccagctgactatcaaaatttacttttgcatctttgacgatcaatgtctcccacgccagatctaaaatacgacgatactgggcggggtcagcaaaccctgtctgacgacaaaacacctgataatttggatacattcgctcacatagactagccataaaagtccaatgttgccaactttcaaatttctctaatcgcaggtggatcgggtttcttaacattagccgttactcatgatgcctaatttgcgtcgaagtttacctgaaaatcaagaatatccacacatttccgctgcaattatagatttttctgcattgtttgcttaaaaaacaatctatttgaggcaatcccatccgcccaacgggtcggctcaggcagtctatatcccttcatgcactgttcaacccagaagaccgcactgtcaaggctgaccttatgaccaatggaaatatagagcggattgcacctttttttacttcgccatacaacgccaatctgctccgcatgatccatcaatgattgataacttcccaccgcatctcccacaggcgggtgctcaccacacagacggcttttagccacaccgatagtcgggatatccgccaataagccaaaatggctggcgacaccaaaacgccgaggatgagcaattccctgaccgtctaccattaccagatccggccgtaggctgagtttttgccatgctgccatcagcgcggggtattcacgaaatgagagtagaccaggaatataaggaagcacagtatcaattctggcgacctgatactctagcaattcaagcgaaggataatgcaggacagcaatagcggcacgagtcaccgtaccgtttttttcaaacccgacgtcagcgccggcaattaattctggcataaaaggcgtagacgcaggcattgcggaagtagaagtcgtcatgaaagaatcatgacggataacctgccgtgctttttctatttgttcctggcgtaacgcctttgtatcaatcataaagtcatcggtgatatttttctgaaagtctgtgtaccgcttcgacgaatgcgccagcatgttccggtgggacatcctgatgaatgccatgccccagattgaaaacatgcccattacccgtaccaaaatcctgcaaaatcgtcgaaacttcctcttcaattcgcgctggagcagcatacagcatagatgggtccatattgccctgcaaagcgactttatcgcctacacgacgacgggcatctgcgatattcgttgtccaatcaagcccaagggcatcacagccagttgccaccatcgcttcgagccattgtccgccccctttggtaaacaaggtgacaggcacacgacggccatcatgttcgcggatcaatccgtcaacgattttatgcatatattgcagcgaaaactcccgataatcgcgatgagacagaacaccaccccaagtatcgaaaatcatgacagactgtgctcctgcttttatttgcgcgttcaaatatagaataacgctgtttgccaatttatccagtaacagatgcaacgtagcaggttgggcatacatcatggattttattttggtgaacgccttactgcttcccccttcgaccatatacgtcgccagtgtccacggactacccgaaaaacctatcagaggaacttggcctgccagtgccttacggatcgcacgaacagcatccatgacatagcccagctccatctccggatcaggtacagggagtttttccacatctgtatgattgagaatcggagagtgaaaacgcggcccttccccagtttcgaaatacagcccaagccccattgcatcaggaatagtcaaaatatcggaaaacagaattgctgcatccagcggaaaccgacgcagaggctggagcgtcacttcacaggccagttcagtgtttttgcataacgagatgaaatctcccgcctcctgccgcgttgctttatattcaggcaaatatcgccccgcctgacgcatcatccatactggtgtgacatcaacaggctggcgtaataaggcgcgcagatagcggtcgtttttcaactcattcatgacaagctcccttgattaattggccgcaaaattctttggttacggtcggtttaactttcactataaaaaaccgacgcattgtaacatgccagaaatcgaacttctggcacaactgccaataacatgcgccattcgctcatcatctcagagcagttcacatgttacggcatagcgcaaccgtctcttcgatcaaacggcgtgcaatcgtatccgactgagggatcaagggaaggtcatcatagcgataccaatctgcactgataagctcaacgggatcatgttggatctcaccgctgtcataatctgccagaaaccccatcatcaatgattgcgggaaaggccacggctgggaagccacataacgcaggttgcggatcttaatcccactctcttccataacctcgcggtgtgctgcttcttccagcatctctcccacttcaacaaacccggccagcaccgtgtgaataccattgcgatggctctgatgttgcgccagcagaatatggtcatcacgacggataccaacaataacgcagggcgcaatttgcggataataacgttcatggcaatgattgcacaaacaggcccattcatgctggctatgctgcatttcatggccacaatagccgcagtaatggtgtgatcgataaaactcagccagttggacgccacgccctaccagttgaaacaatttagggtgttgagaaacaaccatgcggggagatgccatctctgatgccatcttctggcacaccagccacacagtctcgcctaaccactcaccaataggccgcgccatatggccttgtaatgaccattgtctggctgtccctgacggcaattcgccctgtggcagccaaactagattctcaagactgataacccaccagcctcgttccatacctgtcagtttttgttgaatcatctaccgcaccatagttccaatgacattgtgtccaaattcagcatcagacaggatactccttttcgtcgtatcctgtctgaacatcgccctaatttaatcaatctatatcaaaatctatttatttcgaaatgaaaggccgttataacgctcacatttcccaatctgtcatcgatactttccttgaccaacaaatttggggcaatatcattcactggcatgtcagtcgatgagctgaaataaacacaattttggaagcgatattcaaaaaaaccattgaggaataatgactatgtcacagcagattgcggtatttgatctggatgatacattgatttgtggggattccagcctgctttggacggaatatttgtgggaaaaaggcattattaccgatcatcgttttatcgaggcagaccagaaaatgatggctgactacagtgccggtaaactggatatgcacgattatctggcgttcaatttacagtcactgaatcaagtacaccatgaacaggtggatatttggctgacagattttgtggaaaccaaaattaaacccatctcttatcccgcagccaaaaaacaattagatatctatcggcaacagaacattcctatcattattatttctgccactgtttctttcgtggtgaaaaaagtcgcggccgcattgggtgtgctgacagctatggggattgatatggtcatggaaaatggctgctatacgggcagtattttgggaacccctaccttccgtgaaggaaaagtcgtacgtttgcaacaatggttgacagaacaaaacttatcacctcagcatatctccttttacactgattccataaatgacctgccgatgtgtttatttgccaacgaagtgtttactgtcaatgctgatatacggttgcaaaaggaagctggaaatcatggatggaaacagttgaactgggtgttataagaatttgtttctatatctaatatgtttcaaattgtagggtataaattcgtcgttattttatttattactttatagcgacgtttttcccaaaaattatagcaatcttctcatataagatattcatgataataaatattaaattaaatacaataaattatgaattgataatacacttcattaataaaaaacctctattccactatacaaaaaccatcaaaccactcctaattaaaatataattaaaccatgattttctgacgaagtaatatccgttcctatacttatttaaatgatggataataaaaatcgcaataacttatgacacccaaaacggtatggagctcaattcagggattgcaattcaattgagtcttaatctcacacaaaagttgtaagttttaggttgtagttttcacaatccgctctatactctgaggtgtttttttcttgtcggagtgcctagcgttcaacgtatatcacgatgaacacaggctgagaccgttgattcgggatccgcagaacctgatcgggctaatacccgcgaagggaacaagagtaattaccccgctgacatatcctcctgtttctatagagatattattcagcaccaaccattactccctgcgagctccagacaagcaattttctcaacttaagcccattccagcaggcaacgctcccgttcgcatgatggacaggctataacacagtcaggaatttgctatgtctaataatattgttatcccaactactgatgtcatccctgcggccgatatcgcccccaaaacctatcctgcacggccacgcaaggcacaacgggatgcagcacaggaatttatcaattccgttcaaggcgttaccttccccaactcacgcagaatttaccttgccggctcccgcaaagatattcaagttccgatgcgtgaaatccagttatcaccaacactgattggcggcaccaatgaaaatcctcaatttgaggaaaacgaacccgtgcccatctatgatacctctggctcttatggagatcccgactcggtgctggatgtgcgagctggcttgaagaaaatccgtcagctttggatcgaagagcgtaatgataccgagccagtcgctgttctcagttctgactttacccagcagcggcttgcggatgccggactggatcatctgcgcttcaaccagcttcctcatccattgaaagccagacaaagcaagcgtgtcacccaattgcactatgcacgccaaggcattgtcacacccgaaatggaatttatcgccctgcgagaaaatatggggcgtgaacgcatccgcagtgaagtcctgctccagcagcatccggggcaaagtttcggtgcaaacttgccggacaacatcacgccagagtttgtccgtcaggaagttgccgctggccgggcgattattcccgccaacatcaaccatcccgaatccgagccgatgattattggccgcaattttctggtcaaagtgaatgccaacatcggtaactcctccgtcacatcctccattgaagaagaagtggaaaaactgatttggtctacccgctggggagcagatacggtgatggatctctctactggccgttatatccacgaaacccgcgaatggatcttacgtaacagtcctgtacctatcggtacagtgccaatttatcaggcgctggaaaaagtgaacggcgtggcagaaaacctgacatgggaaatgttccgcgatactttactggaacaagccgagcaaggggtggattatttcaccatccacgcaggcgtcctgctacgttacgtgccgatgacggccaaacgtctgaccggcatcgtctctcgtggaggttccattatggcaaaatggtgtctctcccatcatcaggaaagcttcctctatacccattttcgcgaaatttgtgaaatctgcgccgcctatgacgtttctctgtctttgggagatggactgcgtcccggatcaattcaggatgccaatgatgaggcgcaatttgccgaactgcatactctcggcgagttgactaaaattgcctgggagtacgatgttcaggtgatgatcgaaggaccggggcatatcccgatgcaattaatccgccgcaatatgacggaagaattggaacattgccacgaagcgccattctatacgctggggccactgacaaccgatatcgctcccggttatgaccatttcacctccggcatcggtgcggccatgataggctggtttggttgtgcaatgctgtgctacgtcacaccaaaagaacaccttggtctccccaacaaagacgacgtaaaacaagggctgattacgtataaaatctcggcacatgcggcagatctcgccaaaggccatcccggagcacaaatccgcgataacgccatgtcaaaagcacgttttgaattccgctgggaagaccaattcaatctggctcttgatcctgaaaccgcccgcgcctatcacgatgaaaccctgccacagcaatccggcaaagttgctcacttctgctctatgtgtgggccaaaattctgctccatgaaaatcacgcaggacgtgcgcgattatgcagcaaaactggaacaggaagctggcatggaacagatgtcagaagaattcctcgctcatggcagcgagctgtatcacagtgctgaggacataagcgatgaaaaatcagcctgaagcctcatcaattccacaagccccttttgccccaaccgtgcaccgtttggggctttatcccgtcgtggattccctgacgtggattgagcggctactgaaagcgggtatcagaaccctgcaactacgcatcaaagatctccccgaagatcaggtagaagaggatatccaatccgccattgtattgggtcgccaatacaatgcccgcctattcatcaacgattactgggatctggccatcaaacatcgcgcctatggtgtgcatttggggcaggaagatctggatatcgcggatctcaatgccatccggcaagcaggactgcgtcttggcatttccacccatgacgaatatgaactggcgcggacaaaagcactgaggccttcctatattgcactcgggcatattttccccaccacgacgaaagagatgccttcaaagccgcaaggcctttcggcattgaaacatcaagtggaaataaccccggaatatcctaccgttgccatcggtgggatttcgctggatcgtgtgcctgatgtcgttgcaacaggagtgggtggcgtggcattggtcagcgccattactaaagccaaagattggcggcaggtaactgaccaattacttcatttgattgaaggaagtgatcgggagctcttatgttaaacgaccaagaatttatgcggtacagccgtcaattgctactggaagacatcggctctgatggacaggaaaaattaaaagcaggaaaagtactgattgtcggattgggtggattaggttcacccgcagcactctatctcgcagcggcaggcgtcggccacctttatctggcagatgatgatacgttgcatgtctcaaacctgcaacgccagatcctctatcgcacagcagatattcccgcaggaaaggcggttttagcagcgaagcaactgaaggccctgaatccgctggtcgaaaataccgtgctgaccgagcggcaggatcgtgaatcactggaaaatctcgtccgtcaggccgatctggtgctggattgctgcgataacatggcgacgcgctatgctatcaatgccgcctgtgttgcagaaaataaaccgctcatcagcggtagtgccgttggtttcagcgggcagcttatcgtattcgaacccccttacttgcacggctgttatgcctgtctctaccctgatcaggaagagccgcatcgcaactgtcgtacagccggtgttttagggccggttgtcgggatgatcggtacgttgcaatcgttggaggcaatcaaaatgctggtgggtctcccctctcccctaagtggaaaactacggttgtttgatggcagacagcagagttggagcacgttacaactaacattgttatcgcagtgtcctgtgtgcggaacccatgccgcaaaatctgatcgcgcagaaaccatttcaggcaaaacacgctcagggaaagaagtcgcatgaacattatcgtcaacgatcaaccgatcacactgagtacgtcgatgacggtgcaacagttactggagcatgtacaacgtccccaatcaggcaccgctttggccattaatcaaactattattccgcgctcagagtggaacagccatcagattaatgacggagatattatcctgctgtttcaagccattgccggaggttaattatgttaaaaatcgctgatacttcctttcattcccgcctgtttacgggaacaggaaaattcgccaatgcaaatttgatgatcgaggcgatacgtgcctctggtagccaattggtcactatggcgatgaagcgcatcgacctgcatggcaatgacgacggcattcttgccccactgcaacagttaggcgttaaattactgcccaatacctcgggggcaaaaacagcagaagaagcggtgtttgccgctcacctggcacgggaagcgctgggaactcactggatcaagttggaaatccatcccgatgtaaaatatcttttgcctgacccgatagaaacgctgaaagctgccgggcagttggtaaaagagggattcgttgttctgccctattgcggcgctgatcctgtcctgtgtcgccgtctggaagaagtcggctgtgctgccgtgatgccattaggcgctcccattggctcaaacaaggggctgctgacgcgagattttctgcaaatgatcatcgaacagtccaacgtgcctgtcgtcgtggatgccggaatcggagcgccaagccatgcactcgccgctatcgaaatgggtgctgatgcggtactggtcaatactgctatcgccgttgcccgcaatcccatcaaaatggcacaagcattcaagacggcgattgaagccggcgagctctctcatcaggcgggtgtggcaagccagaaatcacatgcagaagcttccagcccactgaccgattttctgggggcgttatgacagacaacacagtgacgactgatcatacattccgccagcgctggcagcagttggattgggacgacattacactgcgtatcaacagtaaagccacgcaggatgttgagcaagtattaaaccgcgatcgtctgactctggatgattttatggccttgctctctcccgcagccctgcctttccttgagccgctcgcccaacgagctcaacaactaacgcgtcagcgattcggcaataccgtgggattttatatcccactctatctttccaatctgtgcgctaatgactgcacctattgtggtttctccatgagtaatcacatcagacgcaaaacactcaatgaacaagagattaaagctgaatgccaagccatcaaaaagctggggtttgaacatatcctgctggtcacgggagaacatcagaacaaagttggcatggattatttctgccgctatctccccatgatccgcagctatttcagttctatcacaatggaagtccagccattggcacaggaagaatacgctgaactgaaaacgctggggttggatggcgtaatggtctatcaggaaacctatcatgctcccagttatcaactgcaccatttgaaagggaaaaaacaggattttcactggcggctggaaaccccggaacgcctgggacgtgcaggtatcgacaaaatcgggttgggtgctttgatcgggctgtcccctagctggcgtaccgattgttacatggtggcagagcacctgcttttcctgcaaaaacaattctggaaaagccgttactctatttcctttccaagattgcgcccctgcgcaggtggcatagaacccgcttccctgatgagcgaagctgaactggtacaactcatttgtgcatttcgcctgctggcaccggatgtggaactgtccctatccacccgtgaatcaccgtttttccgcgatcacgttgtaccgctggcaatcaatcatgtcagtgccggctccaaaacccagccggggggttatgccgacgatcattacgaactggaacaatttgcacctcatgataatcgctcggtggttcaggttgccgcagcactggtgaaatcaggtttacagccagtctggaaagactgggataattatctgggacgttagtttctgagagcctatatgattaggctctccgttttatctttatatacgatgaaaactgcccgatttttctaactcaaatcatgcaggtgtcttttcagacatgatttcaggctaaaatcggagaactttacctgcaacccttctcgttctggcgaacaacacattgctccgacaaaaacccgctgactgccaaccgcaaaaggcgataaccgcagtaacggccacttcaccccatcaatggaatattgcagcctgatcactccctcactatacgtcagccttaaccagaatttatcaggattccccggaaatacgcccatcgcccagtcagagcaagaattcgttagcacactaccgatcgttgcctgcccatcagaatgctcaacacccgcttttaaccaatgttgctcatccaccagtagcataatgccagcctgatcgtataaatgttcaaaacgcccttcgatacaaagctggaaggtaaaaccggcttcaatatgaacatcatcaacatagcgaccaaaaacatggccgctatgacgctgaaagccataccatgtatcacgccaaaaatcagttttaatatctgtcgtcacatggagtatatcttctcgatgcttccacgaggcaggctcattaagccaatggcagtgctgaaaattcatcaatagttaacctgttattttctggcgggatgaatcaatccatagcccgctaacaatgtaagagaaagtagagcaatacaggcaaaagcgccatgcaatgtgacctgatgagccaaacccccgataattgcaggccccagcaggatacccgaatatcccatcgtagagacggcggaaactgcctgagaatcaggcatgactttctgctgccctgaagcagtgaaaaacatcggagccagattggataaacccgctcctatcatcaggaaagaaatacccaataccatcatgctggatgccagatagatcaggacaaaacccgaagtagccagaattgcacttgccaaaaaaacccgccggtatccaaacattgagataattttatcgcccagaaagcggccacatgtcatggtaatggcgaaaagcgtgtaaccaagtcccgcctgatggctatctatattatggacactactcagcaagatcccactccaatccaacatggagccttccatcagataaacgacaaagcaaagaaaaccaagcaggatcacaatcccacgcggcaaggcaaaaaatggtgtattacccgtttctgtatgatccaataatccgctccatgctggcagcaacaacagaataatgaataatgacactgcggccattacctgaaatggggatattcccatcaataacaggaaactgactgaccctgcacccgcaattccccccagactgaacaacgcatgaaaaccagacataattggctgctgtgccattttttcaacattgactgcatgaatattgatcaccacatccgtcgcaccaatccccacgccgaacataaacagcgcacaagccagtgcccagggggttggcaatatacttaaccccggtagcatcaaaattgccagcagggcaaacaagggaaaaattttcctacaaccgaaacggctggccagcatccccgccaaaggcatcgtgataaaggaaccaatgccaaataccagtatgagcaaccccatggcaccatcatcaagtgcaaatctctccttaaccaaaggaataagaggtgcccaagctgccatactgaatccggcaataaaaaaagcgagccgtgtcgcgatgatcggctgttttatcgaagaaactgcatattcctcagacaacttaattcctccataaccctgttctctaaaaccatctgttccaaaacaatgtactctgacgcacaatcatgccctccgcaggttttgctggagggcatcaatatttacattgttatcacactgaagttatcatcacgctgacagcgaatttatcccagaaaattgcggaatatccgtcaattcaccaataatgcaagtcgcctgcccgtactgttcagctaccgacaaatcatgaggccaagcatatacccacgggatccctgcctgttttgccgctgcgatccccagatccgtgtcttcaatcaccaaagtctgctgaacatccatccttttcagctttagcatagcaaggtagggatcaggaaaaggtttagttctttcaacatcatcaccggaaatcaaagcaggttcatcaaacaaatccagtaaccccagattcgccagacaaacggcacgcggtgcggtggaaacaaacccaaaagcaatgtcattttgctgtaaggccgcgattaggcgagtaacccccgggcgtagataatgtgcagataacttttcctgataaaccgagataatcctgtcggtaatgccttgctgctcgggtaatggaacaccaatttcattcagtgtttcagccagactcaaaccaattaattgctgtggctgaacatcacgcgtgtgatcaggtgccagttcacacagcacatcaaaatgcagttgttcactatcgacaatgaccccatcgatatcaaaaatgacattgaatttatccatcagaaatattccattacttaaagtcagccaaacggatcaatattttgcagtttggtgtactgagcggtacttgggctttcgcggcaatatcacagcccacggtgagaaaagcctgctgataatcctcaaaatcaaagatctgactaatcaggcgttcggctgggatcacaccatcccggatcatggcgtaagcacgctcaaaactgttgttcaaggagtcaatcgagccgatgacagaaagacttttgtcggcaattttcagaatatcaagattggcatgtttatcttttaaagcgacattcagcaacttaccacctgcggctaaatggtcgaaaacatattcggtcagttgtcccgtagtatctacacataaatcgatcagggctgatttatcaccgtattcctgcatcaacgcttcatcaaaatcagtatataaccgacattctgccggcaggttgttgatagcaaattgcacacgactcgggtttttctcgatcatgaatgccttaacaccccgttcatgcaacgcccaaagatacagcattcccatagggccagcaccggctaccacggcccgaatattggtatgggtgatccccagtttatccactcccgtcagtgtgcagctcaaaggttcagtcaacgaagccgcttccatactgacatgatcatcaagcttaatcagcgagctttctttcgccaaatactgctcggcaaatgccccatcgtaagaaacccccgcttccgtccctagtttcttctcgcagtgattgggattacctgtctgacacattctgcaatgtccgcaggagtatgtcggattgataacaacacgatcgccaatctgaaagcgggtaacatgactgccgatttgcgtcaccactcccgtggtctcatgccccaatgtggttcccggcaccgctacaggataagaaccagtaataattcctatatctgtgccgcaaatcccacatactgcaatatcgactaccacatcatccggttcaatgcagtgcaagggttcaacttgctgaatctggacattccatacttggttgaatttcagggctttcattatgcaacctctctgtgcttcggtgcagaaaccgtcagttcagcgaatgccagatccaatttatggagaatttcatgtaagtgttcctgtgtacaaaccaaaggaggacgtaccttaagtgcccgccctttgccataacgggagccgcgcaggatcaatcggtgacggctggcggtttcaatcacctgtgccgcaaattctggggttggagtatcaaaaccgaacatgtagcccatgcctctgacccccgtgatttcagggtatttatgctgtaaggccaacagtccatcacgcaggaaagcctcgttctgctgcacattttccagaatcgcatcatcttcaataatatcaatgatttcgttgagagcgactaaagacaagggattagcaccagaagtactggaatgctcaaatgattccagcacatccagcgagctgcgcatcagcacaccccctgtcggaataccaataccccctgcccctttcgcaaatacaatgatatctggctctaattccttggcataacctgtcgacgcaaagaaagttccggtacggccaaaccctgtctgtatttcatccgcaataatgatgatgccgtgctgatggcagatttccctgattttgcgatagaactccacggggaaaacggtgttgccgccattgccctgaatcggttcaataatcagacatgcgatattgtcactggagcccaactgaataaactgttccagatcgacatattggttctctgtctcattcgggtcaggttctgccatgacactggcaggtgctggaatttttatcgaaccatcaatactgatatggaaatctttaattctgaacgcattgccagaaatctgcgcagtcgcaagagactggccgtggtgggcaagaaagaacgaaataatgccggagcgtcctgtggctttttgggcgatgcgaatggcaccttcaacagccccagaaccggaaacatcccgcagccacattcggtcaatgccttctggtgtatgtttcaccaatttggtcaaaatatattgtgacatttctcgcgtataagcagaacttaaatgcgtacatctatcaatctgttgcttgagtttttccgcaactctgtggttagtgtagccaagcggcaaattaaacgtacctgatgccgcatcaatatgcttttcgccatcaatttccaaataaggaccgtgaccaacaaaacgggaaagcatatcgtcaagatgttttctattttccataattactaaccaccattagttatttttaacaattatgagcgtaccaaatgtaatgagattagcttagacccatttaaacgtgacatccatcacataaaacccataaaaaaatataaggttattttaaaaattaatttatatttaaattgcatataacttagtgttaatatttatttatgttattagcgaaaacattactaaacttaaatattcattgatgcaacactcaaccccatcatttgcatcaaatgttgagcctgttgaatagcatcctgccgatgggtaatacccattttttgatacagattacggatatgcgtcttgatcgtggtcgcggcgacctccagttctgcggcaatttgatcgttactgtagccggaataaatcaaccccaatacctgccattcacgctgagtcagcgggctatttcggataagttccggtacatcagggtgtgtaagaagctgctcaacaaacgtttcatcaaaatgggcgaatttatgccgatgctggcgattaatttcccgcaggatacgctgggcacggtgttgctcaagttcaggcagaatattgagctgaataagctggcgcaattgttgagccatcaactcaccttcaagtacaaagtgactaataaatcccgtgcggttagccaaactcagggcttccatcaaaacagcctgtgcttcagccttgtacccaagctgccagtgcaacagattgcacagcagcaggttgcggttcaaatcgcttatcagcagcaattccctcgcgtacttattcagcgttcccaagatagattccgcttcctcatactgaccaagcaggatctgtgcacgggcgatattgcgccattgattctgattgaaatggttattgaaactttctggccgttccgcctgtaccaaccactgagtcgccgagctgctatcttccaaattctgccagataatgacgcgtagcttgtcggtattggttcgccagtcacgatgataatgcccgttattcaacagattttcgcagcgggacaggtaacggcgggcattatcaatatcccctcggatcaaggaacatttcgccagttgggttaggcattgtaattgctgctgaggctggacgctggataacacttccaggcctcgacgcgccgcttcttcagattcgtctatccgcgcccaacaccacaaaagctgtgagcgaatgcgcaacaggaattcgtgcatcggcaactgttccaaatgctgctcactaatcaaatcaaaagcgtgattttgaatttcataggccgcctgcaaatagccctgagccaataagatctcactttgctgcaacaacgcccacaaagcatagtgataaacatgacagcgtcgggcaagttgctccgtttgcttcatcagtgccaatgcatgggataattctcctttacaatgcagaacttcccctttcaccgacatcgcaacaatccggccatattcattgtcgggcaaaagggctgccagagccttctcagccagagtatcagcatcgtccggccggccatcattaatcgcaacttgggcacgcagggcatcaaattctgccagcaattccggctctataatgatttgtttctgcttcagcgactgttctgtctgattcaataaagcgttcacttcataataacgatgctggctctgtgccagccatgcctgtaacagtaccagacgcggattttccagtaattgctcatatggcaatgcattcatgcactcttccaatagtgacagtttgctgtggttaaacagatcccaagcatgttgcagcaaaatatcacgtaacagtacggtatctccggcagccagcgcatggtgaatggcttcccccggaaaaccctgcatcagccagccttctgccgcggctctgtgcaattctggcaatttcgctgccatctcccactggcatcgttgacgcaggaatgaggcaaacagaggatgaaaacagaaccattcgccagaatcatccatacgttggataaacagcccctgacgttcaatatcttcaaggcgttgctggccgttatcctctcccgtcagacaaacaatcagaccatcattcatcgaacgcaggatagaactgcgcagcaggaaatcccgcgtagcctgatccacacgatttaacacctcatccacaagataatctgcgagatggctggcattaatccctgaaaggcgttttgccgacatttccgccgtattgcctgattgacgggcagaaagagcaataagctgcaaggccgtcgcccaacccgcgacgtcattgcataactgtttgcaattatccgcatccagtgggctggccagtcttttatcaaaaaactgctgggtttcccgataatcgaaagccaattgctggctgtcgaactccaataactgttcacgcacacgtaggttagctacacccaacgatggcaaatgacgggatagtattgtcaaagtcagattttcaggctggtgacggaggaaaaagcgcatggcttcgtgaatgaggttattctctatcaggtgataatcatcaatcaccagaaagatcggctgtttccactcactaagttcaataaacaactgcgcaaataatgcgggtaaattggcatactgatgtttctgagccagcacgtcactttttacacaatgcccctgtgttgcctgctgaatagccgcgatcaggtagctggcaaaacgttccggctgattgtcactgtcatccagagaataccatcccagattactctgtccggcagcccattgtgacatcaatgtagttttgccataccctgcggggctggttatcaataccagacgatagtgctgtacttcactgagcagttctaacagacgctcacgcatgaccatattattaaggcgaagggggcgactgagtttcgatgggataagcattggtttcttcccttcataagcaatgaataaaactgataccaaaaccctgttcaatgttattgattcattttcaccactaacattcattaatgcccaaccaaatttagagaaacgtctgtcttttgcaaacaggttgattgatttcattgtgttaagttgcaccctgtcacattctttgcttgcaatttttcctgttcccaatgaaattgcgaaaagcctcgaaaaaacaggacaagtaggaaatttttcctatcaagttgttggtcaatttcttcagccacccgccttgctgtttatttaattacagccaatggctacgcccttgcactcctccctgtgaatatccccgtaggatgatgcctaccgcttcaagaatcttcagcatatcccgataaatcacctccatattttccttattcagtgacaggatgaagacttcatgcaacagcccaaattagatagagccgtctttcaggccgcgcttacacgccagtggcagcgctttggccttagttcagcacaggaaatgaccccacatcagtggtggcaggccatcagtgctgcactattagaattacttccctcttccagcccgaaccatggtcatcagttgcataactctaagcgtcatgtgaactatatttcgatggaatttctgataggccgtctgacagccaacaatttgctgaatcttggctggtatgacgatgttcaggcttatctggcagaggatgggctgactttgagtgatttacttgaacaagaagctgatcctgcattaggcaatggtggtctgggtcggctggcagcctgttttcttgactcaatggcaacgattgatcaacccgcaacaggctatggccttaattatcagtatggcctgttccggcaatcctttgatcaaggattacaaattgaggcacctgatgactggaagcaaggctcctatccgtggtttcgccataatgcccaattgaaagttgacgtgggttttggcgggaaaatcgtgatgacagacgaaggtcatgaaacttggcttcctgcctttaccttgattggcgaagcttgggatctgccggtcgttggctatggtaatggcgtcacacaacccctgcgcctgtggcaggcaacacacgataacccttttgatctgtcacttttcaatgacgggcagtttctgaatgctgaacaacaaggcatcgaagccaccagcctgaccaaagtgctttacccgaacgataaccatcaggacggaaaacgcctgcgcctgatgcagcaatatttccagtgtgcctgtgcggtggccgatattctgcgtcgtcatcagcaggcgggccgcaaggtggaagaattaccacgctacgaagttatccagcttaacgatacccacccgactatcgccgtccctgaaatgatgcgtctcctgctggatgagcacagattggattgggaaaccgcatgggaaattacggggcagactttcgcctatactaaccatactttactaccagaaggtttagagcgttgggatgagcatctagtcagtgaactattgccacgtcatcaccgcattattcaggaaatcaaccgtcgcttccagaaaaccgtggagcaaacctggcccggcaatcaacaggtgtgggaaaaattagccgttactcacggaaatcaggtaagaatggctaacctctgcgtagtggcctgttttgctgtcaacggtgtggcagcactgcattcatccctaatcgtgacggatctgtttccagagtattatcacttatggccgaaaaagttccataacgtaaccaatggcgtcacaccgcgtcgctggttaaaacagtgcaatccagcactctcctcactgattgaccaaaccttgaatcatgaatgggttaatgatcttgagagcctgaaacaactcgaaccttatgccaacgatacagctttctgcgaagcttatcgcagcatcaaacaggaaaataaaatccggttgtccaactacgtcaataaagtcatggggcttaagattgatccccacgccatttttgacgtgcagataaaacgtctgcatgagtacaagcgccaacatttgaacctgctgcatatcctctcactgtatcggcagattcaggaaaatccgtcactggatgtccacccccgcgtcttcctgtttggtgccaaagcagctccgggatactatctggcaaaaaatattatttcagccattaaccatgcggctgaaaagatcaatcatgatccgatcgtccgtgatcgtatcaaaattgcctttattcccgattacaacgtttccaccgcagaattgatgatcccagccgccgatgtctcagagcaaatttctaccgcaggtaaagaagcctccggtacaggcaacatgaaactggccttaaacggtgcactgaccatcggtacgttagatggcgccaatgttgaaatcgccgaacaagtcggcaatgatcatatttttatcttcgggaataatgttgaagaagcaaaagccttactgaaaagtggctacaatccacggcacatcctccagcagaaccctcatctacaaggcatactggatgcacttgccagtggtgaattcagccacggagacacacaagcattcaatctcatgctgcatagcttggttgatggcggtgatccttatttggtactggcggattttgactcctactgccaggcccataagcagattgataccctataccgtaatcctcaacactggacacacagtactattctcaatactgcccgcatgggtaaattcagttctgaccgagctattcaagattaccaacagcgtatctggcaggccaaataaggttcatcatggaaaataaacacctcgacaatttggcaacagaggctggcatagccgccgaatatattaatgcctacgggaaaccgcaggctatccctgccgaaattcggcatcggatattggcagccatgtatacagacccaccggccaataggccggtttctgatgcatctattcttaccctgcctgtggttaaagtgatgactcaaggtcagacaatcactttacctttgagcagtacagaaaattatcgatggcaaatacagacagagcaaggagagacatttcaaggggactgccaatatcaaatcactctgccgaccaacctccctctgggctatcacacactgacattaatgccagtaaaatcaatatcagtaacagaacctcatagccaacacccggttatgcagattattgtgacgccagaacgttgctacgagccagagacactgataaatggcgaaaaactctggggagcctgtatccagctctataccttgcgttcagaaaataactggggaatcggcgattttggcgatttgaaatatatgctgcaagaactgacgcaacggggtggcgcatttatcggcctgaatccacttcatgccatgtatccagccatgcctgaagacgccagtccctacagcccttcttcccgtcactggctcaatatcatttatattgatgtgaaccaagtagaagatttcacatacagtgtcgaagctcaaaaatggtggcgattgccggaaactcaactcaagctccagcatgtccgccaaacaggattagtcgattacaccagcgtgatgacattaaaaataacagcgctgcgtctggcttatcaacagtttcaaacccgatccgctacagatcccctgcatattgcttttcaacaatttgttaccaaaggtggtaaaagcctttattctcaagcagcctatgatgctctgcaccgtaaactctacgacgaagacagcgcttactggggctggccggtatggccagaaaaatatcgtgaacctgatagcgatacggtgaaagaattctgccagtcacattggccggaagtggagtttttcctctggttacaatggctggccgatacccaattagctggctgctttaccgaaagccagcacaatcatatgcccatcggcatttatcgtgacttggctgttggtgttgcacaaggcggctcagaaacatggtgcaaccgaacggtgtattgcaccaaggcatctattggcgcaccaccggacatactcggcccactcggacaaaactggggcttacctccgataaacccccatgtattacgagtccaagcctatcagccttttattgaattactgcgtagcaatatgcgccactgcggggcattacgtattgatcacgttatgtcactactcagactatggtggataccacaaggagaaactgccgataaaggggtttatgtccattatccagttgacgatttgctggcgatactggcgctggaaagccaacgccatcactgtatggtgattggcgaagatttagggatcgtgccagaagaaattgtcggcaaattacatacccgaggtgtctattcctataaggtgttctattttgaacgggatgggcacggagaattccgctcacccgatgagtaccccacgcaggcaatggcaaccattactacccatgatttacctacattacgcggattctggcaaaacaaggatttgatattgggggaatcgatcggcttatacccagataaaactctacttgatgggttatatgatgaacgtaagcgttgtaagcagaagttattggacggtctgaaccgccatggttattcatctgcatcactgagtatgacagacacgccagctccgatgtcagcctctatcaatcaaaacatacatcactacattgcccacagcaccagtgccttattgggattgcagcccgaagactggctagatatggaactccccgtcaatattccgggaacgtccacagagtatcccaactggcggcgcaaactaagcattacgctggaagctatgttccaagatgaacatatcaaccaattacttcaaacggtaggagagtaccgaaggtaaattccgtaatcacttaaaccaccatcgatagaacaactatcgatggtggtttagctttttaactgaacatcatcatcccttcacactccctgatgttagcccaccgactaaccagcgctgtgcaagcaggaacatcacggtgatagggattgcagaaagcaccgctgcggcagcaaaatccccccatagggagttttgtggatgaaggtactgttgcattcctactgccagagtataactgtctacatcccgcaacagcagtgacgccacaggaacttcggttatgacaccaataaaagacaggataaacaccaccgccagtattggtacggaaagcggtaataatatcaaacgaaaaacttgccacgatgtcgcaccatccaacattgcggcttcttccagagacccatctaacgtttcgaaataacctttgatcgtccatacatgcagtgcaatccctcccatataggcaaaaatcacactaccgtgagtattaagccccataaatggaatataggcacctaatcgatcaaaaagcgcatatagcgccaccagcgaaagtaccggagggaacatctggaaaatcaacatcccttttaacaaagtgcttttgccacgaaaacgcattcgagcaaaggcataagcacaggtcgttgacagagccacaatccccgtagccgtaatgaatgcaatttttactgaattccacagccattgtatgacggggaatggtgggggggtgatacgtccatctggggactctacgctataaccaagcgccagtttccagtgttcccatgaaattgtttcagggataagactacctgtggcaaaatttccaggtcgcaaagaaatagcaatcaccatcaacattggcaataaaatcaatgcaataaaagacagcattaacatatgtgttgcccctacccgccaccgttgtgattttggttgcaccatcgccattacccgttctcctcaatcaaatttaatacgagtcgctttcagattaatgatggctaatgccccgaccaaaagaaaaatcaacgtagcaatagccgcagccaaaccaaaatcctgtcctccgcccccttcaaaagcgatacgataagtataattcactaaaagatcggtataacccgcaggggttgttgtaccaatgcgatccggcctgccattggtcagcaactgaactaaaacaaagttattaaaattaaaagcgaaactggcaattatcaacggagtcagcggcttaatcagcaatggaaaagtaattctggaaaaattatgtaatggcccggccccatcaatagccgatgcctcataaagatcatcaggaattgacttcagcagccccatgcaaaggatcatcatatagggatatcccagccacgtattcactataatcaacatcgttcgcgccagtgttgggtcggtaaaccactccggtttcaaaccaaacagcccgttaagcagcaggttgatttccccaaaactctggttaaataaccccttaaaaatcaggatggaaataaacgaaggaacagcgtacggcaaaataagcagtacacgataaattgcccgtcctttgagcgcctcccactgcacaatacacgcaaggatcatacccagcgccaccgtcaatatcaccgttagcagggaaaagatcacagtccagacaaaaatcgaaagaaagggtttttggataccgtcatcctgaataacccgcaaaaagtttttccaaccgacagaaaccgtgaatcccgggcttaatgttccctcactccagacgccctcagcgttcgtggcttgatagaaccctgtatccatatttggtcggtattctgtccccgtttgattattggtcagggtgatgccgtcttccccaatggaatagaggggatgtatgccggagaattgacgcaatgaactcatacgtaacttactgccatccggcagaacagtaacaagctgacctaacgcctgccggtactgggttatggttcgcaatgcagcggcatcactctcaaaaaccttttcctgcttatgcaaaggcagaatgacctcttcccccgcagatgtagataaagaaaaaggatcagacaccagtaattgagagctatcaggaacactcaaggccagtacccactgttcagattcaggataaagtttgaaattaagtgtctgacctgcctgatattgacgactcatcaacaccgtttgagcccgttcaaaagtcagttgatttgtactgctatagttcgtgaaagcaatagcaacagtacaaataagtggaaacaatacaaacaggctcatgcccgcaattcccggataggtataacgccaagcataagacttacgattggcaaagacataaataccacttcccagtaataccagtgtcagcatggcaaacagatattcaccctgggcatacatcaatacaatcaaataaccggtaaaaaataggcacagactgactccgaaccattttaggacaggatgcgaccaccattctgttttgtccaatctcgctgacatcatgcacttcctgttactaagagcctatcccaatagacactaacgctccttctataccattcatctttcaaattgccgccaacaaagcggcaacttgaaatctattgggtataaaatcaggaacctgttattcgtttatttagctattcgattttctgcatcattaagcgcagcatcaatagattgccgaccattcactgcattaagaacagcactgcgcatggcataccaaaaactactcatttgcgaaacatttggcataatttcaccttgctgagcatttgccatcgtggcagcaatacgtggatctttcgcaaggatatcctgataagatttcagcgccacagcccccaacggtttgtccttatccacggttgccaagccttcgttggtcagcagataattttccagaaactccttcgccaattctttattaggactagctgcattgattccggcggttaagatgccaacaaacggtttagagggttttcctttaaaggttggtaataaagtaacaccataattgatcttacttttgtcgatattcgtccaagtccacgggccattgatggtcattgctgttttgcctttattgaaggcggcttcagcgatggagtaatcgatatcagcactcaaatgtttgtttttcaccaaatcaaccaagaattgcattcccgctttggaacccgcattattcacgccgctatctttggtgttataagcaccattctccactttgaaagcgtagcccccatcagcagcaatcagtggccaagtgaaataaggttcctgcaaattaaacatgattgcgcttttattctgctttttcagttcattatccagcgcagggatctcttcccatgtctttggcggagatttcactaaatctttattgtagataagagaaagcgcttcaactgcaatgggataaccaatcagtttgccatcataacgaaccgcatcccaggtaaaaggaaataacttgtccatgaacggttggtcaggtgtcacttcggccaataaaccagattgggcatagccaccaaaacgatcatgcgcccagaaaatgatatctggtccatcaccgttcgctgctatttgagaatatttttcttcgaatttatcgggatgctcaacagcaacaggaatgccagtttcttttgcaaatttctcaccaacctgtgccagcccgttgtatcccttatcaccgttgatccaaatcaccagcttgccttcttccagctttgcaaaagcaggggcagagagtatccatgttgttaaaacggaaagcatcagagcgcgagatcccactttcagagttgtttttgtcatcattccgtccttttcgtcgtttgcaggttcaagatgaatttctcgttacaccgctagaaaatggttcccagtgtgcaatcaacagaaagcaagctcatcctcccctgttctacgcctcaccacaaatgagtgtgaagttgattacaaaaatactgaaaatcagtatgttaaccttaaagagacatcgatttttgggattaaaatcacatcttgctcagtgatttttcacagaatatcccaatcacattaatctcatcctccttatgcctcccccataaaaaattatgggatggaggatttttattcctgttattttgcacacaattttgctaccagtttttcactaagttttttactacaaacataaaactagggtggcaactccgaggggaacacatgtccagcgtcacactccgcgatgtatctaagacttatggtgaaactgtcatttccaaaaacttcaaccttgagattgaagaaggggaatttgttgtttttgttggtccatcaggatgtggaaaatcaacactgttaaggatgattgcaggtctggaagacattacctccggtgatttactgatagcagggcagcgaatgaatgatgttcctcctgccaaacgcagtgtaggtatggtttttcaatcctacgcgctatacccccatttgtctgttgctgacaatatgtcattcggcatgaaactggccgggatcaaaaaaagcgatattcagaagcgagttcaacaagttgcagaaactcttcagctcgcccatctgttggatcgtcgccccaaagcactatctggagggcagcgtcagcgagttgccattggccgcactctggtcgctgaaccgaatatatttcttctggatgaaccactctccaatctggatgctgcgctgcgtgtccagatgcgcattgagatttcacgcctgcatcaacgcctgcaacgtacgatgatctatgttacgcatgatcaaaccgaagccatgactctggcggataaaatcgtcgttctggatgcaggcaacattgctcaggtcggtaagccactcgaaatttatcactaccctgccaaccgttttgttgcgggcttcatcggttccccaaagatgaatttcctaccagtcaaagtctctgccacagcaatcgatcaagtacagattattttgcctaacgggcagcctgtctggctacccgttgaaagtaaggatgtcactgtcggtagcaatgtatctctaggtatccgccccgaacacctgttgcctaatgatgtggccgacgtaacgctggaaggaacagtgcaaatcgtagagcaactggggaatgaaactcaggttcacatccgcatacctgcaattcaccaaaatttggtttaccgccagcctgatgttgttctcgtggaagaaggagcaaccttcactatcgggttagctccccatcgctgtcatctattccgcgaagatggcactgcatgtcagcgtttgcataaagagcccggagtctgaacccgtgccataaaaaataacaggagaatcattatgcgtatcttacctctttcattggccatactgactggtttgttatccatgcaggccactgcggtggagttccacggttatgcccgttctggcattggctgggcaggtaaaggaggagaacagaaatgtgtccaaagtaccggtgcacagagtaaataccgtctgggtaatgagtgtgaaacctatgcagaactaaaattagggcaagagttatggaaagagggtaacaagcgtttctattttgataccaatgtggcctattccgttgcacagaaagatgactgggaatcaaccaacccagctttccgcgaagtcaacgttcaggcaagtaacgtcattgactggctgcctggttcgacgctatgggcaggtaagcgtttctaccagcgacacgatgtgcatatgatcgatttttactactgggacatctccggccctggagcaggtctacaggatattgatttgggatttggtaaactttcccttgccgtgacccgcaatacggaatccggtggttcggttggctggatcgccgataaacgcgatgaaattccgacttccaatgatgttttcgacgtacgactggctaatttacaggtgaatgaaggcggcactctagagcttggcatcgactatggacgtgccaatgcacgcaagggttaccatctggatcaaaaagcatctaaagatggtgtaatgctgacagctgaacatactcaaagcatgttaggtggctttaataaatttgtcgtacagtacgccactgatgccatgacttcctacaatagtggtcattcagaaggtgccagcgtaaataatgatgggaatatgttacgcatcctgaatcatggtgctatcaatattacggataaatgggatctgatgtatttggccatgtatcagaatatagatcgcgataatcgcaacggcaacacatggtacaccgttggtgtccgcccaatgtacaaatggacgcccatcatgagtactttgctggaagtcggctatgataatgtgaaatctcaacgcaccaaagacaccaacaatcaatacaaaatcacgctggcacagcaatggcaggcaggtgacagtatctggtcacgcccagcaatccgtttgtttgcaacttatgccaaatgggatgaaaaatggggctatgcaaacaaaaatggcagttacacgaaaggtgttgcctacagtgattcgtcatcacatcgtttcagccgtggtaacagtgatgaattcacctttggcgcccaattcgaagcttggtggtaatggattcagacaaggctaatacaatgaaaataaaactgctttcagtttgtctcagtactctgctttgctatgcacttcccgcagcgagctatgcagcacctgatacagcaatgcctgacagttctgacaatatagttgtgcccgatagcaaactgcacaataccacagcacctgcgctgactatatcgtccttacagaaattaaagtggttgccagctaatactcatgccacacagactattatcctgaatagtgcatcatcccggattcatgaaggggatattcaaggagcggtagctgcatttgcattgccagccaatcagggtgcattagagatcaccctgaatagcctgataaaggataagcaggtttattcgcctaatgtgttagtacttgatgagcaattgcgccccgcagccttttacccaagtcattattttcaatatcaacgaccgggcatcatgtcagttgacaggcttgaagggacgttaaaattaacccccgcattagggcaacagcaaatttacctgctggtttataccacccgtgctgatttacagtcatctacacaaatggtcgatccagctaaagcctatgctcagggagtaggtaatgccgtacctaatattcctgatccgatggctcgccatacggaaacaggaatattaacgctaaaagtgaaatcagaacgcgatgccggtaatgtcctgattggtcaggccttctcagcaccagcgccaaaacctgtcatagtcggctccatgcaaacagcaacgacggccgttaccgcactacaacctgttgtgccggctattgcacccaaaaacaaaccagttctgggtgataccgaaaaatatttcaataacgccattaagaaagcgattaatgacggtgatattgataaagcactacatctgctggatgaggctgaacgcttgggatcagcaaccgcaagagatacctttatcaaaaggataaaaaatctcaaataggctcaatttattattggggttatagtaagaaatgaaatattcattttacaatctataatccctttattaaccagatactctattagaatttttgccaaaaaataaagagacagaataataaataaaaatatattgtaattccaaaaggataactacatatcattcaataattcatattccacatccgattattaataagttataaaagtatttcatcccattaattagcaattattttttccattttttcaatagaatcggttcgtaatatatataaacgcttcagtgaaaatgggttatctcccagttttactttaccctgtttggttgtgaccgctaaatgaaaccctgcatttcgggctgcatctatagcttgctggttatatccaccaaagggataagagagatagagaacatggggattgaattgtgataacgcacgacgagaacgttcaaaatcatatagaatagtgtggtatgaacggctgaataatattggtcctttgtttttccccagacgatgcaaaaagtgggtatgggactgaaaatcaaacacatcctttgtagcatataatgtagaaagactcataaattgcaggttttcagaattccattcctgcggataccgcttaattctggatgaaataataaaaagggtcgctttctgcccattctttttcaagattgggtaggcataacggtaaatggatttcaatccatcatcaaacgtcagaccaaccacttttgcaggtaagttgagagtcccgttcaggtaaccttccaactcatacaatgaaatcgtggtgtaacctgcctgtttcaaataatccatttgctcgcgaaaagccgataaagaggtcgttgttgaggtatggagaaaacgcttgttctctttatctttcagaatatggtgataagtcagcaaaggaataccatgatccaattcggcatcctgaccactaatgtaaccgacgcgaccccccagattcacttcataccacgtctgatatgagggatctttcagtttgtctaaaattggatagcggagattagcattcagaatcgcaatcgatgaactattaacttcaggcgtgctataaacccgaatatccttaaaaatcattaaattttcgctagtttttttatcaagagtagcgagcgaaccattgaaagatacagattgtttgacttcttttagattttctttatcaatatagccttgaccattaccaaaatgaaattcgtaatgatcgttctgcttgccttgttcctgagccgcttttagaaaatgacctttctttaataatccaacctgcacaatatgttcacctacccgagcatatatttcactgtctttagtcacctccatgtaacgatagtttgataaattgtggtgctgtgctaatacagaattggaaaagaaactaaaaaacagtaataaagcgacttcaataacatagacgatttgtctcattttattttccatccaataaaaaatgccctccaccaagagagggcattttatgattagcgatgtgtatagaagatgattctatacatcatgatactactctttatcgctgctgctaccgaaacctgcattcaacaattcagcaaggtttgcagtcgcttcatcaacactgactggtggcgcttcaaccacttcgtttgcgtgacgacggcggatgcgctcctgatggtacgcataacctgtacccgcagggatcagacgaccaacaatgacgttctctttcaggccacgcaattcatcacgtttacctgcaacagctgcttcagtcagtacgcgcgttgtttcctggaacgacgccgcagagatgaaggattctgttgccagtgatgccttggtgatacccaacaggtcacgatggaaggtagccgctaatttgccatccagttccagcttacggttcgcgactttaacacgcgcgtattcaacctgctcgccttcgaggaactcagaactacccgcattcgcgatagtcactttacgcagcatctgacgaacgataacttcgatgtgtttatcgttaatcttaacgccttgcagacggtaaacttcctgtacttcgttggtgatgtagcgggcaaccgcgtgaacgccacgcagacgcagaatatcgtgtggagattctgggccatcggagatcacgtcaccacgttcagcaacttcaccttcgaatacgttgagctgacgccatttagggatcatctcttcgtaagcatcactaccatccaatgggctgattaccagacgacgtttacctttggtttctttaccgaaggaaacaataccgctgatttctgccaggatcgcaggctctttcggacgacgtgcttcgaacagatccgcaacgcgtggcagaccaccggtgatatctttagtaccgccagattcctgaggaatacgcgccagcgtatcacccgcagagatagacatgccatcttccagctgaacaatcgctttacccggcaggaagtactgagcaggcatatcagtacctgagatcagaacatctttaccctgagcgtcaacgattttcagtgccggacgcaggtctttaccgctacctgtacgttctgcactgtccagaaccaccagtgatgacagaccggtcaattcgtccgtctgacgagtaatggtctggccatcaaccatgtcatagaactggatgataccggacacttcactcacgactggcatgatgtgtggatcccagttcgcaacggtttcgccgccagtcactgtctcgccatcacctttcgacaataccgagccgtaagggactttgtagctttctttggtacggccgaaatcatcaatcagacgcagttctgtattacgagaagtaataaccagtttgcctgctgagttagtgacgtatttcgcgttgaacagcttcagatgacctttgttacgtacctgaatgctggattctgctgccgcacgagatgccgcaccaccgatgtggaacgtacgcatcgtcaactgtgtacctggttcaccgattgactgtgccgcgataacaccaactgcttcacctttgttgatgatatgaccacgggcaaggtcacggccgtaacagtttgcacagacgccgaagtctgtctcacagcttactacggagcgtactttcacgctgtcaacggagctttcttctaacagatcacaccatttttcattcagtagagtgttacgtggaaccaaaatatccgctgtacctggttttaggacgtcttcagccgtcacacgacccagtacacgctcacgcagtggttctttaacatcaccaccttcgataaccggagtcatcaagataccgttgtgagtaccacagtcatcttcagtcacgaccaagtcttgagcaacgtcaaccagacgacgagtcaggtaaccggagttcgccgttttcaatgcggtatccgccaaacctttacgagcaccatgggttgagatgaagtactggagtacgttcaaaccttcacggaagttcgcggtgattggggtttcgatgatggaaccatctggtgttgccatcaggccacgcatacccgccagctgacggatctgagcggcagaaccacgagcaccggagtcagccatcataaagatgctattgaaagaaacttgctgttcttcttcgccatcacggttaataacagcttcagtagacaggttttccatcatcgccttggcaacacgttcgtttgccgcagcccagatatcgataactttgttatagcgttcgcccgcagttaccagacctgactggaactgttcctgaatttcggccacttccgcttccgcttctgcaatgatgccttctttcttctcaggaataaccatgtcatcaatacctacggatacccctgaacgggcagcgtaagcaaaaccggtatacatggtctggtcagctaagataacggttggtttcaggcccagaatgcggtaacaggtgttcagcatcttggagatagcttttttgcccaacgcctggttaatcagcgagtaaggcagaccacgcggtacaatcatccacaggatggcacgaccgacggtggtatccaccagacccgtattggtggtgacattgccttcaccatctctcacttcttcagtgatacgaactttgacacgggcgtgcagagaagccagaccggcgcgataaacgcgttcagcttctttaggaccggtcaaaaccatgccttcgcctttggcgttaacacagtcacgagtcatgtagtacagacccaatacaacgtcctgagagggaacgatgattggctcaccgctcgctggagacaggatgttgttggtagacatcatcagcgcacgcgcttctaactgggcttccagtgtcagcggtacgtgaacagccatctggtcaccatcgaagtcggcgttataggccgcacacaccagtgggtgcaactggattgccttaccttcgatcagaactggctcgaatgcctggatacccaaacggtgaagggtcggtgcacggttcagcagaactgggtgctcacggatcacttcatcaaggatatcccatacgaccgcttcttcacgctcaaccattttcttggcggctttgatagtcgtcgccagaccacgcagttccagcttgccgtagatgaatggcttgaacagctccaatgccatcttcttaggaagaccacactgatgcagacgcaggtatggccctacggtaattacagaacggcctgagtagtcaacacgtttacccagcaggttctgacggaaacgaccttgtttacccttgatcatgtctgccaaggatttcagaggacgcttgttagagccggtgatcgcacgaccgcgacggccgttatccagcagcgcatcaaccgcttcctgcaacatacgtttttcgttacgcacgatgatgtctggcgcagccagatccagcaggcgtttcagacggttattacggttaataacgcgacgatacaaatcgttcaagtctgaagttgcaaaacggccgccatccagtggaaccaatggacgcaaatccggtggcaaaactggcagaacggtcagaaccatccactctggcttgttgccagactgaatgaatgcttccaacagtttaatacgcttggtcagcttcttgcgtttagtttcagagttagtttcgttcaactcttcacgcaaggtttcacattcgttttccagatcaaggtttttcagcaaagcctggatcgcttctgcgcccatttttgcatcaaattcatcaccgaactcttccaatgcatccagatactgttcttctgtcaggatctgtgcacgctcaaggctggtcatgccgccttcaacaaccacataggattcgaagtacagtacgcgttcaatatcgcgcagtggcatatccagcagcaaaccgatgcgggatggcaaagatttcaggaaccagatatgagcggttggagatgccagctcgatatgacccatacggtcacgacgaactttagtctgggtcacttcgacgccacacttctcacaaatcacaccacggtgtttcaaacgcttgtatttaccacacaagcattcgtaatcttttactggcccgaagatacgtgcgcagaaaagaccgtcacgttcaggcttgaacgtacggtagttaatggtttccggcttttttacttccccgaatgaccacgaacggatcatatctggagaggccagagcaattttgatcgcatcaaactcttcggtcttagtttgcgctttcagaaacttcaataagtctttcacgaaatggctcctgtcggagttagacctgttaggtgagtggcccatgccactcccccctatgaccagtgtaaccactggctggtaaactgcccggcatattcataccggacagtaccagcgggaaaacgatttattcgtcttccagctcgatgttgatacccaacgaacggatctctttcagcaatacgttgaaagattccggcatgcctggctccatctggtggttaccatccacgatgtttttatacatcttggtacgaccgttaacatcatcggacttgacggtgagcatttcttgcagggtgtacgcagcaccgtatgcttccaatgcccacacttccatctcaccgaagcgctgaccaccgaactgtgctttaccacccagcggctgctgagtaaccaagctgtaagaaccggtagaacgggcatgcatcttgtcatcaaccaagtggttcagtttcagcatgtacatgtaaccgacagtaacctgacgctcaaactgctcaccagtgcggccgtcaaacagcgtgatctgaccggaagtcggcaagccagccagttgcaacagctctttgatttcagtctctttcgcaccgtcgaagaccggtgttgcgattggcataccttttttcaggttttcagccagacgcaaaacttcttcatcagtgaaagtattcaggtcaactttctgacgggtatcgtcaccaaggtcataggctttctggatgaattcacgcagtttggcaacttcctgctgttgttttagcatggcattgatcttgtcaccaatgcctttggccgccatacccaagtgagtttccagaatctgaccgatgttcatacgtgatggtacacccagcgggtttaatacgatgtctacaggtgttccgttttcatcgtaaggcatatcttcgatcgggttgatcttagagataacacccttgttaccatgacgaccagccatcttatcaccaggctggatctggcgtttaacagccagatatactttaacgattttcagcacacccggtgccagatcatcgccctgagtgatcttacggcgtttagcatccagttttttctcgaactcagttttcagttcgtcatactgttctgccagctgttccaactgattctgtttttcttcatcagccagacccagctctaaccagcgctcgcgcggcagtttacttaatttttctgcttcaactccaccggcaaccagtacggagtgaatacgcgcaaacagacccgcttcgaagatacgcagttcttctgtcaggtcttttttcgcctgacgcaactgcatttcttcgatttccaacgcacgcttgtctttttctacaccgtcacgggtaaagacctgcacgtcgataatagtaccggcaacaccgtttggcacacgcagtgaagagtctttaacgtcagatgctttctcaccgaagatcgcacgcaacagtttttcttctggcgttaattgggtttcacctttcggtgtcactttaccaaccagaatatcgccgcctttcacttccgcgccaatgtaaacgatgccggattcgtccagtttagacagtgcagcttcgcccacgttaggaatgtcagcagtgatctcttcaggccccagtttggtgtcacgagacacacaagccagttcctgaatgtgaatggttgtgaaacggtcttcctgaacaacacgctcagatacgagaatggagtcctcgaagttataaccattccatggcatgaacgccacgcgcatgttctgacccagcgccagttcacccaaatcagtggatgggccgtcagccagtacatcgccacgctctaccaattcacccagagaaacacatggcatctggttgatacaggtgttctggttggaacgcgtgtatttggtcaggttatagatatcgatgccagcttcacccgcgtacatttcgtcttcgttaactttaataacgatacgggatgcatccacgtactgaatcacaccaccacgcttggcgactgacgttacaccggagtcaacagcaactgcacgctccatgcctgtaccaaccagcggcttgtcagcacgcagagtcggaactgcctgacgttgcatgttcgcacccatcaatgcacggttggcgtcatcgtgttcaaggaatgggatcaaagaagcaccgacggacacgatctgctgtgtcgaaacgtccatatactgaacctgatcacggttgaacaagctggattcatcataatgacggcaagtcaccagatcttctacgaagtggccttcttcatccagcacggtgttagcctgtgcaatgacgtagttaccttcttctatagcagacagataatgaatttcatcggttactacgccgtcacgcaccaaacggtaaggggtttcaaggaaaccatactcattggtacgagcataaacggatagtgagttaatcagaccgatgtttggaccttcaggcgtttcgataggacatacacgaccgtagtgggttgggtgtacgtcacgtacttcgaagcctgcacgctcacgggtcagaccgcctgggcccaatgcagagatacgacgtttatgagtaatttcagacaacgggttgttctgatccataaactgggacaactgactggaaccaaagaactcttttaccgcagcagaaattggtttagcgttgatcatgtcctgtggcatcagggtatccagatcgcccagtgacagacgctctttcacagcacgttctacacgaactaagccaacgcggaactggttttctgccatttcgccaacagaacggatacgacggttacccaagtggtcgatatcgtccacttcgcctttaccgttacgaatatcgatgagcttcttcatcacatcggtgatgtcttctttgctcaggataccggaaccttcaatttctgtacgatccagagaacggttgaacttcatgcggccaaccgcagacagatcatagcggtcttcagagaagaacaggttctcaaacagattttctgcggcttcgcgtgttggtggctcacccggacgcatcatgcggtaaatttcaaccagcgcgctcagacgatcattggttgggtcaacacgcagagtttcggagatgtatgcaccgtgatccagatcgttggtaaacagagtctcgatggttttgtgaccagactggctcagacgcgccagcagatccagagagagctccatgttagcagcgcagaggatttcacccgtattttgatcgatgtaatcttttgcgacgactttacccgcgatatattcgacaggaacctcaatacggtctacctgatctttttctaactgacggatatgacgtgcggtgatacgacggcctttttcaacataaagtttgccgtttgcttcaatatcaaatgaagccgtttcaccacgcagacgttctggaaccagagtcatctgcaatttgttatcgcgaatttcgaagatcgttttgttgaagaacaggttcagaatgtcttcagtactataattcattgcacgcagaataatcgaagccggcagtttacgacggcggtcgatacgcacaaacagattatctttaggatcgaattcgaaatccagccatgaaccacggtaagggatgatacgcgcgttatacagtaccttaccggatgaatgggttttacccttatcgctgtcaaaaaaaacgcctgggctacgatgcaactgagatacgataacacgctcagtaccgttgataacgaaagtcccgttatcagtcatgagtggaatttcacccatgtagacttcttgttctttaatgtctttgactgtgccttctggcgcttcgcgctcatagatcaccagacgcagtttaacgcgcagcggtgcggaataagtcacaccacggatctgacactcttgcacatcaaaaacaggctcaccaagacggtagcttacatattgcagctcggaattgccgctgtaactctgaattgggaacacagaacggaaggccgcttccagtccattttggccttcaggatcttgctcgataaacttctggaacgagtcaagttggatagaaaggagatatggaatatccaaaacttgtggacgtttaccaaaatccttacgaatacgttttttctcggtataggagtaaaccatagggttcctcagctcgctgatcagtgacccactctgcccgccctttaggacagcactctgcaacactatttgttcgaacagaaaatagaatattttccgtaatactcattgctattactcttaaatcatttcattgcgctacctgactaccgagctacccgagtggatcgtagctgagaacgcagtatattaagtcgtcaataggaaagagtattttgggttgattagcagccaaacagtgtgaaatgctactaactccctacagcgcaaaaaggctggcgattaaaaatcgccagccatcagcctttaaagtcaggctgcaaacttaaaactgatcttacttgatctcaacagaagcaccagcttcttccagagattttttcagagcttcagcgtcgtctttgctgatgccttctttcagagcagctggtgcgctttcaaccaggtctttcgcttctttcagacccaggccagttgcgccacgtactgctttgattacagcaactttgttagcgccaatgctagacagaattacgtcgaattcagttttttcttcaacggcttcagcagcaccgccaacaacagctacagctgcagcagcagaaacgccgaatttttcttccatcatagtgatcagttcaacaacgtccattacagacatttctgcaactgcgtccagaatttgttctttagtgatagacataacaagtgttcctaaaattcagaaaaagtttatacgttaaaaagcaacgaaggaaataggctattaagcagcttctttctgatcgcgtagcgcagccagagtgcgaaccagtttgcctgcagaggcttctttcatggttgccatcaggcgtgcgattgcttcttcgtaagttgggagtgttgccaggcgatcgatattttcacctgaaataaactcaccttcaaaggctgctgctttaatctcgaatgctgggttcgctttcgcgaattctttgaacaaacgagcagctgcgcccggatgttcgctagagaaagcaatcaaggttggaccaacaaacgcttctttcaggcactcataatccgtaccttcaacagcacgacgcatcagggtgttacgaacaacacgcatgtaaacgccagcttcgcgacctgctttacgcagttcagtcattttacctacggtaacgccgcgagaatccgcaacaaccgcagacagcgcgcctttggctacttcgctgacttcagcaacaatcgcttgtttgtcttgaagatttagtgccattagcttcttgctcctggattaaccgggaaaacccgggactcacttcactcaaagcaccaagcgtgcctgagcgctgaaacacggtgagcagaatccagaaaataaatttcatttggctctgtcaccgtctacgcaggatattaagtaatcacttacgcctgcggtcttggacggggcttggattaggccaagctccaaccgaaaactgttttctacctaatataggttttatataacgacttatattagttgttatatacaatataaggcaaattttaagcgtcagattttagacaaatctgacgctaaggtaaagcgttattcactttcagcctaaattaggctgttgcgttcagaccagactggtcgatcgcaacacctgcacccatggtggtagacaggctaactttcttgatgaaaatacctttagctgaagatggttttgcttttttcagcgcaactaccaaggcttccaggttttctttcagtttgtcagcgtcaaagtcaactttaccgatggtggtgtgaatgatgccgtttttgtcgttacggtaacgaacctgacctgctttagcattctgtacagcttcagcgacgttaggagttacagtacccactttcgggtttggcatcaggccgcgaggacccagaatttgacccagttggccaacaacgcgcattgcatctggagatgcgataactacgtcgaaattcatctcgcctttcttaatctgatcagccagatcgtccatacctaccagttcagcgccagcagctttagccgcttcagcgtttgcgccctgagcaaatacagcaacacgtactgaacgaccagtaccgtgtggcagaacagttgcgccacgaacgttttggtcagatttacgagcatcgataccaagattaacagctacgtcaacgctttctacgaatttggcagttgccaattctttcagcagagcaacagcttcgttgatgtcatattgtttagttgcatcaactttaccacggatagtgcgcatgcgcttggtcagtttagccattgattaaccctccactaccaggcccatggaacgagcagtaccttcgattgaacgcatcatcgcgtcaacgtcagcaccagtcatgtccgcagctttagtttccgcgatttcgcggatctgtgcgctggttactttaccaactttttctttgtttggtttaccagaacccgatttaacgccagctgcttttttcagcagaacagcagctggtggggttttggtaacgaaagtgaaagaacggtctgcgtaaacagtaataacaactggaattggcaggcctttttcaatgctttcagttttcgcattgaacgctttacagaattccatgatgttaacaccctgctgacccagagctggaccaactggtgggcttgggttagccatacccgctgcaacttgcagcttaacgtaggcttgtactttcttagccatctatatttcctctatatgggtattatcgcctcaaaaagaggctcccctaacgattcaggccccgtctaaaagaccaggccactaaaaacaatacttaaaaataaaaggcgcgaaattgtatgataatttcacaccctttgcaagccaggctgctcaattaagcatcagattaggctttctctacctgactgaaatccaactcgactggcgtagcacggccaaagatagaaaccgaaactttcaagcggctcttttcgtaatcgacttcttccactacgccattgaaatctgcaaacgggccatcgctgacacgaaccatttcgcctggctcgaacaaggtttttggccgtggtttatcaccaacctgctgaagacgatccataatagcatcgacttctttatcactgatcggagccggacggtcagatgtaccaccgataaaacccattacgcgcggtacactacgaaccagatgccaagttgcatcgttcattaccatttgtaccaagacataacctgggaagaatttgcgctcgctcttacggcgttggccactgcggatctcaacaacttcttctgtcggcaccataacttcgccgaaagaatcttccataccatctaatttgatatgttcacgcagagattgagcaacacgaccttcgaacccagaaaatgcctgtatgacataccaacgcttttttggggattcagacattttttaaaacctcaggcctgtaataaatgaaactaaacgcaccagtataccatccagcccccacaaaatcagagacatgacagctgtcaccgctgcaacaatcaatgttgtgtgcagagcttcttggcgtgttggccaaatgactttacgcatttcaacgcgggcttcacgggcaaatgctaatgtggctttacctttcgcagtccagaatgcaactgctcctgcaagagcaacaatagccacgacggctatcgcgcgcagagccaggttatactcccggtaataataattacccacaatagcaactactagcagcacagccaccagtaaccattttgctatatcaagaccacgcctgctttcttgagcattgctattcgcactcataaaccaacctgtaactatgatgtaaatagatagccagcttgcctcgcaagagcaaaacaaatcagaccgaacccaaagataattgtaattgtatctgacttggcaccataattcagtaggacttttcgtatctgcatgataacaaagcccatccgttgtatcagagcctatctcaccaataattcgctacaaccattgagtaatgatccattcattatcagacaactattgatgagataggttcttcttaagacaacgtataaaaagggcatctgtcgatgcccttccagaatgaacacataaaaaaaattatgcaatcactttagcaacaacaccagcacctacagtacggccaccttcacggattgcgaaacgcagaccttcgtccattgcgattggagcaatcagggtaacgatcatgttgatgttgtcacctggcattaccatctcaacgccttctggcagttcgatagttccggttacgtcagttgtacggaagtagaactgaggacggtaacctttgaagaatggagtatgacggccaccttcatctttgctcagaatataaacttctgattcgaattgagtgtgcggctggattgaacctggtttagccagtacctgaccacgttggatttcgtcacgcttagtaccacgcagcagaacacctacgttctcaccagcacggccttcgtccagcaatttgcggaacatttcaacgccagtacaagttgttttcactgtatctgtgataccaacgattgaaacttcgtcacccactttaacgataccacgctctacacgaccagtaactacagtaccacggccagagatggagaatacgtcttcgattggcagcaggaatggcttgtcaatgtcacgctctggctctgggatgtaggaatccagtgcatctgccagttcgataattttcgcttcccactctgcttcaccttccaacgctttcagagcagaaccacggatgattggcgtatcatcgcctgggaaatcgtactgagacagcagctcacggacttccatttcaaccagttccagcagctcttcatcatcaaccatgtcacatttgttcaggaacacgatgatgtatggaacgcctacctgacgacccagcaggatgtgctcacgagtctgtggcattgggccatcagttgcagcaacaaccagaactgcgccatccatctgagcagcacccgtgatcatgtttttaacatagtcggcgtggcctgggcagtcaacgtgcgcatagtggcgagttggggtatcgtattctacgtgagaagtagaaatggtgataccacgcgctttttcttctggtgcattatcgatctgatcgaatgcacgagcgctaccgccgtaagttttcgccagaacagtggtgattgctgcagtcagggtagttttaccgtggtcaacgtggccgatagtaccaacgttaacgtgcggttttttacgttcaaacttttctttagacacgactctattccttaatatcgctccctcatcacgaaaataagggagccaaaagatagtaaacccgaaaacttatctagctttacgagtttcgataatagcctgagcgacgttgctaggcgcttcgttgtacttcaagaactccatggagtaagaagcacgaccttgggtctgagaacgcaggtcagtagcataaccaaacatttcagataatggtacttgagcacgaacaattttgcccgttgctagatcatccataccttcgatcataccacggcgacggttcaagtcaccgatgacgtcgcccatgtagtcttctggtgtttccacttcaactttcatgattggttccagcagaactggtttcgctttcatgaagccttctttaaatgccatggatgcagcaattttaaaggcgatttccgaggagtcaacgtcatggtaagaaccatcaaacagggtaactttaacgtcaacaattggataaccagccagaacaccgcctttcagctgttcacgaacgcctttatctacgcctggaatatattctttaggaacaacaccaccgacgattgcgttctcgaacacgtaaccttcgccacctggttccagaggctcaacacgtatccaaacgtgaccatactgaccacgaccacctgactgcttagcgtgtttaccttcctgctcaacagtatttcggatagtttcacggtaagcaacctgaggtttacctacgttcgcttcaacgttaaattcgcgacgcatacggtcaaccagaacatcaaggtgcagttcgcccatacccgcgataatagtctgaccagtttcttcgtcactggttacgcggaatgatgggtcttcctgagccagacggcctaaagcgatacccattttttcttggtcagctttagtttttggttcgatggcaacagagataactggttctgggaattccatacgctccagaatgatcggagagttcaggtcacagagagtatcacctgtagtgacatctttcagaccgatcgcagcagcgatatcgcctgcgcggacttctttgatttcttcacgtttgttagcatgcatctgaacgatacggccaaaacgttctttccggtctttcactgggttaagtactgtatcaccagagttaacaataccagagtaaacacggaagaaagtcaggttacccacgaatgggtcagtcgcgattttgaacgccagtgccgagaaaggttcttcatcgctggaatgacgctctgccggggtatctttaccgtctggcagcatgcctttgatagactcaacgtcagttggcgctggcaggtaatcgataactgcatccagcatcgcctgaacacctttgttcttaaatgcagaaccacaggtaaccaggataatctcgctagccagaacgcgcttacgcaaagctgatttgatttcttcttcagtcagctcttcaccacccagatatttgtccatcagttcttctgatgcttctgcagcggattcgatcaagttctggtgccattcctgagccagctcaaccatgtcagcagggatctcttcgtactcgaaagtcacgccctgatctgcttcactccagttgatcgctttcattttcaacaggtcaacaacgccggtgaaggtatcttcagcgccgattgccagttgaagtggaacaggggtcgcagccaaacgggttttgatctgttctactacgcgcaggaagtttgcccccatacggtccattttgttaacgaacgcgatacgtggaacattgtatttgttagcctgacgccatacagtctcagactgcggctgaacaccaccaactgcacagtaaaccattactgcgccgtcaagaactcgcatggaacgttctacttcgatagtgaagtcaacgtggcctggggtgtcgatgatattgacgcggtgtggctcatactgtttagccataccagaccagaatgcagttgtcgcagcagacgtgattgtgataccacgctcctgctcctgctccatccagtccattgtcgctgaaccttcgtgagtctcaccaattttatggttcacgcctgtgtaaaacaggatacgttcagttgtcgtggttttaccggcgtcgatgtgagcactgataccgatattacggtaacgtgctataggtgttttacgagccatgttttcctctctcgtgggcgttcaattttgagaacgggtagccccgagaagctacccagaacatattcactacgaaggaattaccaacggtagtgtgcgaacgccttgttagcttctgccatacggtgaacgtcttcacgtttcttaacagcagtgcctttgttttcagccgcatcagataattcattcgccaggcgcagagccatcgacttatcaccgcgtttacgagcagcatcaacgatccaacgcattgccagagcattacgacgaaccggacgaacttcaactggaacctgataggtagaaccaccaacacggcgggacttaacttcgacagtcgggcgcacgttatccagcgccagctcgaatgcttccagatgacctttactagaacgctgagccagggtctcgagcgcactgtatacaattgcttctgcggtagattttttaccgtctaccatcaggatattcacgaatttggccagcaattcagatccgaactttggatctggcagaattttacgttgaccaattacacgacgacgtggcatggaaatactccgtttcgaatttcagggttgtccaaaactctatgagtttattttgacattaaagtgaaaaatgtttggccttacttaacggagaaccattaagcctttggcttcttcacaccgtacttagaacgaccttgcttacggtctttaacaccggaacagtccagtgcaccgcgaacagtgtggtaacgcacacctggcaagtcttttacacgaccgccacggatcaggataacggagtgttcctgcaagttgtggccttcaccaccgatgtaggaagaaacttcgaaaccgttagtcaaacgaacacggcatactttacgcaatgctgagtttggttttttaggggtggtagtatatacacgagtacatacgccacgtttctgcgggcaagcttccagagcaggaacgttgcttttcacaactttcgagctacgagatttgcgaaccagctggttaatagttgccattattaaaaaaactcctggtttttttgcttcgtaaacacggattttatcctctgtcagccatcatgacaaaacatgaggacgcggaattttattgctgacttgacgaggtgtcaagaaatatacagcttttctatgctggtaaaatacctgcaatgacaaggtatttactgacaaagttcagataatgtctaccagccaaaattttgcggatgtttcgctgttaagctaacaaagcctttgtagtctatcacctgtacacggtctgaaatctgctcaacaagcccccgtgcagtcagatcttcctgcaaagcataaacaccggctcccgtacggatcaattcagccagatagcgattgtcattgatccccagcagcacgccattttgcattaacagaacatcatctgcatcagaaacaaggctcagcattgcattgaaatcatcatggtaaggtgagcgactcacagtatataacatgttacccctccgcaatagattaaaatttcaacacaacatcatattctgatagtacttcacgtattgcagccgccgggagaaattccgcctccagcacaagatcgcttgctgggctgcctccccgagcgttcaaatcatcgaggcaaatgtagcatttatcaatgtcatacaggggcagtatcttaaatgttgagatgtaatcacgcgccagaattgtctctggctgctgattggtcaacagttggaacacgccatcagaaataaagaatacaccgattttctcagtcaatgccgatgttgcaagcagcgcatccagcccttccctgccagcagaagatccgtggggagcttcagtaaaaacgaaggcgatttttttcatcagaaccctcaatactaggtatgctcctaaaactgtaccacgcgatcacacagcatcatggcttcggccaacgagcccaatccactaagctcaaacccatccgccagattcgcggcagacagattgagttcgttggcctgctgttcatcagcgacaccgcgacgcaatgccgcagcaacacaaataaacaagttgcattggtgctgggtagccattgcctgccacgccctgaccagatcgaactcatcactggcgggagccaccagtcgattgccattttggacaccttcgcgataaaaaaacacgctgtgcagtttatggtctgaagcaaccagcgcctgagcaaattgataggcactgctggcttgctgagtaccataagccggtccagttaccaacaggcaataagacagcgatgacattatttctccgaacttgcgtattcaccatttttaaactggcgaatataaaggtatacggtatgtttagaaatattcagacgatcagcaacctgattaatcgcatctttaatatcaaaaatccctttctcatagagattcaggacaacctgtctgtttttcgcattattggaaacattgcgatcagcgtttacttcttcgatagtaaattccagtgtctgtgccacaagatcatctactgaagaggcaaaattaacgtttgaagacacctcatgcgttttttcaggaataaaggtttgaataatctcagagaaaggcacatccaggttcatattaatacacaaaagcccaatgacccgacgagagcgattacgaatggcaatcgtgacggatttcatcaatgcaccgctttttgcccgcgtgaaatacgctctggaaacattacagtcttcatctgtaatatcgtgcagcatccgtaatgccaaatccgtaatgggagagccaattttacggccggtatgctcaccattagctattctgacagctgaacatttaagatcctccagtgaatgaagaacaatttcacaatgcccaccaatcagcatagccaaaccatcaacagcagcttcgtaagattttaaaatttcatgatccgtttcactgaacggttggttttccagtaaatcaatatcactgttatcaccggataatagtggggtagacatgcaatacaccatccttcaagctcagactttgcctcaccgaaaatatcagggcgagatttattataaaatcacattaatgcaacttaacagaaaacattttaaatgttctgtgttctattcagaataatgacgttaaaaccacattgaattgccgtcaagcccttgctgcacagaccgcagagttttatcacagcttttatactcaatatacctgaaatatgaaaaagttatttcatttaataccgttaaaaaataataaatagctaaaattatttttctgtcgtcatggtttattacttaccaagtcgagataaataccgagataacaaaacaggggctatctgatcagcccctgctatcacattacgtctaattattgtggaaattattttgccttggcagccggcttgatatccagcaattcaatatcaaagactaaagtagaattagtagggatactaggaagacttgtcttaccataagccaaatccggtggaatgaccagagtgattttcccgccttttttcacatgctgtaaaccttctttccagccgggaataatacgatccaaaccaattgtcaggggttctttgcgctcataggagctgtcgaacaccttgccatcgatcaaacttcctttgtagtttacaaccaccgtatctttttccgttggtgttttaccactcccttccttctctattttatagagaagcccggttttagtttttacaacccccgatgtcttggcaaactgctgactgtatttagtccctttttcagcattttcatcggcttctttctctgccttggcctgtgctgcacttttcactttagcttcaaaagtgccaaggatctgctgaatttcttgatcattcagtttgcttttatcctttaatgcatcttcaacaccagccaataactgagactgatctaacttaataccgagcgattcctgctcttttaacgaagcgcccatgtagcggcccagagaagaacccaatgcataagcgttttgctgattttctgttttaaacgcactattcagttttacttcgttttctgtattagcagacaatgcctgcggtacactaaatgccatcgccagtgacgctgccaataaagttgtttttaacaatgatttcatcctattctccaatcagttttttgggattcaccgtccgcaaagctacgtgaacgaactcactataactgtctgcggaaaccgaacacaatactcgtcatacattggcttcagaaccattaaaacaaaaaggtttcatggcaaccctcttttatagaatgttttgagtattatagtgccaatttgattaaaataatcattccgacacgaaattaactaaccaaagataagagggaagatagtgttattatccgaatttgaacaaaaatttgaacagttagaaaccaaactggcctaccaggaagtcactattgaagaactaaataaagaagtgagaaaacagcagatagaaactgaaaagctcaaaaaacaactacagttaatgtccgaacgcctgaaaacccaccagtcgtcgatcatcgcgccactctcagaagaaacaccgccccctcattactaatactgttcccgccttttcaggcagaaaaatacttgccaaggaaggcgggaacacaaaaaagagaagctcatctgcgcttccctttttctgcttaacgattaatggcagccgccgccacagcatgcatgttcttcatgatcatgatcgtggtcgtgatcaccacagccaccctgaccatgcacatggccgtgagccaattcttcttcggtcgcttcacggacagcaacgatttcaacgttgaatttcagattctgtccagccagcatgtggttgccgtcaacgacaacttcatcaccttccagagcggtaatttcaactggcacaggtcccatgtctgtatcagccaggaaacgcatacccacctgcaattcatcaacaccaacaaaaacatcttttggtacacgttgaactaaattttcatcatactgaccgtacgcatcatttgcttcgacgctaacatcaaaccgttcacccgcctcacgcccttccaccgctttctctaaaccgctgatcagagaaccacggccatgcagatagtctaacggtgcgctcaccggagactcatcaaccaaaacaccctcttctgttcttacttgataagccaggctgaccaccaagtcttgtgctactttcatgacatctcctacatacccgaggggaaaaaaccccgtgagggaaaatttttacggctaaaaaaatgctgctgattgtaacggaattctacttatctgtacctagcgacagcaaaatttatccattatttgttgttcatatatttaattattgtggtgtgaagataccgataacctgttcctgctctctaacatgaggcgccacggtttcatcggtttgccgctgcacatgcccacaatgaacacactccacaatatcgactttattttcctgccacatcgccagtgtgtcccgcgactgacacttgggacaaaccgctcctgcaataaaacgtttacgactgattgacatgactcacccccattgctatttatattcgtcccagccttccggccggcgacgctcattaagcatttcccgttcaaacagttcttccaattccctgcgggcttctttcacacgggatatctgcgccacatcgccatgtaactgaggcatcagctcacgcaacatacgcatatccagtcgtcggaaatgctgctgtgcacgataagcctgatgtggatgcattccagtcttaatcaatgccttacgaccaagctccagggcactggaaaacgtttcacggctgaaatctttgacatcgttctgcaacagctcatgagcttccagacgccctctcgcccgcgcaataatatgcagctgaggaaaatgcttctgacacagatgtactatcgccatggtttcttccggttcatcactggcaatcacgatagcctcggcgtttgccgctcccgcagcacgcagcagttcccgctctctcgcatcgccataatacaccttatagccataacgacgcagcgtactgatggcgctggcatcacgttccaataccgtgatccggattttattcgccatcagaaggcgccccactacctgcccaaaacggccgaatcccaccagaatcacttgcggctcattatcctccacaaatggctgttcactgcttttttcttcctgagcattataatgccgagccaaaatactttggatcaactgcatcaccagaggcgtcgtcatcatcgacaatgtgacgacaaccagcaaaagtgacatttgattctgatccagcactctctgccccagtgccgttgagaataaaacaaatgcaaattccccgccctgactcagcacgccggaaaactgaaaacacgatgcttttttcagaccagcaaacctgccgatcacatacagtatgaaagtttttatcagaaccagccccaaaacactgaacaatacccctgacaaatgagtcaacaatacgcccatattcaaggacattccgacggaaataaaaaatagccccagcagcagccctttaaatggctcaatagaaatttccagctcatggcgatattcactgtcagccaacaaaaccccagcaataaaagtcccgagcgccattgaaaaacccagttcctccatgaaaatcgctgctcccagcaccaccaacagcgctgctgccgtgaacacctccctgacaccagatttcactactaaccgaaacagtgggcgcagcagataacgccctcccagcaacatgcccgcaaaagcaacaaatttcagcccgacccgataccagtcactcgatgccgtactgccagccagcagagggatcagagccagagaggggatcaaagctatatcctgaaacaacagaatagaaaaaccgagttgcccgccttcactatcggtcattcctttctcttccatcaactgtagcgccatggctgtcgatgacatagcaaggcctattccaccgataacggcagcctgccatgcaaaattcgtcagacacaggaataaaatcagcaccagcgcagtcaatacaacctgagcagtacccgcaccaaagatagatcgcctgagctgccagagttttgccggattcagctcaaggccaatgataaacatcaggaaaacaacacccagttcagagaaatgcagaatttcctcgacatccttgataaaccccagcccccacgggccaagcacaatcccgacgatcagataacctaataccgccccaatcttgaatttctgggcaaggggaacagccacaacagcagcagacaaaaacagtgttccggcgcttaacagcgctgaattctccataattacattcctcccaaagacaaaggcgatttcagccatttccgataagccttcgcgtgactggcgagcacttcaggtcgttggcgcctggcccaataaatgatcatgggtgataaccaatgcatatgacacatcgatgccgttaattcgaaaggacggagaatttcttccatcggatagaggttatacccacctttccggtaagcgccttcgggttctcctgtggtgatgacagagcgccaatatttacctgtcagcgccaactctgatccgctaacaaagtcacggctcaacacacgatccatccactctttcagtaaagcagggcaactataagtatataatggatgctgaaaaacaatgatttcatgctcacgcagcaatttctgctctaacggcacatcaataaaaaaatcgggatagcagccgtataggtcgtgaagagtaacatgctccaacgcccgcacgggctgtagcaaaacattattagccacagagatctgtggttctggatggatatataacagcaatattttaggcggcaatagcatcattcccccgggacgtgtcaggacacctcttttccgctaccatgcatatcaggcgatcaaatcgaatacatacaacgtgtaattattaacttaacatactctataacagacaacctctatgattgttttctcatctctgcaaatccgtcgcggcattcgcgtcctactggacaatgccagcgcaaccatcaatcccggtcaaaaagtgggattggtgggtaaaaatggctgtggtaaatctaccctgctttcattactgaaaggtgaactccagtctgaaaatggctccgtcacatttcccaacaactgggcgctggcgtgggtgaatcaagaaacgccggctttggaaatttcagcactggaatatgtgatagacggtgaccgtgaattccgacaactcgaacagaagctgaaaatcgccaatgaacagaatgacggtcacgccattgcccatcttcacggccagcttgataccattcaggcatggacaattcgtgcacgagcatccagcctgctgcatggcctgggattttcccaaaccaagttagaacagtcagtcagttcattttccggtggctggcgtatgcggctcaatctggctcaagcgctgatttgtcgttccgacctgctgctgctcgatgaaccgaccaaccacctggatttagacgcggtcatctggctcgaaaagtggttgaaaaactataccggcactttgattctgatatctcacgatcgggactttctcgatccgatcattgataaaatcctgcacattgaacagctgatcttggctgaatacaccggcaactactcctcctttgagcggcaacgcgcggctaaacttgcccagcaacaggctctgtatcaaagccagcaggaaaaagttactcacctgcaaagctacattgaccgttttcgtgccaaagcctccaaagcgaagcaggcacaaagccgtatcaaaatgctggagcgcatggaactcatcgcgcctgctcatgtcgataacccatttcgtttcagctttcgccagccagacagcctgccaagcccgcttttggtcatggaaaaagtcagtgccggatatggtgaaaaaaccgtgctagattcgataaaattaaatctcgtaccgggatcacgtatcggcctgttagggcgcaacggggcgggtaaatctacactgatcaaacttctggcgggtggacttgccccacagcggggcgagatcgccttagccaaaggtatcaaactcgggtatttcgcccaacatcagctggaatacctacgagcagatgaatccccgctgcaacatttggtcagaatcgcaccacaggaaacagaacagcagctccgtgactatctgggtggctttggcttcaaaggtgatcaagtaaccgatccgagtgggcgtttttccggtggagaaaaagcccggctggtattagcgctgattgtctggcaacgaccgaaccttctactgcttgatgaaccgaccaaccaccttgatctggatatgagacaggcgctgactgaagcgttaattgatttcgacggtgcgctggttgtggtatcgcacgacagacatttattacgctccacaaccgatgaactttatctggtacatgatggcgaagtagaaccgttcaccggcgatttggaagactaccagcaatggctgactgaacaacaacgccaacaaacgcgggaaaatcaggaaaaggaaaaagcgacctcaagtcctgatgcttcaatgaatggcgctcaaaattacagtgctcaggagcgcaaagatcaaaaacggcgtgaggctgaatttcgcaaccagacgcagccattacgcaagcaacttactgcccttgaaaaacagatggaaaaattgggcgcaacattggccggatgggaagaaaagctgtcagataacacaatctacgaaaatgatcgcaaaactgaattaaccgaatgcctgcaacaacagactcaaaccaaatccaagttagaagatgtggaaatggagtggctggatattcaggaacaacttgaacagatgagcgaaacatttaacgtgaatcagtaaattaatttattttatttaacttttggaaatgattgggcattgatattcaatgcccaaatcttgaaaaaagctggcccttgtttacaaaacaaaaaagtaaacacatgcagacgaacagctattctattgacagtaaaaaatgataactcatttatctagaaaggttatttacacttgaaaaacacctgagcgtctaattagcatttcagactccttattaagaataatcttaccactcaactcccaaatatcatttccgtaaaaaatttcataacaacaatcgagagaaaaacgatcaatagtaaaacgatgccttactaactgacttacttggattcacatattaagcgcaacaccgtaatggacgaagtaaatgagagggtattcctttaaataactcattcggtgttttgtaatctcgtgttttacgaggacgattatttaatcggtttgccacaaggttaatctcccgctctgacaccttattaaaatcagttccttttgggaagtaatctctgattaatccattcgtgttctcatttatccctctttcccagggggaatacgggtgagcaaaataaatttttgtctctaaatttttactgatcagttcgtgttcggcaaattcgaggccgttatcaaaggtcattgttttaattttatgttttatcagtgataaatgtcttgttgccgcttttgcgaccccttctgctgttttattttcaagtttaattataatagtaaataacgattttcgttcaactaatgtcaataatgcacttttatgatttttacccacgatagtatctccttcccaatcaccaatacgctgctttttatcaacaagtttggggcgcttatcaatactgactctgtttttaatttttcctctgcgctcataacttccatagcgtttacgatacggttttttcgcaatcctaagatgttgccataaattaccatcattaagtttatccttataaatcaatcgataaactgtttcatgatgcaaagatattatattttcccttttgagataaccgactgtttgttcaggacttaaatcttaccaaattaactgtttgatccacatttctatctctggtttcacttttactgcttttgtagcacactgtcggcgcgctacggccttaagctgagcttgttcaggcgtatatttctttgcctcccgatttgtctcaattcccggctaatcgttgatgggtttcgattgagtgactttgaaatctcccgttgtgaaaaaccggcttctttcaggctgaaaatctgatatctttctgtttcggtcagttgtttataggccatagcgcattttcctttggcaagaaagatgcctactatagcaactgaccgcctttcttagaaattgcacttattatgcgaatccaagttacaaattagcaaccaatgcagaaaaactttcaacatcatcaatcagatgatcatctattgatttaccccatattacgccgagttctatttttttatccgtttcaacaatttccagcaaattcatataatactcagggatcgagctgataatacgttgaggaacacacgcatatgcactattttttgtaatcatttccatgatgagcataatgtcattagtctttaataacaaatgcttactgtcacccgtataaacagggaatacgttaaggcaatcggttaactcaacaatatcttttttttctgatgaataaaccggaacattcccatttccaaattgacttttctccgttctaaatttaggtatcaggtggctccttcttttaaaaatatagatcaatttttcagtaaaaatctttttcggctccaactgagttatcgcaaccagaggcatcaccgcgacatgtagcattcctgcattcaacaaactgatctgctgttcaaccgacagcccggtcatcagcgccaatatgacattccctttcttatccgcgatctgcttttctatctgagaatagttatggataggaaaacaagatccaacatataaatgcctgataatatcttcctttgaatcaaaatgaactctgcttttaaactgctcatagtgagataaaaattttcgggcattctccagcgtcttatgcccgaagtctgtcaatctcgttccatttggcccccttatgaataatgaagcaccaagaatatcttccaacccgtgtattttctttgtcaaggcaggctgagaaagataaagcctctctgaagctttatgataattaagagtctcagccaaaacgataaaagcttcaagattgcgtatatccatgttctctcgctcaatgattgtttaatagctacaaaacattacagattcatggtgatagcattttaacttagcgttttgctaaaggttttatcaggacaactggtcaaaatgttaactaacaaaatgttagttaataagggcacaattagcaaaagatttattaatgcggcattttaatttactacataaacaattgcaacagaaactaaaaatccaaatacacaactgacggtacagctcgaggaaaatttcaatctatacctgccaatacaccatacacataatcacattactggttattttatatgtcgtacaattttgactatcaccagaaaaaaataatgacctgcaagttatcaattgataacttttatctattggcaacccacattatggaataccaaatccattaaaagtaaaatatcatactactaaactattgtgtgagtaatttaattaacagacataaagaaaagcagatatacctgtcttactcgtatattggaacaaaccatagataattcacattcactttattacattatctattttagatctttaattttatggctatttttatatttactcttattacgtgttaataagccccagctttaattaaaagtattatattaaatacaactataaatggtaaacaccatcataaaacgagtaaaaataatttaaaaaaatacagttacagtgacagtcagtatgagtaatgatgtttttattgcatattgatattggtaaatagtatctatttttatttcaagttttgagggtttttgatatcagaatattctgtattagtaagttattttatggtggtgatgtattgggttttagtgatatgtaggttatatgttaaatggttagattgagcattgaaaatagtgtttacgctcaatgaaagtgcctatcactttgttatgcatttcctcagattcagagtaacccatcgttttgcggttcagccttttgattcgtgtacgatgcgttaaattagttctctctatacgttgggtaaacgtctttccggtaaggtgatcttcctcaggaaggcggccatacaccctataatcatccgtacagtaaagccgaatattaaagggggataaaacttgtcgaatgttttcatggcggtggctatggcgacgtttagaacacggacggtgtcgtgaataccgccgttattcatcttgatattaaaatacattaagaaagattttatctttatatccaatgaattttatattaaatccagtacgataatcatgctccccatgaatagcatattcacttttccatcacatacaacaggaacaaataatgaaaatcgatctgagcaatatggtgacagaaagccgtaaccctgccagtacccatattgatgagctatccacactcgatatgctgcgcgttatcaatgatgaagatcaaaaagtggcgctggccgttgcagaaacgctgccacagattgcccgggtggtcgataaagtggccgaggcatttcgtcacggcggacgattgatatatagcggagccggaacttccgggcgtctgggcattctggatgcgagtgagtgtcccccgacttatggtacaaagccggagtgggtggtcggtttaattgccggcgggcatcaggcgattttgaaggcagtcgaaaatgcggaagataatcagcaatcaggcgtagaggatcttaagggactacacttcaatgaaaaggatgtgctggtcgggattgccgccagtggccggacgccttatgtgttgggtgcgatgaaatatgccagatcggttggagcaaccatagcctgcatcagttgcaatccggacagcccgatgacgcagttggctgatatcgccattacgcccgttgtggggcctgaaatcgtgacgggttcttcccgtatgaaggcaggcacagctcaaaagctggtgctgaatatgatcacaaccggggccatgatccgcatgggtaaggtgtatggcaatttaatggtggatatagaagccaccaatgctaagttgatcgaacgtcagaagaatattgtcatggccgccactgagtgcagcagagaaatggcagaacaggctctgagtgcctgtgacggtcactgcaaaaccgcaatcgtgatgattttatcgggaacctgtgccgaagatgctaaaaggttactggcagaacaccaagggtttatccggcccgctatctcaaaatcctgatgatcattgtttctttggagagatcatagatggctaaaatcagccaggaaatgctggtagaaatactcagggcgatgggtggcgcggataatgtcgtccattgtggcaattgcatgactcgcctgcgcttaacactgcatgatgattcactggtcgataaaactgtcttaaataaaatttcaggggttttaggtgtcattgaaaatgacgaacagctccagattgtccttggccccggcaaagcacaaaccgcagcggataggttgaacgggctattgagtactgctgatcactccgccgctggacaccagcccgcagatttgaaagagattgcgtcttccaataaaaagcagctcaaagaaaaacaaacccgttcagttcataagtttctggctaaattcgccaccatttttaccccgctgatccccggttttatcgccgttggcctgttattggggtttgctaccttgctagaacagattttcattcagggaaccggacatcccaatgccgtattggttgagatggtcggctatatgaaagttttcagcaaagggatgttcagtttcctgagtattctgatcggttataatgcgcagaaagccttcggtggctccggcgtcaatggtgccattatcgcttccctgttcgtgctgggttataacgccagcgccaccagcggcttctattccggtatcagtgatttctttggcttcgccattgacccgcgcgggaatatcatcggtgtactgattgcctgcattctcggcgcttgggtggaaaaacagatccgcaaaatgatgccctctgatctggatatgatcctcacttccacccttacccttcttatcatgggcgctgtcgcgtttattgtcatcatgcctgtgggaagctacctgtttacggcgatgtcatggctgttcatgcatctgaacggtaatccattcggtgcggcaattctggcagggttatttttaatcgcggtgatgtttggtgtacatcagggctttgttcccgtctattttacgttgatggatgtgcaaaactttaactcgctgttcccgattctggcgatggcgggagcaggacaggtcggctctgcgctggcgttatatatgaaagcccaaaaaggttcgctgctacgcactcaaatcaaaggcgccatcattccgggttttctggggatcggagaaccactgatttatggagtgacactgcctcgcgtcaaaccctttgtcacggcttgtttcggtggcgcaatcggcggcttttttatcggtctggttgcctggctgggagtccctgtcgggctgaattctgttttcggcccatcgggtctggtcgccctgcccctgatgacgtccgatagtggcatcttcacgggcatggcagtgtacggtgcaggtttaatcatcgcttatatcagtggttttatactgacatttttctttggcagtaaaaatattgatttaagctgattcagctaatccaaagcaaagggacacagacagcagtaagaatacccatggtgatattgaaaataaaccaggcattgcggcttttcaacagggagccaatcagcgagcccagaacaatccacactgtaccagcgatcatattggagatcagcatcaccacactgatcacgaccactgagtggttatataagtctccctgtaggctgtaactgccgacggcacccaatcccatcatccacgccttggggttcagaaactgtaataaccagccttgatggcttttgatgggaacagccgccaaatttgccgtttccaaccgtttataatgtgctgtcgacgttttccacgccaaccttaataaatacagactaccgagcactttcaacacggtgtgcatcgccggatacaacagcagcactgctcccacgccaaaagcagacagcagaaggatggtctgtatgccaagaaggatacccacccaaagcggtaacgaacgacggaaaccaaaattagcacccgatgaagtcagcagcatattgttcgggcccggtgtaatcccagagattaataagaaggtgcttagtgagaatatcagacttgcggtcatggggggattgttcctcttacccaaatggttaacatttcctttcgacgaaaataacagtatgttattcactacacaagatgactaattatgaaaattaatcccttatgagtgagcacttttctcccctgagcagggccgccaatccccatttacaaactcaggagcaaccacaatgatgatcccgtggcaacaactggcacccgaaaccctactcgatctgatcgaaagttttgtcttgcgggaaggcaccgattacggtgaagatgaaaaaacgctggagcaaaaagtacaggatgtaaaacgtcagcttgaacggggagaagtcctactggtttggtctgaactgcatgagaccgtcaatatcatgcccaaagagatgtttcgcccttagcgccttctttttatcaggctgttccgtttgccttattttgctctgtattgctgattacgagaaagatagtcccaacttttttggataaggagtctgttcttatgtctgccaaacaccctgtcattgcaataacgggttctagcggagccggaacaacaacgaccagtgtggcgttccgcaagatttttcaacaacttgaagttactgccgcactcatcgaaggggatagtttccaccgttacacccgtcctgaaatggatgccgagatccgtaaggcgaaggagcaaggcagacatgtcagctattttgggccagaagccaatgatttcagcatgttggaaaagacattttacaactatggtgaaacaggcactggccgctgccggagatatctccacacctatgatgaagccgtgccttacaatcaagtaccgggtacattcacgccgtgggaatcactgccatcaaacaccgatattctgttttatgaggggttgcatggtggcgttgttactccacagtataatgtcgccagctatgttgatttgctgattggtgtcgtccccatcgtcaaccttgagtggatacagaaacttatccgtgataccagcgaacgtggccattcaagagaggcggtcatggattccgtggtgcgttcgatggatgattatatccgctatattacgccacagttttcccgtactcatatcaatttccagcgagttcccaccgttgatacctctaaccctttctccgccaaggctattccatctctggatgaaagttttatcgtgattcgtttccgtggcctgaaacaaattgatttcccttatttactatcaatgcttcagggatcatttatttccagtataaataccattgtcgttcccggcggaaaagtggggctggccatggaattaattatggctccgtgggttcagcaattactggaaggcaaaaaaatttcttgatttaaacgcaatttaatttttaattaaacaggtaacaaaaaataacgttgcctgttttacgaaaataaacatttcagtaacaataaaaacagattataaagagaaaattcagtaaggtaaaacgcgtaaaagcagtacgatatttaccaaagtacccacagcctcttacacaataaaaaagtcattcagccgttcccgtctttatgttgtttctccttttccctttggaaatactggcattattcgatttcctataagtcgtagagcaataaagacgacgctccaaatagatttctgttaatctggcgggctgaagcgatacaggggaagacagaaacgttttcctgtgttacaaacgaggttacaagcgaagctggcaagatatataggttaagattaagacacccatattttggtatgattataatctatataaaattcccgcttgtcagtttttcagcaagttaatatgttaaactattgactttataaagccagccgggtgaggaaaaactgttcctcacgtcatcaaggcggaaataacaacagaggataaagcgaatggttctcggcaagccacaaacagaccctactcttgaatggtttttgtcacactgccatattcacaaatatccatccaagagcacgcttattcatcaaggcgagaaagcagaaacgctttactatattgttaaaggttcagtcgctgttctaataaaagatgaagaaggcaaagaaatgattctctcttatttaaatcagggagatttcattggtgaacttggattgttcgaagaaggaaagctgcgtactgcatgggtacgagctaaaagtgcctgtgaagtcgctgaaatttcctacaagaaatttcgccagctcattcaggtcaatcctgatattctgatgcgtctatcctctcagatggcaagacgcttacaaacaacctcagaaaaagtcggtaatctggcatttctggatgtcacaggtcgtattgccaagacgttaatgaatctggccaaacagcctgatgcgatgacccatcctgatggtatgcaaataaaaattacacgtcaggaaattggccagattgtcgggtgttcccgcgaaacagttggccgcattctcaagatgttagaagatcaaaacctgatctctgctcatggcaaaaccattgtagtatatggaacccgctaatttctgaaattactcttgaaactgagccagcgcaacccttatcctgcactggcttttttgttgcttcctttgtcttatcagtgcaatggcagcatcaagccccgttacgccgctttctgtaatacttcactggccttgccctgatattccgctgggacagacgtgatttcccccaccttatttttatatttgccatatcacagtgaaataatagtcaccaaatatgaataaaaaatcacataagggcaaataaaaaacagccggtgaggaaaatgcgatggtatttggttaatatctgagaaaattattcaacaaatcatgtccctgttcactgagaatgctttcagggtgaaattgcacaccttccaatggcaaagtacggtgacgtattcccataatttcatctacattaccgttatgctgactccatgcggtcacttcaaacgatgctggcagggtttcagcagcaatcaccagagaatgataacgagtaacagtcagtggacggttcaatcctttgaatactccttgttgattatggtggatcaagctgttttttccgtgcatcacctcgcgggctttgaccacactcgcaccaaaagcctgcccaatagcctgatgccctaggcacacaccgaggattggcaatttgccggcaaaatgcgcaatggcctctagtgaaatccctgcttcatttggcgtacaaggccccggcgaaatcactaaatgtgtgggcgccaacttctcgatatcttcaagctgtaattcatcattacgcttaactaaaacatttgtccctaactcgcaaaaatattgatataaattgaatgtaaaagaatcgtagttatctattattaatagcataggagtatatcctattgatttttatagttttatatattgccgctaccctagcgggcattgtgcattctgtatttcgataaaatcaggtaaagcagcatcaacagcagcgggacgctcatcataccacagacgtatttttaaaatagtaggatacaaacagcagcattcacccgtggtgagagcttgacgtgaaaagataacgcaggtgagaggggaagacggcactcaaaaagcgaatggcacaatataaataccgtcttattttctaggtttcaggcaggaaaacactgttttcctattgaattaaggtgcaactttggcagaaaggatcacaatcggtttcacgggtacattttgataagggccaacattttctgtcttgacctgagaaattttatcaaccacatccataccttttatgactttaccaaagacagcataaccaaaatcacgctgaccgtgatcaaggaaggcgttatcagtgacattaatgaagaactgactggttgcactgtctttatctgcggtgcgtgccatcgctatcgtaccacgcagattacgcaaaccattatctgcttcatttttgattggtgctttggtcaccttctgcttcatatctttcgtaaagccacccccctgaaccataaacccgggaatgatgcggtgaaaaatggtgttgttataaaatccttcattgacatactcaatgaaattttttgtagtgattggcgccttgttactatccagcgcaagctctatttcccctgctgatgttaccagcttcacatgagtttcggcagccaatgccggagttgccatcacactgatagcacatgcagccataagcgacacaaaaatacgtttaaacattaatggttcctttatttttgaggtcaataacaaaactcataacaacaaaacttattaagtgtaattccctatagaactaagttccaaagatttacctacatttacgagtaagcagctatttgttgagatgaattctgtctgaatagctattatggtctcataacctgaattttgtttatgtggggaataacgttataaatggcgagaaatatagagtattcaaccaaagggtatacaatacagatatcgcgcaattagtagttatacctgtccacaagccgctgctctaggtataatcagcgcgctgttttcgtgtattcctcagggagataaccattttgaccatcaaaaactacaactatcacatgacccactttgtcacgagtgcacctgacattcgccacctgcctcaagatgtgggtattgaggtcgcgtttgccggtcggtcgaatgcgggtaaatccagcgccctgaatgcactgactaaacaaaagagccttgctcgcaccagtaaaaccccggggcgtactcagcttatcaacctgttcgaagtggaagacggtattcggctggttgacttaccgggttatggctacgctgaagtgccagaagagatgaaacgcaaatggcagaacgcactgggagagtatctccagaaacgtgagtgtctgctggggttggtggttttgatggatatccgtcatccactgaaagatctggatatgcagatgatcgaatgggcagtcgtgatgcaagtacctgttatggttttgctgacgaaagcggataaactggcatccggcgcccgtaaaagccaattggcgaaagtccgtcaggagctgacttctctgggtggcgagattcaaattgaaaatttctctgccctgaaaaaaatcggcatcgaccaacttgagcagaaacttgactactggttcaaccagcctgccattgaggtggagtgagcttcacctaccccctaaagccgtgcttcgcgcataaaaatctatggtccccaccttttttgcaacactgatttttgattgatgttggcttgcttaaatctatccggcgtcactatgggcagggatgcccgcgcctcgatgagttccgcacctgataagcctaaaaaaccgcacggcttcagagagccattttttatgtcaggattccatcaggtcgataagccgttcatgtcatcaataatcagtcttcgcaaaaccagattgggaactgctttaattaacgattaacctgccagtcagactggcgtcgtcgttacctttcgaacacagtttgccgtgttgtgattgcccaggctatccgggctaatttgttggccagcgcacaggccacaacatttgagtgttttcgctcaagctgagcctttacccattcagccagccttcctgactgataatcgattctctggataaagactctggcgcactggacaagtaaccgtcgcagatttttgtctccgcgtttacttatccctaaaagcgtatttttgccacccgtgctgtactggcgtggtaccaga

SEQ ID NO: 14970 - DNA, 81552 bp, Xenorhabdus bovienii
  Genomic contig Name=Xb4151_4152.C429
tatttcttataaaaccaatcgtttgataatattattttaggtttcattttatacctttttctttaacatatgcatgtatctaaatataattaatattaatgagataattatacatccagcccaatatatagtattttcttgagtattatttaggtgtatgtataacatatatattattaaaggagagtttgtgagtaatgataatataaaatttatatactggtctttgaagtattgtttgaattttatctttaatattctaaaaagataaactaaaatgatactccaacatagcatgtttcctatagaatagaacaggatagtatatatgtcattatctaaatatataccaatatataatgtaactatgcttgttagtagtattattgcttgaaataatgtccagattttctgttttcctaatatcatatatgctgaacttattggggatgtaataaatactatgtacatcaacatacaaagtatccttgcataatgtcctgcagttttccattcgtttccaaaaatataattaaacatggttggtgaaattagcattatcaatattacgaaaggaaaagctaatgttacaagttttttatatatttgataggttaattcatttagtctattttccctgtaaaaattggaagcctcagcataatagacattagatagtgattttccaattaattgaacaggaagtgttaggattctatctgttattgcatagaacccagcatatgctggattaaaatgtattgctaataaaaatataggtatcctagagctagtattatctaatagggaacccattaaaatgtacttagggaaatctttatattttcgtatgccccatattaatcttttccgcgatggtatgacaaaagatttggttttttttgaatatttatataattttagacttcccatgaattgatttaataattgccctaatatcaagcctaaatcttgtaatttatataaagacagctgggcaataagcattgatagagtttgactgaattttgttctggcaatcagagtgaaatttttatttctgctggcccaataagttaatgcctgataaattccaatgaataataatgacgctgggattaggtataaatagttattaaaatcttgtagtcccatattccctagtaacttttttgggaaaaatattattattaatatggatgtgaaagatgtaattatagtgaatgctaaggctaaaaataaaataactttagcttgattatcatacttaggcaaaacaatagctaattcataacgcagacttacaattacattgagtatagcgattatacttatatatgttgccaatactccaaaggaattcggtgaatataatcttgtcattaaaggcataaaagctattgtaattaattgagctaataatgttcctcctgccaaagatagcacattatagtaaaatttatttttctcttttattttaagaagaatgtttttaatataattcatgtgattattttatgcttcttattatttttcttatatctgaattttccaaataagggtgcataggcaagctaataacttcttgagaaattatatctccaactggaaggattgtattattagcaacagcaggttgtttatttaatggtataggataatgaacagttgttggaatgccttgttcctttaatcgcaactgtagttcatcacgatttctaacacgaattgtatactgcgcataagcacttacattatgggattcgatatatggagtagtcaggatgccaatttgatttaaagctctattataatttttagcaactatttgacgtgatttcatttcttcatcgaaaatttctaacttcggtagaagaattgcagcttgtagagtatctaaacgactattaacaccaactcttatatgatgatatcttctatcttgtccatgacgagcaatttgacgaataatttttgctaatccttcatcgcttgtaaaaatagcaccaccatcaccgtagcatcctagtggtttacttggaaagaagcttgtacatgcaatagttgttaagttacaagagcgtttacctttatatgttgctccaaaactttgggctgcatcttctataacggtaatattatgtttttctgctattgcattgatttcgtcaaaatcagcacattgaccatataaagaaacaggaataattgctttagttttaggagttattgcagcttctaatagtgctggatctaaattataagttgttggctttacatcaacatatacaggaataccgcctaaaagagcgactgtttcagctgtagcaatataagtaaatccaggagtaataacttcatcgccgggtttgataccaatagccattaaagcaatttgcaaagcatcggttccattcgcacatgtgatacaatattttgctccagtatattcaacgagtttttcttctaattccgagacttctggacctagaatatattttccatgtgctaatactttttggatattttcgtctattttatctttaatttttaattgttgtgctgctagatctgtgaattgcattatatattcttcctatattatttgattttttttacactgttatcatctaagtgatagatatgccctgtataaggacatgttgtagtggattttccatgcaatggtagatctaactgttcaccaaattcactcatccaacctatttgttttgctggtaccccgaccatcagtgcgtaatcaggaacatctttattgacaacagctccagcaccgataaaagcataagaaccaattgttgttccacaaactatggtgcagttggcacctaaagttgctcctttttttactaaagtatttttatactcattctttctttcgatgaaagatcgaggattatagacattagtaaaaaccatacttggaccacaaaaaacaccgtcctctaaataaacattatcatagatggaaatattattttgtattttgcagtggtttccaataattactttatttccaataaatacgttttgacctagagaacagttttcaccaatttgggcaccagagcaaatatgtgtaaaatgccaaattcggctattctttcctattttagcaccatcatcaacgatggcactcgtatggatcatgacttcttctgtgattgacataattagattacccacattaatatatcaaaggtaaagacaccgttttattatctctggcagaaaggtaagcagcaattagtaattcaagagattttaatccttcccttccatcagtcattggttctgcttctcctctcattacatcgataacatttttataatataatggatgtccaaaaccgtatactgaagtggtttcgtaattggcaccttttacttgttggtcataatctttttcgtcggcaaaattccactcttgaatttcattaacggctaaaccgccaactctaacactccctttttcccctaatatagtgatagagccttctaggttgctaggataagtacacatagtgacagccattgagcctagcgcgccgtttcgccatctaatatttagtacacctgtatcttcagcttcaatgtctaagtgtgtagacatcattgcttgaatgtctttgactgggccaatcagccattctagcaaatcaacataatggctagcctgattcataaatgcaccaccatcaaattcccatgtaccacgccatgcagcttgatcgtagtaatcttgagggcgagtccaaaatacattgaggtgaaccatattgatttgaccaaaacgttgttcttctactgcgcgtttcagcaattggagagttgcgtttaagcgattttgtttgactacgaataagcgtttgccagctttgtccgcagctttaaccattttctctccatcagaaaaacgagtggccatgggtttttcagtaactacatggaaacctttttctaggcaagcaatggcttgttcaggatggagtcctgaaggtgtagttaggatgataatatcagctgaaatgttatccagcatatcatgtaggttattaaatccattagcgcctgttttttccatagcggtattgagggcaacagggtctgtatcacaaacagcaactaactcggcattatttttatgtgcatctaaagagttaaaatggtttttagcaatccttccacatccaaccagtgcaaattttatttttctacctttgataatatcaaacatatttaatcctaaattaagcttttatcacgttattatgattaggagaatattttccacgagtatcaacaattaattttgcattgttaattattaagtcatagtcaaatttatcgtggtctgttgctaaaataatacaatcgaattcttttaaattatttgaagttatagattggcttattagatcgaactggtgttcacgcattttagggaaagcaggtacgtgaggatctgaatattctacgaatgcacctaagtctcttaatttttccattatatggactgatgggctctctctcatatcatcaacatttttcttatatgaaatgcctaagacaagcacattgctaccattaattgatttattaactttatttaaagctaagactgttttagtaacaacataatctggcattgatgaattaacttcaccagaaagttcaatgaaacgggtattaacgccgtattctctagctttccatgttagataaaaaggatcaatcggtatgcagtgaccacccaacccaggacctgggtaataaggaacaaagccaaatggttttgttgctgcagctctgattacttcatgtatatcaatgcccattttatctgcaactagcttcatctcattgactaatccgatattaaccgctcgatgtatattctcaagtagttttgtcatttcagcagcttttgtggagctgacaggaacgactttatcaatagctggttggtaaactgcaatgccagcgtttaagcaattttctgtgtgaccacctattactttcggaatagttcttgtttcgaaatctgggttacctggatcttcacgttctggtgaatatactagaaatatatcttcaccaactcttaagccactttcttctgctctaggtaataactcttcttcagttgtgcctgggtaagttgtgctttctaaagaaagcacttgaccttttcttaaaaatggtttcaccatatctgttgtatttatgacgaaactcatatctggttctctatatttatttaatggggtaggcacacagagaataattgcatcacattctgatattcttgaaaaatcagtggttgcttcaaagccagtttcaatagctttttgaattctggaagaggaaatatgttcaatatagcttagacctcggcttaatttttctgttttatctttatctatatcaaagccgataactttaaaaccaatatcgttgtagcgtagcattaaaggtaaaccaacataccctagtccaacaatagctatatttgcacttttgttattaaatttgttaactaatttattcagtgatgacatgttataggcctttaatataccatataaaagtaagctaaaaaaatactcttagaataaaaatattcttttagcttatgtgacacttatgacgtgagggtatggagtatatagaagagtagaagtttttgtacttagaatgttagataacataaagctaccgcactaggttacggctcccagagtgcctattatactttgcgatttattcatccatttgatataaaaggattttatcgtttaataaaaaccataagcacaaaccatttgtgttaagcagcgacgaggttagaccttcgctgctttgaggtcaagtacaataattttttttctttaactattacaagccgtaactatctaaattttaagatgaaagtggttcatctcccatgcaacggcaaccaaattatcagccgtaacccacctaaaggactatcttctgctttcacccatcctcggtgctggctcactgccgtttcaacaatcgccagccccaatcctgttccacccgattctctatccctcgcttcatctgtccgataaaacgggcggaagatttgttcacggtcttcagggctgactcctgggccatcatcgtcaaccgtaattgtcactccatggttatccgccttaaacgcaacggcgatatgactactagaataacgcagggcattacggacgatgttttcgaatgcactaccgagtactgccggattacagtagataacccaagaacccggaggggagacgatatccagcgttttgttcatctgttcgacttcgaatttggcattctccaggatatcgtgccatatatcgttggctttgatattttctcgcagcagttcattcttatgctgattgcgggaaagtaccagaagatcattgatcatctcatctaatcgttgagtttctgtttcaatacgttgcagctctttgctctcaccatgacgtcggcgcagcagggcgctagccaattgcaggcgagtcagtggtgtgcgcagttcatgagaaatatcggaaatcagccgttgttgggctgtcaccattctgtccagcgcgttgatcatctggttgaagctgctgccagcggctaaaaattcttgtgggcctgattccagttcaggatgtggccgtaaattgcctttcgcaacctgatctgccgcatttttcaatttacgggcaggtttggctaaactccatgccagccataatagtaatggcgcactaattaacatggttgcagcaggtaataaaaggggtcggtcaaacattaagttaataaagtcagactgggggctacctgcgggcctaatgaggtaaagctggtagtgatcttcaccatcgcggatagaaaagggcccgagtatttcagagcgaccatatttcttcttcttgggatgatctgcattattggattgaccaatgaagttacggacaacctgcttttcactggtctggatatcaacgatacgtccttcactggtaacgagcagtaaaagttgccccggcggcgtccactttgcaattgcgcgatccagtcgtagccaccaaaacagttcattagcagggtagcgggttaactctttttctatctgtttcgcgagtatgatgccctgttgatattcactgtccaacagcggtgtcaattgccgtgaatccagttttggtgccatcaaggccaccatcaggacgagcgccagtgtaagccagaaaatcgcaaaaatacgggctgtcaaactattgatcattttgcagagaccattaagtatccacgaccgcgtaatgtcttaaaccaaggtaactcgtcagtccggttcggcaatttacggcgcaggttggaaatatgcatatcaatggctctgtcaaagggtgtcaaccgttttcccaagacttcctgactcaagtgttcgcgggaaacgacttgtcctaaatgttgcgctaataaataaagcagggtgaattctgttccggtaagatccaaaattgtaccgtcaaagctggcttcctgccgcccagggttgagctgtagtttatcgacctcgagtacaggtgtcccactatcagcctgttgttcgctccagttggaacggcgcaggatcgcacgtatacgggccaccagttcacgatcattgaacggcttaggaagataatcatcagcacccagttctaaccccagaacacggtctaaatcgcttccacgggccgttagcataataacgggagtctgatggtcttgtcgtagctcttttagtgtctcaatgccgtttttacgtggcatcatgatatccagtagtagcagatcgattgaagaatcgatatattgtaatgcctgttcgccatcatgagcgagcacaacagtgaatccttccatctcgagcaactcttttaatagcgatgtcagttcacggtcatcatcaactaataagattttatgcatgttttcttcctccgagagcaaaatacgataacaaactttgctattccataactttacgttcttttacatgctctgacgctagtttgcagcagcagggttatagtgatccgcactgacatcgaatagtactgttcgagaaagcgaggaattatttgatgcgtaacatagcaatcttggctttagcgtcaatgtttgttcttggggcaaccgatgctttagctggaactgctggtactgataatgttattgcggatgacttctctcaatattgtatgccatatggtaataagaataacgttagttattgcctgaatgatgaacgtaactataactatagttgtatcttcgctggagtcagcttaacagagcagcaacgccagcagatatgggatttagtgaaaaagcaacgtctgcatgagaaacccgtggcagatattagagctgaacgtcggaagatgtatagccttttggattcaacgaattttgatgaggctgcggtcaggtcgcagcttgaaaaaatagcgaaagaaaatgttgatttgagtgtagagatcgctcgtattcgcaatcagatttatcaattgttgacaacagagcagaaagtacagctccagagacgttatgaagtgcgtgttaatcgagaaatgaactgatttctattaatacccttgacgtaaagttgcatcaacaacagttttccttgccatagacaccatccctgtctttcagcccccttgtggggcttttttttatctggcttgaaattaattctctttaaaaatcagctataaaaattttataagcaacttgaaaattttcaagtgttgtatcacaaattagtgttgaacaaataatctttccgtacaatttatggacaaatgacactgttatatgcttcaatcaaatatgttaaatcatcatatttaaagcgcacattttatgagaatcagcaaaaataacatttcttctatcgccgctgctatggctttatcactcgcaccagtccctgctgatagcgttggtagttacatggcaacatcgacaacacagaatacgttaatgttacaaaatgttaatgattctatggtgtatatgcctattgctgaagcacagaaatacgttgctgatatggctaaccgtatgagagggcatttgcgaaatctgcgtgcggaatgggaagaaaaacgtattcctattgatgataaaagtatgtctaaatttgccagagataatctgaattatttaacaagacatatcacgctttgcgctgtattagttagagcatcaaaagtggctttaaatcaaacaagtgatcaagaacttcgaaatacgattatgcagtttggccggtcagcagcggatttgcgttatacatatgaagaaattctcacatttactaaaaatacacatgaatcacctaatgtgcttgaaatggcagatcagttcagtaaagaaggtgttcaagcattaattagctctgaacatcaagcgctgggccttgataagccaatgtttcattaatggtgatattgtggtaactgtttccattcacaaagatattgaattacctgctgttgccagatagtacgccaaacttttgaaagaatggaaaaatggtgggttgaggccgattatttttggtgatgaggggcgctgggaagatcatgcatccctatgcgcctcttttgttttcaaaatacatatcaaattacctgatgaggaaccgtggtcagctaagatgcccgttgttgcacgtaagagtaatagctatcttgtgtatacccgtcattggtgtgagccgaaaaaatatcaactcattagtatcatgaccccaaatgcccatgaacttgccagaacctcttttttatctgtattggttgatcgcgcagaagatttccaaaataactgaacccctattaatgccgtctattgggtcatgtattaaatagttagttgttatgataatcttccggtatttcgtggtggaacatggctaaagtagaagttgattgtcgttattgtcaccaatcagaagatgtcaaaggacagggaaaaggtcatagaggttatccccgctaccgctgctatgcctgcagtaaagtctttcagttggcatacacctatcaagcttgcaaaccgggagtcaaagagcagactattgatatggcgatgaataacagcggcatccgtgacacggcccgcgtattgaaggtggcaacagctactgtgatgaaaacgcttaaaaactcaacccccggaacgtgacgacgcttcctcttgacggggatgacattcatcttatctgtgaagtggatgagcaggagtcgtttgtggggagtcagaaaaatcagcgctggctctggtatgcctgggagccgcgtatgaaacggatagtggcacatacttttggggatcacagcagaaaaacatgggaaaaactactggcactcttgtcaccctttaatatccggttttactgtacggatgattatgccgtttatgattgtcttcctgaagaagtccatcttactggaaagatatttacccaacgtatagagagaaccaaccttacccatcgtacccgaataaaaaggctgaatagaaaaacaatcggttattccaaatctgaagaaatgcacgataaagtgataggcactttcattgagcgtgaaaactatatttagtgagcattctaactatttaatacacgaccgtctattgagccgtctttcagccccaaaatgtcaggagaaccgctcatggccgcatttttggtgggctaggttcttattttttattttaccgcactaaattataagggtaattctctattaatgaggagattgcttattagcccgtatcaatataggcttggatgaatttagctctcctctgcttgggaataacgtgccctcagcccgttgttatcttgaccaatcttgattatcttaccttctcttaagccgctaattagaaaatcttatcactgttattacacagtaagggataaggatacccaatatggctaactctcataaaataagcctgttagcaagatgcatgggcgcgacgttattgggcctgtgccgtgtcttgaccggtgtacaagtacgatggattggctgtcagccatcgacctcaagccgtatttattatgcaaatcataccagccatcttgatggattggtgatctggtctgggcttccccccaaattgcgttatcagattcatcctgtagctgcacgggattattgggataaaaccaagctgcgtcgctatcttatgtataaggtatttcgtgcagtcttgattgaacgtaaaggagaacatacttcaaaatccggggttcttgcacctttggaagctattctggcgaaaaaagagtcgttgattttctttccagaaggtacacggggagatggtgaacaactcaatccgtttaagggaggtttgtatcatctggctcgtcagtaccctgatgctgaaatgatccctgtctatctggaaaattcgaatcgtgtcctgccgaaaggaaaaagattattggtaccgattatttgttcggcaacatttggcaagcctctggataaattgggtgaaaatgaaagcaaagtcgccttcttgcaacgtgctcagtctgcattggaggagttgatgcgatgatcaagattgataatggcctgatgcttctgctgggtgggatatttggggtattgattatcgccagtgcgattggtggcatattgtcgcttcggtattcgggggcaaagcgcagtgcgactatcgataacctgaatgccagaattcgtggctggtggatgatgtgtatcatctgtgtgctggctgttatcgttgggtctgtggggtcggtgatcctgtttacggtgatgtcattttttgccctgcgtgaattcatcacattgacaccgactcgccgtggtgatcatgaggctcttttctggtgtttctttgtctttatgccaatccagtatgtcttgattgggatgcaatggtacggcttattctcagtttttattccggtttacgtttttctgtttttgcctgtgcgtattgctttggttggggataccacccgctttctggaacgaaccgctaaaatccaatcggcaatgctgatcacggtgtttgccctgagccatgctccggccttgttgatgttgcatatacccgattatgaggatcagaatatcaagctattgctgttcctgatgattgtcgtgcagatgtccgatattttgcagtatgtattcggcaagttattcggtaagcgcccgattgtgccgaaattaagccccaataaaacggttgaaggatttattggggggattttggcctcttcgctgctagggatgtcactgtattgggtgacgccgttttcaccgtgggaagcggggctgatgtcattggctatcacgttgatgggctttattggtgggttgtgtatgtcagcaatcaagcgtgacagtggagtgaaagactttggcggaattattgaggggcatggcggtatgttggatagaattgattcgctttgttttgctgcccctatatttttccatctaacacgctatttttatacctgagactgaataaccgaagggcggtagtcaatgagtataaattatgggcgatgggtcagtgctgctgcgttgttggcaacggtgctggccagtgtgttgctggtcgtgaaaatttttgcgtggtggttgacggggtcggtgagcttattggcggcgctggtggactctttagtcgatctggccgcttctttgactaattttttcgctgtacgctattcgctccagcctgccgataaagaacataccttcgggcatggtaaggcggaatcgctggcggcgcttgcccaaagcatgtttatttccggatcggccattttcctgtttttaacgggttttcagcatttggtttcccccgagccattggagcatgcgacgataggtatctgggtgatcgtcgtcgccttgatttcaacgatctgcttggtgacgttccagaaatgggtgatcaataaaactcaaagtcaggctattcgcgcggatatgttgcattacaaatccgatttgttgatgaatggggcgattcttctggcactggtcttgagtatgtatggtttccggcgtgcggatgccctgtttgctttgggaatcggggcttatatcctctatagtgcgttacggatgggatatgatgccgtacaatctttgcttgatcgcgctttgcccgatgaggagcggcaagagattattgagatgatcaagtgctatcccggaatcgcgggtgggcatgatctgcgaacacgccagtcaggtccaacgcgttttattcagttccatctggagatagatgatcacctgccgctggtggacgcgcatgctttggctgaggggattgaaaataaattgcgggataggtttccgggcgccgatattattattcaccaagatccttgttccgttgtgccagaggagcataaaaaccgttgggattaacggggaatttattcataatcaaaagagcgtcagaaaataaacataatcttaatgcagactgggtgtttttccgtatcatagatggagttgaatcaattcagctaatgaagtgacgatcagggtttcgtaaaaccgccgtaaattttcccgtcaggggatcagtcagcagattggtaaatattacatctacaagtcagaggtcatcatgatcaacaagattaaaagaatcggagtcttaacgagtggcggtgatgcgcctggcatgaacgccgctattcgtggagttgttcgtgtcgctttaaccgaagggttggaggtttacggcatttatgatggctatctggggttgtatgaaaaccgcatgaagaagctagaccgtttcagtgtttccgacatgattaaccgtggtgggacgtttctgggatcggcgcgttttcctgaattcagggatgataaagtccgtgaaattgccattgaaaatatgcgtaaaaatgacattgatgcgctggtggtgattgggggagatggttcttatttaggggcgaaaaagctgactgaagcgggttttccttgtattggcctgcctggtacgattgacaatgatgtggcaggaacggattacactatcggttattttacggcgctggaaacagttgtagaggcgattgaccgtctgcgcgatacttcgacgtcccacaagcgtatttcgattgtagaagtgatggggcgctattgtggtgatttgacgttgtctgcggcaattgcgggtggatgcgaattcattgttttgcctgagaatgaaatcccgttcgatcgtgaagaattactggcggaaatcaaggcgggtatccaaaaaggtaagcgccacgccatcgttgccattactgagcatgtctgcaatgtggatgaattggcgaaatacattgaagcagaaacacgtcatgaaacccgtgcaacagtactggggcatattcaacgtggcggtgcgccggtggcgtatgaccgtattctggcttctcgcatgggggcttattctgtccagttgctgatggaaggttttggtggccgttgtgtgggtatccagaacgagaaacttgttcatcacgatattatcgatgcggtgcaaaatatgcagcgtgttttcaagaaagactggctggaaacggcgaagcagctttactaaacctttctcacctgcaacatactttttcaagggctgccatattttatggctgctcttttctgcactatattccacttatgcataagcagaaattttaaattatttctgcgtcatactgctttctgtcagcttttatggcgataccataaatagcttaggggagcatttcagaatggtcacgagatgggcagcaagaaggtgtgccgtattgacggcattattgatggtcttggcaggaggtagtgcatgggcaaaagaggtgcaactcttgaatgtttcttacgaccctacccgtgaattgtatcagcagtatgatcaggcattcagtcagtattggcagcaaaaaaccggagatcacgtaacagtccgccagtcacacggtggttcgggtaagcaggcaacgtctgtcatcaacggccttcaggcggatgtggtgacattggcgctggcatatgatgtgaatgcgattgcagagcgtggccgcattgccaaggattggattgatcgcctgccggagaattccgcgccttatacttcaaccattgtttttctggtacgtaagggcaatcccaaacatatcaaggattggtcagatttggttcgtcccggtgtttctgtcgtgacaccgaatccaaaaacgtccggtggcgcgcgttggaattatctggcggcttggggatatgggctggcacagaataatcaggatcaaggcaagactaaagccttcgttaaggcgctttataagaatgtcgaagtgttggattctggcgcgcgtggtgcaactaatacttttgtggagcgtggaatcggggatgtattgatcgcatgggaaaacgaagcgttattggctacccatgcactggctcagggtaagtttgagattgttacaccgagtctttccattctggcagagccaaccgttgccgttgtcgataaggtggttgataaacggggaacacgtaaactggcaacggaatacttgaaatacttgtattctcctgtcggacaggaaattgcggcaaataattattatcgtccccgtgataaagccattgcagaaaaatatcacgctgtttttcccgtactgaaattgttcacgattgatgaagtatttggtggctgggataaggcccagaaggtgcattttgccacgggtggcattttcgatgaaatcatccggcgttaatgtttagaaataaccgccattggatgatattccgtggcggttaatgagcaactgtctttcactttacaccgtgtggaatgattcgtcccacggtctatttgtttttatcattgcattgagaatgaccagtaatttacgcatacacgcaacgatggcgactttgtttggcttgcctgcttcggtcaatctcttgtagaaagcgcagagaacggggttaaatctaattgccgttaacgtggccatatatagcattcgacgcaccattgctcttcctccaaagattgttcgtttcccccggaaaaatccagaatctcgattaaacggtgcaacaccaatcaaggcactaatttcccggcgtgttaacttacccaactccggtacatcagcgatcaaagtggctattgtggcaggcccaacgccttttactgtagataataaatcgagtttggaacgatgataggttttaatgtgtttagacaaggcagattcaatgaccttaagctgttcctgtataaagctgatcattaaagtgatgctttctcgaatgtctggatggcaattccccaacctttggcgttctgagatggaaagtacgaccaattggcgacgacgtgcgatcatggcttgcaagactcgttgctgagcagagggcaatatcctgactattttatcccggtctgttcgttgagataaaaccagggctaactgtgccagcacctgagcatctattttatcggttttggctaagttacccattgccttagcaaagtcacgggcttgtcggggattgacgatagcaacagccagccctatggtctgtaaaacacaagcaacggatacctcataaccccctgttgcttctaatacaactaaatcaatctcatagttggtcagtgtagccgctagttcatcatgaccttcaggggtatttggatatgtcattacggttccctgagcaccaagtgcaatttcaagtgaagctttggcaacatcaataccgatacaaatcgttttagtcatggttcttcggctcccattcttgcaaatacgaattgtgtttcaagcaactgttcgggtttctcgaagaaaagtcacaatcatgcgtcgaaagctcattaacgggcttaatcccttgatggttatctgactgcatgattgttaccaatctaacttaaccataataaaccagattaaagatacaagatggtccccaccaccctgtgagcggtatgctggcagggtgtttctttcaggagaagaccatcatgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtgataaaaagactttcaaccgtcttggcagagaacgaacttcctccctatctggcacagttgctgatgcgtttacatgcccattatctttatcttgtcgaacagctcaccgagcttgagacggcactggagcaggagctgagacgtgatgaaacaggacagcgtcttcagacaataccgggcgtgggtccgataactgccagcgtcttatcatcgcagctgggcgatggtaagcagtatggctgtagccgggattttgctgcttcaaccggtctggtaccacgccagtacagcacgggtggcaaaaatacgcttttagggataagtaaacgcggagacaaaaatctgcgacggttacttgtccagtgcgccagagtctttatccagagaatcgattatcagtcaggaaggctggctgaatgggtaaaggctcagcttgagcgaaaacactcaaatgttgtggcctgtgcgctggccaacaaattagcccggatagcctgggcaatcacaacacggcaaactgtgttcgaaaggtaacgacgacgccagtctgactggcaggttaatcgttaattaaagcagttcccaatctggttttgcgaagactgattattgatgacatgaacggcttatcgacctgatggaatcctgacataaaaaatggctctctgaagccgtgcggttttttaggcttatcaggtgcggaactcatcgaggcgcgggcatccctgcccatagtgacgccggatagatttaagcaagccaacatcaatcaaaaatcagtgttgcaaaaaaggtggggaccatagatttttttgtttttctgccgctaactttacccgccactacgcgatggcttttcacacctatcacggctataaatccccctgactcaaactccaccccactacctgctaatctcccttatgggctagttattgaatgaaggggcatcaagccttgtgttcacttcggctgctccggccattggatatcaggtgcggtagtgcaatccacccgattgagcagcacccggtatttacgccattcggttagtgcggatttctccgagtcggtggccatatccaaatcaaccgcatcctgtaacggcgggatatcgccccatgcaggtaaaccattctcgcccactacgcggcgcttgccctcgggtgaccaaccatgatccctgcaatcgtaatctcttttggttccagaacagcatggtcagcaattgccgctcccgattcgatagggttttcagtaatgcgtagatttgaactgtgattctcgataaccacgcagtcaaattgaaactcaccaatagaacgcgttatcaccgaagctcacatggtgttgaaagcgcttagtaagtccatagtcagatccagtaaaaatcccccttcatagaagggggcattgatttcgccccaaaggggcgctattagttcagactctgagagccttcacttcacatccctttcaacgataattgattgtcctcatgttcgtgcttctcttgatacttcacatacttccttatcatttcttcatttatacctacggtatctacacagtagcctcttgaccaaaaatgatttccccacaactttttctttctcaaatagggaaatttattaaatagacgaatagctgttcggccttttagatgaccaagcacttgagatactgataattttggcggaatttttactaaaagatgcacatgatctatttgaacattcaattccacaatttctattccgagctgctcactggaaatccttatctgcttatttcctttcctacattatttttcaggatcctaaatcggtatttgggtgtccatacgatatggtattgacaacaccaaagcacatgcgatgctttcttgaatctactcatggttaaatccttctctgttatggggataacggattcggattttcccatgagtagcattattggcagagccaacctgttgctaaccacctccgcaggaggtggttttcagttaagaataaaaaaggtcgcaaatgcgaccttatattaagttatgaatttattacttatcgtacaatacgttcactggctatcttataggctttagagtcttctcttttacctacagcaataacccatatcacaatatcttcatctatcacctgatagacaagacgaaatccagaagagcgaagctttattttgaagcaacctgccaaatcaccgtgtaatctggcagattcaatatagggattatcctgtagcttccgtagcttctttttaaactgttcacgaatgctgttatccagcttctaccattcttttaaagcgcgttcgtcaaactcaatattaaatgtcatcgagatttacccgaattcgtttggcgggattttttaggcgatcgcgtactacatccaaaatatcttcatcttcatcatgctctgcaaccatcactgatacctcagtaaatggcagtttttcattctctgccacataacgcaggaagagtcgcattgcatcggaaggagatagattcagtttctcaaatgcctgatatgcattcttttttagttcttcatccactctgatctgaattgtgctcatagtgttaccctttgtaatgacacttgtattacattgtatgttacttcacctatgatgcaatgagttttacaaaattttcgtaaagccagccatccgtggcttggggttatactggtaaagactcctgcctgagattatttagaatccgcgagttatcaaaagtgttcagcgtaagatgagcggtcaatctcttaagtattgattgcacctctccggaattccattcgctttctctcggggaagatcaatgaactccgaaattgtccaaatcttgcaagatgcacttgatactggtgttagccagatcgacccaagtatgtcgccagaggatgctcaggccacgttcgaggatggaatggaagaattgagaagattgcttaccaaaaaacaggaagaaatattaaatacagccagagtgtttgcaaagttaaccagctccaacaaaaaagccccgtgatggggctttatgattacattgaagctagattttttgataagagatagaagaacataaccacgaatgcaacaactgcaattataattgtctgcttcttatttttcattttttatccataatgttttgagtaaaaacttttatatattagagtattataagaaagcaatccataaaaaaagcccgtgatggggctgtttggctttcagagaaaactaaaaggcattattcttgttcttgctcttttttacagttagttagatgctgcgttatcccgccataacgtggattaccaatcgtaagtgtcgctatgcggtattttggagaaaaatcttcactaaattcgccatcgtcatatttaaattctctttctgacattagcttcctgccatcccgcgttactggcggcgcagtcatagccatctcatgaccgacataatcacctgatttcatcccatgaattgtcatagccccatttttaaaggtcattttggctttcactaccgttagcgggaaagaatattcacttccttagtctactgctacggcattcattgacagacctattttacaagtataaacgccattaaattcactgtagttatcaccgcaccctattaaggtaagcgctgtacatactattagtatccttttcataacatccttacattttttgcggtaatcataacagttgattgcttaaaataatcacaagaaaagcccgttggggcttctcttggctttcagagaaaatcagctatcacaatgtccttcctttgcaagacgaacacccgcctgagatattaccctttttccttcttcctctgttgatgcactcaaaccagcaccaccaacaaaaactcccatttttatgtattgccttatgaagtaattttttccagattcggtgaaaattactaggtcattaggggagaactctgattcggttgatattttgtggttttggctgcctgatacttgtgtgtagaaaaacgttttatctgctgtttctccaatacacttcccatcaacataaatgtctttttttagagccttaccgacaaagctgtcgcggtagatatataagccagatttgctttcctctggggcagaaaagcttttagcttgtgctgatttttgttcagttgcaagaggtacgctggcacaaccattgagaaacaaagcgcctaaaagagaagctgataaaagtaattttttagtattcatcataaaaaacagaaccttttgtataaaagtaaaaaaactaacctcgcaactgaggttacttagatagagtttgtgtgatggatgtccagttaaaatctctctttaaggcacggatggttttaaagccccgtctgggactgttttctaacgctcaatgacgtataaatcggatttatttatttccattctaatatgagctatcccattaactatcaatgagtttggaggacgaggcgtatcgcttatatcaatcatagcttcgactttaccgcaaaatactttatctcgcccctctgataggatgttcgagggatttgcattggcatcaatatcaaatgtaaccaaacatgttttctcaatccctttatcctgatccattatgataatgttagacaaagattttataaccaaatccgaatatgtttgctcaggtgtcttttgttctttttcgccacaccctgctaatgccattaatgacaacaataaacaaactgactttttcatcacattctcattgttaaatatttcctacatttaaccactgagataatgataagtgttactgattatttgatcagcaatttcagaagtgtgagaggagttacaaaagtcggtcatgactctattttattgatagtgatgaatgttcagataatatcctataattctgtcatgcatttctatggattttgaaaaagacaatgttttgcgagtcagtcttgccaaatgttgacgaagattcaggttatgcttctctatgcgttgggtataacgcttgctggccacatggcgtttccctgcgagtgctttttcgtaatttttccagccatctgtcatataaataataatgttgaaaggtgccagtaaagctaataggcgcattaatgtcttttttgttcttggaccaaaaacatgggcgatcacttttcgtcttatcctgtcgtcggcataaaagagccaacgaggcggcttctttgactttacgtaagaccattgttcatccatttcgcagcagacaatcacttcagtgccaggtttaatcgcttctgttaccgatttgggtttgagttttttaaatgccgaagtacggtattcaggccaatccccatcactcgtgctgtcgcccgacatcccattccattcatagccatatcgacgatttgcttatgggtaccgagacgacaagcggcataagtgaactcctgttgccaggagtgacggcaggattggcaaagataacgttggtgaccagaacgcgagcgcccattgcgatggatccctttcactgcggaacaagaggggcaagttacatcaatctttgccatttgaatgttttccaaatagacagactatacatgattcaataaattgatgtcacgacctacacgaccccagagccggacttcgtagccatccaagccctgtttcttcaaaatcactttctatctcccagcactgatccgtttgaattactacagattaactacaaccccaatgcatatttcagcgccagctttttcatcgcccctgaacgttgtgccgccatcagcgctaaattccgcatggttttcaagcccggcaaatcatagctgaatgcggtgtggaagagatccatacccgcctgcatcactaaattatccggcatcctgcgacgctgataacgcaccaataccgcttgagaatcccactcttcctgtaattctttagcgtttatcagcaccttaagcaaaacctcaacatctcgataacctaaattcacgccctgcccggccaatggattaatggtatgagccgcatcgccaagcaaggccaatccctcacgcacatagtggctggcatggtgacgagtaagaggaaacgaacccacagcaattggagtcactttgcccaagcgggagggaaatgcctgaaagatttctcgctcaagctgtaccatcgtcatcgattgtaattgacgaattcgggcaggagaatcgtaccagaccaatgaagcccactgatcaaacagaggtaggaaagctctcgggccagaagggaaaaactgctgccatgtggtgtcctgctgaggttgttcagttttgacggtaattaacatacatgactgccggtattgccacccattgctgccaataccggccagttgtcgaacctgagagcgggcaccatctgcaccaatgatcagacgcgcattcatttccgtgccatccatcaatgttacttgccatatttgatgtgcatgctgccgttgcatcgatttcagggcggccgggcaaaacagtgtcagattcgggtaacgttcaaactcctgccacagtgccaattgcaggatgtagttctctaccatatagcccaactctgtcagcccaagactttgaacatcgaaagtcacgttggaatcatgctgctcccacgtctccaatttccggtaaggtgcactgcgcatccgcaaaacatggttccaaacacccaattgtttcaataaatccacggaagcgcagctaattgcagatacgcgaatatccggttcattaccttcattataaggctgcggcaactgatgctccagtaacgcgacacgccagccctcttgtgcgagtcccaaagccgtcgctgcaccaaccatacccgcacccacgacgacgatatcgaatttttgctgtggattattcatattcatcacgccattaacttcctgattaaaatagtgtaccggaattttccctttccggctgtgaatatccgatgttacagtctggtcactggtgcctcaaatgactacaatagcctgtaatattatgctaaatacattatgttcaatacactgcgcttttcagtgttgatgcaacatttcactggaaataccggatacataaaatgtcgacgataaaaaaactgtatatcaaaacctggggctgtcagatgaacgaatatgattcatccaagatggccgacttactggaaaccactcacggttatcagttaaccgatgtcgccgaagaagcagatatcttactcctgaacacctgttcaatccgtgaaaaagcccaagaaaaagtcttccatcagctcgggcgctggaagggtttaaaagacaaaaatcccgaaattattattggtgtcggtggctgtgttgcatctcaggaaggggatttcatccgccaacgcgctcctagcgttgatattatcttcgggcctcaaaccctgcatcgcctgcctgaaatgattaatcatgtgaaaggcacccacagtccaatagttgatatcagcttccctgagatcgaaaaattcgaccgaatgccagaacctcgggcagaaggcccgagcgcattcgtctccattatggaaggctgcaataagtactgtacattctgcgtcgttccttacacccgaggagaagaagtcagccgtccttgtgatgatattttgtttgaaattgcccagcttgctgctcaaggcgtacgtgacgttaacctgctcggtcagaacgttaacgcttaccgaggcgcagcattcgacggggatatctgcacatttgcggaattactgcgtctggtcgcggccattgatggtattgaccgcattcgcttcaccaccagccatcctattgaatttaccgatgatattatcgcggtttacgaagacacaccggagttagtcagctatctgcacctacccgtacagagtggctctgaccgtatcctgacccagatgaaacgtgcacataccgcactggaatacaaagggatcatccgccgtctgcgcaaagcacgtcctgacattctgatcagttctgacttcatcatcggtttccctggtgaaacacaggatgacttcgaaaaaaccatgcaactgattgccgatgtgaatttcgacatgagtttcagcttcatctattcagcgcgtccgggaacccctgcggccgatttgccggatgacgtgagtgaagaagaaaaaaaacagcgcctgtatctgctccagcagcgtatcaatcagcaggccatgagcttcagccgcgcaatggttggcagtacacagcgtattctggttgaaggcacatcccgcaaaaatatcatggagctttccggccgtactgaaaataaccgcgtggttaattttgaaggaacgcctgacatgattggcaagttcgttgatgccgaaattgttgacgtgtatgccaactccctgcgcggtaaagttatccgtacagaagatgagatgaatttgcgcatccatgagtcacctgagtcagtcatcgcccgtacccgcaaggaagatgaaatcggcgttggcatttatcagccttaacaggccctaacatagagataatcagtgacacaaataaactcacaagtagcaacacaagagatctttctggaacccgcagataatcaacggctgatgagtctgtgtggcccacttgatgacaacctgaaacaacttgagcgtcgtcttggagtagagatcagccgccgcgacaatcgtttcaaactggtgggtaagccattgtgtgtcagtgcagtagccggtatcctgcgccatctttacgtcgaaaccgcacctgtccgcagcgtgatcccaaacattgaacctgaacagattcatctggccatcacagaaagccgcgtgctggagcaatcggcagaaagtattcctgactacggcaaggctgtgaatatcagaaccaagcggggtgttgtgaagccccgtacgcccaaccaagcacaatacattgccaatatccttgattatgatattacctttgggattgggccagcagggacagggaaaacttatctggccgttgccgccgccgttgattcactggaacgtcaggaaatccgtcgtatcctgctaactcgtccagcagttgaagcgggtgaaaagctgggatttctgccgggtgatctgagccagaaggtcgatccttatttgcgcccgctttacgatgcgttgtttgagatgctgggatttgaaaaagttgagaagttgatcgaaagaaatgttattgaagtggctccactggcctatatgcgtggacgtaccctcaatgatgcctttattattctcgacgaaagccagaataccaccattgaacagatgaagatgtttttaacccgcattggcttcaattccaaagcggtgattaccggtgacgtgactcagattgacttgccaaaaggccagaaatccggccttagccacgcagtagaagtcttgtctgaagttgatgaattaagctttaatttcttccatagcgaagacgttgtccgccatccggtggtcgccaaagtcgttatcgcctatgaagcatgggaatctgcggaacagaaacggaagcaagagcttaatgataaacgcaagcaggaagcgcaatgaattcagttatattagatttacaaattgcatgtgaaaatccagaagggctgcctgatgaagcccttttccagcgctggctggagagtattctgccacaatttcaggcagaaagtgaagtaacaatccgcttggtcgatgaggcagaaagccacgatttaaacctcacttatcgcgggaaagataaaccaaccaatgtgttatcctttccgtttgaagcaccgcctgaagtggaattgcctttgctcggtgatttaatcatctgtcgtcaagttgttgaacaagaagcagaggaacaacaaaaaacagttgaagaacactgggcacacatggtaattcacggttctctccatctgcttggatacgaccatatcgaagacgatgaagcagaagaaatggaatctctggaaacagaaattctacaaaaaatgggttatgctgatccctatcttgcggaaaaaaaataaccgttagcatcatttttatgctaaaaattacgatttacaatattaattaatggggaattttcattcaaacgccatgagcgacgaccatccttcaaataacgatagccctggccctaagaaaggctttcttgcgcttcttaatcaactttttcacggtgaaccaaaaaaccgtcatgatttggttgaactgatccgtgattctgaacagaacgatctgatcgatcccgatactcgagagatgctcgaaggggtaatggatattgctgaccaacgcgtgcgcgacattatgatccctcgctcacaaatcgttaccttaaaacgaaatcaacctctggacgaatgtctggatgtaattatcgattcggctcactcacgctaccctgtaatcagcgaagacaaagatcacatcgaaggcattttgatggcaaaagatcttctgccattcatgcgcacgaatgcagagactttcagcattgataaagtgctgcgtcaggctattgtggtgccagagagtaaacgtgttgaccgcctgctgaaagagttccgctcccagcgttaccatatggcaattgtgatcgatgaattcggtggtgtttccggtctggtcacgatcgaggacattcttgagctgattgttggcgaaatagaagacgaatacgatgatgatgacgataacgatattcgtgccttaagccgccatacttattcagtacgggcattggctcaaatcgaagatttcaacgatgttttcggcaccaatttcagcgatgaagaagttgataccatcggtgggctagtgatgcaggcatttggtcatctaccttcccggggtgaatctatcgacataaatggttatcttttcaaagtagcaatggcagatagccggaaaatcattcaggttcatgtcaaaataccggatgatgctgacgttcctggccttgataaacaataataggatctggatgaacaaagcctcattactgagttgccagcggctgcgcgccttgctggcacttttcttaggagccagtggaacactggctttttcaccttttgatttctggcctgctgcatttctgtcccttttcggcctgcaaattctgacactcaacagaaccactcgacagtctctctttattggtttctgctggggatttggcttatttggcagtggtacaaattgggtttatgtcagcatcgctgattttggcggcatgcccactgtcgtcaatatctttctggttatcctgctatctgcctatctcgctctttatcccactctgtttgctggcctgctcaaccgtttttttccggccgccaacgggatcaggctggtcattgccagtccagcactgtggcaattgactgaattcctgcgtggttgggtattaaccgggtttccatggctgcaatttggctacagccagatcgatggcccaatgaaagctattgcccctattctgggggtagaaggcattaccttcctgatgctaatgatcagtggtctgctggtgcttgccactacccggaaaaaactttcactagctatcgctgcggttattctgctgctactgccgtggccaatgagatattatcagtggtataccctattgccggagaaatctgccgatatcgcactggttcagggcaatattccccaagtcatcaaatggaatccctcagaactggaaaatacgctggacacctatctgaataatagccgtccttttattggtaaaatacccatcatcatctggccggaatctgccattactgcttacgaaatcactcaaggtaatttcctgaccgaactggattctttgctaagacagcgtaatacccgcctgattaccgggattcctgatgctcgtcccacattggaaggctataaattctataacagtattatcgtgttgggagataaaacaccttaccgatatccagcaccgatccgctatgataaacatcatctcgttccgttcggtgaatttgttccgctggagtcaatattgcgcccattggcccccttcttcaatttgccaatgtcttccttcaatcgtggtggttatatacagccacagctttctgtagcagggcataacataactgctgcaatctgctatgaaattattttgggcgaacaagtacgtgataatttaaagcccgatactgaatttttactgacaatttccaatgatgcctggtttgggcgctctattggcccgtggcaacatttccaaatggcacgaatgcgctctcttgaattgggacgcccattgcttagaggaacaaataacggtattactgcggttatcaggccagacggctcaatacaagccagacttccacagtttacccgtcaggtgttggaagctaaggttactccagctagtggtaacacaccttattttcgcgttggttattggccgatatggggattagcactgctgttcattagcttcggattgataagcaaccgccgccgaacttaatttcctattcagtagatccctcaatagaagataagggtatattatttatacccttatcttctctatgcctaatacactccacagaaaaccccaataaaatgcaataattcattacatttaccacaaatttaaccaaatacactttatattattcttaataagaattaaatttaaacatattgacctaaaaattacaaactgtgaacagagtccaaaattattttctctttaatcgtacataagtaaaattgtttatttatagtgcgaggcaggtcgcgaaacagaaacattatggtttcaaaaaactaacattatgaattacttttttacagcatataaacaaaaagattcaggaaatcgtttctacaaaaatgtaaacgccactatctgcaagcaaacccaatcttcaaagaataacccgataaaggagctgtatatgcgtaagttgatgttaaccatgatgttgcttagcgcggtaggagctgcccatgctgaggaattaactggaacactgaaaaaaatcaaagacaatgggattatcgttgttggacacagagaatcttctgttccattttcttattacgataatcaacaaaacgttgtcggctatgctcaagattattccaacctgattgttgatgccgtcaagaaaaagctggatatgcccaacctgcaagtcaaattaatcccgattacctcccaaaaccgtattccgttgctgcaaaacggcacttatgattttgaatgtggctctaccaccaataaccttgagcgccaaaaacaagctgcattctccaacactatctttgtcgtcggtacgcgtctgctgaccaataaggattcaggaataaaagggtttgacgatctggccgggaaacacgttgtcgttacgtctggtacaacatctgaaattctgctgaacaaactcaatgacgagaagcaaatgcagatgcgtataatcagtgccaaagaccacggtgattcattccgtactctggaatcaggccgtgctgtcgctttcatgatggatgacgcattgctggcgggcgaacgcgcaaaagcgaaaaaacctgatcagtgggttattgttggtaaaccacaatcagaagaggcttatggctgtatgctgcgcaaagatgatcctcagttcaagaaattgattgatggcacgattgtgaaagtacaaacctccggtgaagcagaaaaattctttgatctctggtttaaacaaccgattccacctaaaaaactgaatatgaacttctccatgtcagatgagatgaagaccttatttaaatcaccaaatgataaggctttaaattaatgaattaactaaaaacactcgattttattggcacgatgggggtgaggtagtcgttccctacctcattttttagcctgttcttttgagtcaatgagttaccactaatagaacgttttaggcgtgacagccaaccccatttcagggagcacgattatgtctgttgattggaattggggcatctttctacaagctgccccttttggtaataccacctatttggggtggcttatttctggatttcaggtgacggttgcactttccgtctgcgcttgggttattgcgctcgctgttggatcgttgttcggtatcctccgcaccgttccgaacaaatttctagcaacattaggcgcttgttatgttgagctattccgcaacattcctttgatcgtccagttttttatatggtatctggtggtaccagaattcctgcccaaaaatttgagtaattggttcaagatggaactggatcccaatattcaattttttatttcctcggtaatctgtctggggctattcactgccgcccgtatctgcgagcaggttcgagctgccatccagtcactgccacgggggcaaaaagccgcaggccaggccatgggcctgactctgccacaaacctaccgttatgtcctgctgccaaacgcctatcgtgtcattattcctccgatgacctcagagatgcttaatctggtgaaaaactctgctattgcctccaccatcggactggtggacatggcagcacaggcaggcaaattactcgattattcagcacatgcttatgaatcatttacggcgatcacgctagcttacgttggtatcaatctggtgatcatgcttgccatgactctgcttgagaaaaaagtgcgcttgccaggcaatcttggagggagatagaaaaatgtatcagtttgactggagttctattattcccagcttgccatttctgctgaatggattggtgataaccgccaaaattaccgtgatagccattatcattggcattgcttggggaaccttgctggcaatgatgcgcttatcttctatcaaaatactgagctggtttgctactctgtatgtcaacctctttcgctcagtgccactggtgatggtattgctgtggttctacttgattgtgccgaacttattacaaaatgttctaggcatatcaccaagaaccgatatccgtttaatttctgcaatggtcgcgttttcgctatttgaagcggcctactactccgaaatcattcgggcgggtattcagagtatttcccgggggcagtcatctgctgcgctggcgctgggtatgacccacatgcaaagtatgcgtctgattatcctgccacaggcattccgcgcaatgatcccattgttgttaacgcaaggcattgtattatttcaagatacatcgctagtatatgtactgagtctggccgattttttccgtacagcaacgaatataggtgagcgcgacggtactcagattgaaatgattctgtttgccggcgttgtttattttgtgattagttttgccgcttccatgctagttaactatttaaagaaaaggactgtttgatgatttccctgaaaaatgtatccaagtggtatggccaatttcaggttctgactgactgctcgactgaagtcaaaaagggcgaagtagtcgtggtctgtggcccctctggctccggtaaatccacactaataaaaacggttaatggccttgaacctgtccagcagggtgaaattcgggtaaacaacacgccagtcaatgacaaaagcaccaatctggctcaattgcgttctaaggttggcatggtgttccagcattttgagctgtttccccatctgtcaatcattgagaacctgacactggctcagattaaggttttgaaacgcgataaaaaatccgccaccgaaaaggcgttgaaactcttggagcgagtcgggttgaccagtcatgctgataagttccccgcacaactttctggtggtcaacagcagcgtgtcgccattgcccgtgcactctgtatggatcccatcgccatgctgtttgatgaacccacatcagcgcttgatcctgaaatgatcaatgaagtactggatgtgatggttaagctggctaatgaaggcatgaccatgatggttgtgactcatgaaatgggatttgccaaaaaagtggctcatcgcgtcattttcatggatgaaggaaaaattgtcgaggacagcaaaaaagaagatttcttcgccaatcctaaatcagaacgtgcccgtgattttctggcgaaaattctacactgattttctccctgtcggcggataacacgacttccgccgaccttaatctgctccgaaaataggtaaatttcagcgatctcactttaacaagtgttgttgcccctatcccttatcagctatgctatgaggtcttagatttcataaacaaactatgcgcgttacaggcgcagctttattactcaccataggattatcggtgccatgcaagaacaatatcgtccagaagacatagagcgacaagtacagcttcactggcaagagaagcaaacttttaaagtgacagaagacagtaacaaagaaaaatactattgcctgtccatgctaccttatccttctggccgactacatatgggccacgtccgtaactacaccattggtgatgtgatttcccgttatcagcgtatgcttggcaaaaacgtcctgcaacctattggttgggatgcattcggtctgccggcagaaggcgcagcggtcaaaaataataccgcacctgctccatggacctattccaatattgaatacatgaaagcccagctgaaaactctgggatttggttatgactgggatcgtgaagtcacaacctgtacgccagaatactaccgctgggaacaatggttcttcaccaaactgtacgagaaaggtctggtttataaaaaaacctctgccgtcaactggtgtccacatgacctgaccgttctggctaacgaacaggttattgacggctgttgctggcgctgtgatagccaagttgaacgcaaagagatccctcagtggtttatcaaaatcactgcctacgctgaagaactgctgaacgatttggataagctggaagattggccagagcaggtcaaaactatgcagcgtaactggattggtcgttcagaaggtgtcgaaatcacctttaatgtggctgacagtcaggaaacactgacggtttatacgactcgtccagatacatttatgggaacgacctatgtcgctgttgcggcaggtcatcctctggcaaaacaggcagcagaaaataatcctgagctggctgagttcatcaacgaatgccgtaataccaaagttgccgaagctgatatggccactatggagaaaaaaggtgtgtcaacaggcatgtttgcaattcatccattgaccaacgaaaaaattgctatctgggtcgctaactttgtcctgatggaatacggtacaggcgcagtgatggcagtcccagcccatgatcagcgcgactgggaatttgcaaccaagtacaacctgccaatgaaaaccgtcattctggacaacgacggcaatgtgccaaccgttcaggaaggtgcagctaccgataaaaacgcactggttaattccggtgagttcagtggactgagcaatgaagaaggcttcagtgctatcgcagataaactggtcgagatgggggctggcaaccgtaaggttaactatcgtcttcgtgactggggcgtttcccgtcaacgttattggggggcgccaattccaatggcaacactggaagatggcactgtcgtccctgttccagaagatcaactgccagttatcctgccagaagatgttgtgatgaatggtatcaccagcccaatcaaagcagatcctgagtgggccaaaacgactatcaatggtcaaccagcgctgcgtgaaaccgatactttcgatactttcatggagtcatcatggtactacgcacgctatacctgcccagattatgacaaaggtatgctcgatccggccgctgctaactattggctgccagtggatcaatacatcggtggtattgaacacgccatcatgcacttgatgtacttccgtttcttccacaagctgatgcgtgattctgggatggtcaattctgacgaaccagccaaacacctgctgtgccaaggtatggttctggcagatgcgttctattacaccggcaacagcggcgaaaaaatctgggtatccccagctaacgcgattgttgagcgtgatgataaaggccgcatcgtgaagtcggtggatcaagacggtcatgagctggtctatactggcatgagcaaaatgtctaaatccaagaataacggtatcgatccacaaattatggtcgataaatacggcgctgataccgttcgcttgttcatgatgtttgctgcgccaccagagctgacactggaatggcaggagtctggcgtagaaggcgctaaccgcttcctgaaacgtgtctggcgtctggtttatgagcacagcagcaaaggtacaacccagccgctggatatcgccagcctgacgactgaacagaaagatttgcgtcgtgacttacataaaacccttgcgaaagtcaccgatgatatcggacgtcgtcaagcattcaataccgccgttgcagctatcatggagctgatgaacaaactgactcgtgtcccacaggaaaccgagcaagatcgcgctttaatgcaggaagcactgactgcggttgtacgtatgctttcccctatcacgccacacgcttgtttcgtgatgtggaaagaacttggtaatgaaagcgatattgacacggctgcatggccacaggctgatgagcaggcaatggtggatgataccaagctggtcatcatccagattaacggtaaggttcgtggtcgtattaccgtacccgcagatgtgacaaaagagtatgttcaagagatggcggcaaaagagtacagcgttgcgaaataccttgaaagcatcagtattcgtaaagtcatctatgttccaggcaaattgctgaatctggtcgtcggctgataacaggagtccatattttggtaggaaataatgtgcggcatggtattttcacgttgtttctggggttagcggtgctggtcaccgctggctgtggttttcatcttcgtggcacaacacaggtaccaaaagaacttcaaacattacaattaagttcagctgatccctacgggcctctggccagagcagtacgccagcaacttcgtctgaacgacgtcaagattgttgaacgtggcgatgcctcagtaccgatcctgaaactcttgggctctaatgagcacaaagagaccgcttctgtatttcaggatggtaaagcggcggaacgtcaactagtcctgtatgttgatgctcaagtgcttatgccgaatggcggtatctatccattgcgggcaagagttgatcgttctttcttcgataacccgctggaagcactggcaaaggatgcggaaaatgaactgattcagcaggaaatgcgtgagcaagcagcccaccagcttatgcgccagttgctaactgttcacagtgcagaactcttgaaaactgaagaaaaacagcaagcagcgactgcacaaaaacaatgatccgactctatcctgaacaactcctttcgcagctcaatgaagggctgcgaaacaattacctgctatggggcaacgagccgttgctgttgcaggaaagtcaggacagcatccgcagagtggctgaacagcatggctttctggagcatttcaccttttctctggataaccatactgaatgggatgaaatattcagcctgtgccagtcactcagcctgttttcctctcgccagtcacttaccctgctactgccggaaaatggcccaaatgcagcaatggtagaacggctaaccaagctgtctggattgctgcacgcagatatcttattgatattacgtgggcacaaactcaccaaagcgcaggaaaacagtccgtggttcaaaacacttgggcagaatggtgtgtacgtcagttgtctgactcctgaacaaaaccgtcttcctcaatgggtggcacaacgagccagaagcatggggctatcactggaagatgaagctaaccaactactgtgctattgctatgaaggaaatttattagcactggctcaggcactggaacgtctttctctgctccatcccgataatcggctgacgcttccccgagtcgaagaagctgtcaacgatgcggcacattttgccccctatcactgggttgatgccctgctggcaggcaaaatcaaacgggcgtggcatatactgaaacaacttcgacaagaagatactgaatcgatcatcctgcttcgcaccatacaacgggagctgatactgctgttaaccctcaaacgtcaggataagacaactcctttgaagacactgtttgatcagcacaaaatttggcaaaaccggcgatcactgctgacagccgcattacagcgcttgtcacagcaagatcttcaatcagccatacatttgctgactcagatggaactgtgcgtcaaacaggattatggccaatcgatttgggctaacctggaaacactttccatgctgttatgcggaaaaacattaccagagagcttcttgaatgcttcattccactgattcaacaatagacccgagttccccgattattcaggcgctgtttggtggcacattcgatcccattcattatggtcacttgcgccctgtggaggcattagcgaaacaggtggggctaaaacaggtcattttactgccaaaccatgttccgccacatcgtccacaacctgaagcaaccgccagtcaacggttggagatggttcgtctggccgtacaggacaacccgctttttaccgtcgatacccgtgaactggaacgtcagacgccctcttatacgatagaaacgctgaaatcctttcgtcaagaagtcggcgaacaacggccactggcattcatcatcggacaggattcactgcaatccatccatacatggtataaatgggaagaattactgggtatctgccaccttctggtctgctcacgtccgggttatcaaagccaactttcaacctcagatatgcaaaagtggcttgaacagcacaaaattgacactccgatatcattaagacaaaagccacacggttgtatttatctggccactactccgttattaaacatctctgcaactgatatccgtcaacgccatcagcaagggctgagctgtgatgatttactgcctccagcgatacaaaattatgtcaattcacaggggctatatcgacaataacgaaaacatactgtgatttgccgctgagtcgcttacttttacagagattggcatgctattattctgcattattcaaccaatttgatgaaattaaggtgatccttttgcaaggcacagaactacaaaaatttgttattgataaacttgaagattccaaagcacaggatattgtttctatagatgttcgtggaaaatccagtattaccgactgcatggttatctgcacaggcacatcaacccgtcacctgatgtcagtggcagacaatctggttgatgactgccgcgaagccggaattatgccactgggtgttgaagggcaaggcatctcagactggatagtcgttgacctcggcgaaataatgatacatgtcatgcaggaagacagccgtcgcatgtatgaactggaaaaactctggagttgagtttgaagttacaattggtcgctgtaggaacaaaaatgccggactgggttcagaccggctttatcgattatttgcatcgttttcccaaggatatgccttttgagctgattgaagtcccagcaggaaaacgaggtaaaaatgccgacatcaaacgtattcttgaaaaagaaggcgaacaaatgctgtcggctgtcggcaaaggcaatcgcattgtgacactggatattcccggatctcattgggataccccacagttagcacaacagctagaacgctggaaacaagacggcagaaatgtcagtttgcttattggtggcccagaaggtctggctccggcctgcaaagctgccgcagcgcaaagttggtcactttctccactgacgctgccacaccctctggtacgggttctggttgctgaaagcctttatcgggcgtggagtatcacgactaatcacccctaccatcgggaataaattgggtaatctatcaccgtgaattctggcaatgggatgaagaataaacgaaccccttttcgcgatcatacggctgaatcagccctttttatgcgccgcgcactcgtggcgttcattggcattatcattttaacgggaattctgattgccaatctttataatctccagatcattcgccacgaagattaccagacccgctcaaatgggaaccgcattaagctcgttcccattgctccaagtcggggtatcatttatgatcgtaatggaacaccattagccactaaccgcactatttaccaattagaaatcattccacagaaaatcgataatcttgacaaaacgctggatgaattgcgcgccatagttgatctgaccgatgaagatatagaaaacttcaagaaagaacgtcaacgcgcacgtcgttttacctccgttcctttgaaaacatccctgaaccaagtacaggttgcccggttttacgtcaaccaatatcgttttccaggactggaaatcaaaggctatcagcgtcgcgagtatccttttggttctgctctcacccacgtgattggttatgtcgccaaaatcaatgataaggacgtagaaagacttgagaaagagggtattctcgctgactatgcagctacccatgatatcggtaagctgggcattgagcgctattatgaatcaactctgcacggcaaacccggctatgaagaagttgaagtcaacaaccgtggcagagtgatccgacagttacatgaacaacccccacaggcaggtaaagatgtttacctgtcgatagatttgagtctgcaaaactatattgaacaaatcctgacaaccagccgggctgctgtcgtggtcactgatcctcgtactggtgaagtgttggcaatggtatcgaacccaagctatgaccccaacctgtttgtggatgggatttccagtaaggattataaaaatctgctcaacgatcctaaccgtccgctaattaaccgcgcaacccaaggggcttacccaccggcatcaacggtcaaaccttttattgcctctgcggcactgagtagcgatatcatcacaaagaataccacgatattcgatcccggctggtggcagctacccggttcagaaaaacgttatcgtgactggaaacgctggggacacggtaagctgaatgtgcataaagctatcgttgaatcgtcagatacttttttctatcaagtagcctatgatatgggtatcgaccggctttccgaatggatgtcaaggtttggttatggtcaatttacgggtattgatttgagggaggaaactcccggcaacattccaacccgagaatggaaagtgaaacgctataaaaaaccgtggtatcaaggtgacaccatttcggtcggcatcggtcagggatactggacagccacccctatgcaaatggtgaaggctctgatgacattaatcaatgatggggaagtaaaaacgccacatttcttgctggggactcgcgtgaatggcgaaatgcatccttaccaacctcctgtaaatcattcgattggtgatatccattcaggctactgggaaattgccaaagatggcatgtacggtgttgccaatgccccaaacggcaccgcacgcaggttctttgccggtacaccatacaaagcagccgtaaaatcaggtaccgcacaagtattcagctatgaaacctataatgcaagcaaactggcagaacatctgcgtgaccacaaactaatgatagccttcgcgccctatgacagcccaacagttgccatttctattattctggaaaacggcggctcaggacctgcggttggaacgataatccgtcaaatcctggatcatattttaatcaaggatagcaagcgcatcactcccgttgcagctccggccgtaaccggaacacaagctaattgagtaacgccatgacagactctcagaaaaaggttcctttctggaccagagtacatatcgatatcccactgctgctgtgcattctagcattgctagtctacagccttttcattatgtggagcgccagcggacaagacgttgacatgatggaacgtaaagccgggcaagttatcatggggctgatagtcatgatcgtcttggctcaagtcccgccacgcatatacgagaactgggcaccttatctttatattggatgcgtgttcctgctaatccttgttgatgtttttgggcaaataagtaagggtgcgcaacgttggctggatctgggcattgtgcgcttccagccatcggaaattgctaaaattgccgttcctttgatggttgcccgtttcatgaaccgtgatctttgccctccctcgttgaaaaatacggggattgcactgattctgacattcttgcctaccctactagtcgccgcacagccagacttgggaacttctatcctgattgccgcctctggtgtattcattctgtttctggcaggaatgaactggcggttaatcaccattgccattttactgattgcctgttttcttccaatattgtggttctttttaatgcatgactaccaacgtgccagagtcatgatgctgctggatcctgaaagtgatccgctgggtaagggctatcacatcatccagtccaaaatcgccattggctcaggaggggaatttggcaaaggctggttgcaaggaacacagtcgcaattggaatttctacctgagcgccatacggatttcattttcgctgttctctctgaagagctggggctggtgggtgttcttgtcttgctggctctctatctgctgctcatcatgcggggtttggttattgccgccagagcacaaaatacttttgggcgggtgatggcgggtggtttaatactaattctatttgtctatgtcttcgtaaacatcggcatggtgagcggtatcctgcctgtagtcggcgttcccctaccgctgattagctatggcggctcggcattaattgtcttaatggcaggattcggcattattatgtcaatacatacgcatcgcaagttattgtccaaaagcttataaggaagaggtttcatgcgtcaacaatggcttatactcggcatcgtggctgtactgatatcaggctgtacaacaacaggtaataaaagggaggactcctccattcctcctgttccaacccgtgaggtattgggtgcagaacctcaatatgagccttatcatccaagtgccaaccaagactatcaaagggatgggcaaacctatcgcatcgtgcaggactcagctaacttcacccagacgggttatgccagtgggttcggtgaagaagcgaatggaaaactgacagcaattggtgaacgggctagtccttatgctttagcggctgcgcaccccacattacctattccaagctatgtgcgggtcactaatttgagcaacgggcgcatgataattgtcagaattaatgaccgtggcccttacaataagccgggcaaaatcattgaattatcgcgggcaacgacggaacgcctgaacctgatgccacaaagcagagtcaaactggatggaattcaagttgcacctgatggatcaatttctggcttggggacagaaggcgcgattatcgtcaaacaaagttatgctttacctgacagacccgatattggcgcaccagctatgatggacagcccatctgaacaaaatatcgcagagcaaaatacggtgagccaacctgctgttgagcagaatctgtctgggaatacagaaaatccgtttctcacttcaccgtccgcaggaacaccatctgcaccaaagcaatcagagacaaaatggatattgcagccacagactgaacctgttgcgacttcccccgttatacctgaatctgccgccacatcaacgggcggtttcatggtacaagttggtgccatcagttctgaacagaaagccaaagagtggcaacaatcattaagccagcgctttaatgtacagggccgtgttatgcaatttagtaatatctatcgcgttcaactggggcctctcagtcgccagcaagcaacggaactacaaaagaaattaactgaccagatgcatcaatcctcctttattgttgccccctgattagccaatcacctgctgatattcgacaattccgtcaatatcagcaggtggataaaaaaacaaccgggtaaaaaagtgtaaaccttcaactcactcaattttgtttaatgtcagcttttttatcatttgttattatgtcgcttattatcaatccctttctcacggatgctacctaatcaatcatgaaatacatagttacttcccgttttattaaaaatgccactttaggcatcgctctggctaccagcgcttctgcattcgctaacacggatgataatttcaaaaccatgatccccggcgttccacaaaccgatgcagaagcctatattctgattgattacaactcaggtaagatattggcagaaaagaattcagatatccgacgtgatcccgccagtctgacgaagatgatgaccagctatgtgattggtcaagccatcaaatcagggaaaatcggtccgaatgacaccgttaccgtcggtaaggatgcttgggcaacgggcaatccggtgtttaaaggctcctcactgatgtttttgaaacccggtgatcaggtttctgttgccatgctatcccgtggtatcaacctgcaatccggtaatgatgcctgtgtcgcaatggctgactatgtcgcaggcagtcaagatgcgttcgtcaacctgatgaataagtatgtgcagaatctagggttgcaaaacacacactttgagactgtccatggcctagatgcagcaggccaatacagttctgcccatgatatggcactgattggtcaggctctgatccgtgatgtaccggatgagtatgccatctacaaagagaaagaatttacttacaacaatatccatcaacccaaccgtaacgggctgctatgggataaaagcctgaatgtggatggcatcaaaaccggccacaccagtggcgccggttacaaccttgtttcttccgccaccgaaagtaatatgcgcctaatttctgttgtcatgggcagcccaacattcaaagggcgtgaaaccgacagcaaaaaactactgacttggggattccgcttctttgaaacggtctcaccattgcaggtaggtaaagaatttgcctcagagccagtctggtttggtgatgctgataaggtacaattgggcgtcgataaaaatgtttatctgactattcctcgtggccgcctgaaagatctgaaagccagctacgtattgaacaataccgaattacatgccccactcgccaaagatcaagtcgtcggtactatcaacttccagcttgatggtaaaaccattgaacaacgtccattggtcgtgatgcaggaaatcaaagaagggggtttcttcagccgtatgatcgattacatcaaattgatgttccatcattggtttggttgatcccttgaaaggtaagcattgaaccttatattagtcactaattgttagaaaataatcacgccacggcaaaaactaccacattgccgtggcaagtaaactaggagtgcccatgaaaacaaaattaaatgaactgcttgagttcccctgctcattcacttacaaagtgatgggtttagctcaacctgagctggtggatcaagttattgaagtggttcagcgccatgcgccgggcgattactccccagtggtgaaaccaagcagcaaaggcaattaccactcggtttccatcaccatcaatgccacacatattgagcaggttgaaacgctgtatgaagagttgggtaatttggagctggtgcgagtggttctgtgattaaacagccacaacgtgattgattaagtatttaatgccccagtcggggcattttaaaagccacaattcatggtgaaactcatcaaatcatgcgtgatcatcctcggatgaagatttcgaccaatacgccatgaaattgattaatgaacgatctaaatgacgtccctgaagcaaatactgatgcagtttctttgatagtttgaatcaatatgatcaactatatatcaaacacaacccgctcgtgtttactgccacctcaaaaacgccagaatgccttcgaacagaggatcaggatcggataaatttcaagacgccccaataacatggccgcacacatcatccatttcgcgatagcatcaagatcaccaaaaccttgcgcggttgcgccataaccgactcccatattattgatacaggccgcaacggtagcaaacgaggttactaaatcataacccaacaaattcaatgcccagataaaaaaacaactgaaaaaaacatacaaaaagaaaaaaccccagacggagcgcaataccctttcatgaaccgaagactggccaactttaatcgttgaaatggcattcggatgaacaagttgattaatttcgctgatactctgctttgccagaatcaggaaacggagtgccttaataccgccacacgtcgatcccacacagcccccaaagaaactgactgccaatagcatcaatatcgtgtgagagggccattgggcataatctgaagtcgccagaccattatcggtcatcatggaactggtcatgaaaaaaccatgaacgaaagcttccttcacaccatacatacccgagcgatataactccagccagataatgcaaactaccgccgccagtaccagcagaaaaaatttcagttcggcatttttcaatagtggttttaggcttctgcgtgtcagtgcaacaaaatagagcgtaaagttgactgccgccaataccgagaaaataccccccaccatttcaatagcggcactgtcataataaccaaggctttcattgcgggtcgaaaatccacctaaagaaacggtcgaaattccatgacaaacggcatcaaaccacgacattcccgctactttaaaactcaccgaacataaagcgcccaacagcagataaaccagccataaacttttagcactatcggcaaggcgaggggtcaggcgctcttctttaaaggggccaggcatttctgattgatagagttttaccccaccaataccgagcaatggcagaatcgcaacagccagtacgataactcccaatccaccaataaaattaagctgtgcacgataatagagcatagacttgggtaatgcagacacatcattcagtaccgttgctcctgtcgttgtaatacccgacacaccttcaaacaccgcatccacaaggttgatattcaggcttttatcaaggacaaaaggcaaagcactgagcagcgaaaagagcagccagaacagcacgataataagaaatccatcttgggtactgggttgtgctttggttttgcgggtaaaataccaaccaacgcttccgatactcaatccaatgagcaacgtatcaaaaaaggcaaacacacttttttctttataaaatagtgcaacaaaaataggcagcaacatagagaggctgtaaaggagcaccagaaaactacaaagatgccccacaatcaggagttggttttttctgaccatctgttagctcaaacagagattaaaggagaaatcatcgaaatatataaccatcataatataaaatttaaatatattcgtctaattaacaatattagtgcattaaagcattctcaaactggtgggaatccttttagggcgttatactggcggataattttttgttaacgaatgatgaagtttccattgcaacataacaccgttattttacgccagttgggtatccagccttacgaaccagtttctgatgctatgcaccagtttactgagcaacgtactgcggaaacatctgatgaaatctggctcgtccagcacgaaaaagtgtttacgcaaggtcaggcaggtaaagccgagcatgtgcttacgccaggtgagattcccgttattcaatccgacaggggcggccaagtaacctatcatggtcctgggcaacagatcatgtatgtcttagtcgatttaaagcgggcaaaaattggtgtgcgtcagttggtgacggcaatcgagaatgccgtaatcgaaaccttggctcattttggtgtagaagcgcatgcccgtccagatgctccgggtgtctatgtccagaacaacaaaatatgttcacttgggctgcgtatccgtaaaggatgctctttccacggtctggcactgaatattgcaatggacttacagccatttttacgcattaacccatgtggttatgcgggaatgcagatgactcaactcagtgacctcgcagcagaggtcactgttgaagatgtacaacctgttctggtggaaaaattctgccggatcttgggatttcaactaatcaatgaaagatgatataattttttaacatttttcaaaaaaaattgaatggatttattgatctgatggctctgacatagggattagacaataaatcaaaatctgaagaatataactggaaccggcacgattatgagtaaaccaattcagatggaacgcggtgttaaatatcgcgacgcagataaaatggctctgatccctgtaaaaacagtggccacagaacgtgaagcactcttgcgtaaacctgagtggatgaaaatcaaacttcctgcggattccagccgcattcagggcatcaaagctgcaatgcgcaaaaatggcttgcattccgtctgtgaagaagcctcctgccctaatctggccgagtgctttaaccacggaacagccacctttatgatccttggtgcgatttgtacccgtcgctgcccattctgtgacgtggcacatggccgcccgactgcaccagataccaatgaacccactaagctcgcgcaaaccattcaagatatggctctgcgttatgtcgtgatcacctctgttgaccgtgatgatctgcgtgatggcggcgcacagcatttcgccgactgtatctctgccattcgcgaaaaaaatccatcaattaagatcgaaacactagtacctgatttccgtggacgtatggatcgtgcgctggaaattctgacagccacaccacctgatgtatttaaccacaatctggaaaacgtaccacgggtatatcgtcaggttcgcccgggtgctaactacgagtggtcgttgaagctactggaaaaattcaaggaaactcatccaaatatcccaaccaagtcaggtttgatggtgggattgggcgagaccaacgaagaaattttagaagtgatgcgtgatttacgtcgtcatggcgtcaccatgctgacattaggccaatacttacagccgagtcgccatcacctgcctgtccagcgttatgtcagccctgctgaatttgacgagatgaaagaagcagcactggagatgggctttacccacgctgcctgtggtccatttgtccgctcctcttaccatgctgatatgcaggccaaaggcatggaagtcaaataacctacctaccgtcaccatcatgataaatattatttttgctgtatttataggtggtggcttgggcagtgtattacgctggttaattagtctccgcctgaataatgcctctactcctcttgccgttggtacgctgacggctaactgcgttggggcatttatcattgggttgggactggcttattttaataaggccacacatcttgatccagtttggtaattgatgctaaccacgggcttctgtggatgagtaggttctaaatcaagttgaacttaaaaacataaaaaacccgttgtaataaacgggttttcaaaatacggggatagaaattagattgggacaacgtttgcagcagatggacctttcgcaccctcagtgatttcaaactcgactctttgaccttcagccaaagttttgaaaccattagactgaatggcggaaaagtgtacgaaaacatctttgctaccatcttctggagtgataaaaccgaatcctttggattcattaaaccacttaacgttacctttaatttttgacatcaaacttacctttaataaataagacacaaactctgtatcacacacagtacaacaataatatagtctactgtctgtaacgtagatcacgaaatatataacaaaatgtgaaaaacgcacgttttgctttatttcataaagttattttatactttagtagctatttcataaataaactagtattttgttcaactctgtttagctttaatttttttattcttttcatgttccagcagccatcctttgatatccagcccaccagtatagccgactaacttaccatcatgcccaatcactcgatggcaaggtacaatcagggaaatgggattacgtgagtttgccattcctacagcacggcaataattaacggatcccaaagtcaatgccaattgtttataactccacatgtcgccaaaagggatgttgcagagctgctgccagactcgcttctggaattctgttcccttcatgctcaaaggaaccgtgaatgtatgtcgttttcctttgaaatattcctgtaactcttttacacactgcttagtaatcgtgtttttagattctaattctttcttttcattaacaaagtagatgctagtgactccttcatcatctgcagtgatatgtacataaggcttaggaaagccttctggagtattcaggtaatgatgatacataaactacctccatttaatttattgttaataatttctatactagcctaaatctctccttcatcaatttgcaatgatgaattcagttacacatctgacaatttgataaagaaaccattccgccctctgacaataaaaatcagaggattgccaatctaattgaacaccctatttttaatgaggttcaattaaaaaagataaagatactatatatagtgtcttttataaaaaaagacaacgtatattgtatttatttcataaatagattatccgaatataatacaaagatgttagtttttattattagctacagcgatactcagaaagtaattttaccagaagcgttatcatttatggcaaacacagttgtgttcggtacaattttgtctgcctcctctacaacgcaagatctgtctgatgagatatttaagtaattactatactgtgtctaataaatttcaagttgcagtacggtaacgaattcccaaagcatagatatagataacaatgtggctagagtaagtgaaagctgtcataataaattaaaatatcttatttattccaatatttttattgccagtgaaatcaaaatacagattaattcaaatttcctgcaatatttcaaaaatcgacacatcaaaaaaaataaaaaacaattatataacagatatatatatcactaatgccacctaaaatacgtttttatcattacatatttactttcttaaaaaagattaaaaatcaaattgcagtcacaaacattacgccataataaatgtctatttgattaataattctaaacaaggggttgtcaacatatttcagtgtgctagggtagatatgtgaaaaaaatgattcggagtaataaagaaaatatatcattaacaaacggaaaatatttattgcatgacaattaaactcgaagttagaaatctatataaaatattcggagatcatccagaacccgcatttaagttattagaatccggttttaacaaggaacagatttttgaaaaaaccggtctggcgattggagtgcaaaatgccaatctggccattgaagaaggcgaagtatttgtcatcatggggttatccggttcaggtaaatctacgctggtacgccttctcaatcgtctgatagaacccaccagaggtcaggttatcattgatggaaaagatattgctgctatttcagacacccaactgagggaggttcgccgcagtaaaatcagtatggttttccagtcatttgcactcatgccccatttaaatgttctggaaaataccgcgtttgggatggaacttgccggtattcccaaaaaagagcgtcactacaaggcacttgaaaccttgaaacaagtgaatctggaaaactatgctctgtcatatcccgatgagctttccggcggtatgcaacagcgtatcgggttagctagagcattagccaatgatcccgatattctgttgatggatgaagccttctctgctctcgatcctctgatccgcaccgaaatgcaggacgaagtactacgtctgcagggcgagcaccagcgcacgattatctttatttcccatgacttggatgaagcaatgcgcattggtgatcgcattgcgatcatgcaggggggcatcattgtacaagtgggtacacctgatgagatcctgaataatcctgccaatgattacgtcaaaacgttcttccgaggtgtagatattagccatgtattctcagcaaaagatgttgctcgtcgtcggcatgaagctctgctccatatagccacaggttttggccctcgctcggctctgaaagttctggatgatgaagacaggaattatggatatctgatcgaaaaaggccaaaaatttattggcgtggtttcggtctgctctttacaaaaagcgctgacagaaaagcaaccgattgaatatgccacgttgaaagaacccgccgccgtctcggctgatatgccgctgcatgaattgatatctatcgtggcgcaatccccctgtgctgttcctgttgtgggtgataatgaccgttatttaggtgtcatttccaaagggatcctgttacaggctttagataaggaaacaccgaatgagcagtaaaaccctacagacagcatctgatcaggcaaccttcagtgatccttggatcaatagtgccacagtcgatccatcatcaaataatgattggctggatacttccgcaactgagatttcatcagaacacttcaatattatggcgccttttcagcataaattgattccgtttgattcatgggtaacccacgctattgactggctcgtcctgcatttccggcctatttttcagggtgtacgtattccggtggattttatcttaactgggtttgaacagtttctgatttccatgcctgctcccgtgactattctgattttcgcactgcttgcgtggcagcttacaggagcgggaatgggggtcacttccttcatttcactgatcctgatcggtgctattggtgcatggtctgaagccatgataacactggcactggtgctcacggctctgctgttctgcattctcattggcttaccgctcgctatctggctagcacacaatgaacgggttgcccgaattgtccgccccttgctggatgcaatgcagacaacgccagcttttgtctatctcgttcctattgtgatgttgttcggcatcggtaatgtgcctggggtcatggtcacgatcatttttgccttgccgcccattgttcgcctgacaattttagggatcaaacaagttccggcagatctcatcgaggcagcccaatcctttggtgcaagtccacgccaaatgttgttcaaagttcagcttccccttgctatgcctacaattatggccggcgtgaatcagacattgatgttggcactctccatggtcgtcattgcctccatgatagccgttggtggtttggggcagatggtattgcgcggaattggccgtcttgatatagggctggcagccgttgggggcgcaggaattgttattcttgccattatccttgatcgcctgacccaatctctagggaaaaacaaccgtgccagaggaggactttggtatcactcggggccgatagggctgttcatcacactttttgcccgaaaatgggcacaaaagtcctcctgtgacaataacactcaaaccgataaataacggagggaaacactatgcgtatcataactcggtgtaaaaaaatcatgaataagaatacgatcttgggattagccctgtcatcattagtgagcataccgctatttgcctctgaactgcccggtcagggcatcagtgtacaaccgcttcaaagcaccatcagcgaagaaactttccagacattaattgtctgcaaggtattggaaaaactcggctatgacatcaaacccatcaaagaagtcgattataatgttgcctatgcttccattgccgctggtgacgccacattcatggccgttaattgggttccccttcataactcgcaatacaaagccgcaggtggtgataaaaaactctatcgcaaaggaacatatgttgaaaatgctgttcaaggttatttgattgataaaaaaacggcagaaaaatatcgcatcaccaatatcgcacaactgcaagatccccaacttgctaagttgtttgacagcaatggagatggtaaggcagatttaaccggttgtaaccccggttggggatgcgaaaaggcaattaacagccaactaaaagcctatggattggagaataccgtcgaacataatcaagggaactatgctgctatgatggctgatacaatcgctcgctatcgagaaagcaaacctatcttctattacacgtggacaccttactgggtcagtgatgtactgaaactagatacggatgtgatatggctacaggttcccttctctgcgctcaatgatgacgaagtggttgatacccaattgccaaatggccgcaactatggttttcctcccagtactatgcatattgtggcaaacaagatctgggcagagaaaaacccggcggctgcaatgctttttgctgttataaaattgccagttgctgatatcaacgcgcaaaatctgcgcatgcacagagataaagtttctgaaatcgatattgagcaccatgctgaaggttggctcagagcacaccagacaatcgttgatgaatggcttgaggctgccagaaaagcgactgaccaaaaaacaagctaatcctgaactcttaaaaaatagttgtaaattcattaacaaaaatttatggcttttatctccatactgctaaaaacctatcaaaaacacgggacttaataatattaattaaataatttatatattttatattttcactttcaccatattttgttaatgttgtttcacctattaacaaaaaaactagtcagttccatgccaatacctgataaacctgtgcccgatatcccaaaatctggtgcatcgatacctgagcctcccattccgaacaaaatttcttcgttctcagaaggcattattgatagcttacccattgccattggctatattcccatcgccttcgcatttggcctgagtgccgtgaagctgggctttgctcccctcgaagccatatttttttcatgtgtcatttatgcaggggcaagccaatttgtcatcaccgctttgcttagtgcaggtatgtctttgtgggtttctgctttgaccgtcctggcgatggatatccgccatattctatatggcccagctctgcgttatcgcatcaaacaaaaattatcagaaaagaaaactgcgatctgggcttttggtctgactgatgaggtttttgccgcagcgaccgctaaattgattaaagaccagcgtagctggagtgaaaactggatggtcgcgatcgctgtgtgttcatggctatcttgggtactcggaaccgtagcaggctccctactgggaaatggttatctggactcatatccagccgttgaagccgccatgacctttatgcttccagccctgtttttaagttttttattggcatctgtcaaaaaacaaaatagctactgcgttactgcgtctttggcgggtgcgttgataggtgtcacatacttttccatcccgattgccattcttgcgggaattttgggtggttgcctggcagcacttcttcaatttcacaccacacagttgaataagaataaaactgatgattgataatagaatacttctaatcggtattgttgtaggggtagccaattttttattccgttatctacccttgcgctttggtgtcaatcgctcgcctatgaccaaagcgggaaatactggggttgtactggatagtattggtattgcatcaatttgttcgctccttattgtttcaggtattcctgaagtcatacgcgaacataataaattttttccgactttgatcggcagcctgactatctgtttactgttctataaaacacgaagtatcagcattgccacactgtctggagccactgtttttggattaacattcaaggtatttatgaattaggtatcaatatcaaaagaaatatgatgataataaataactacaattgctaaatttaacttttaatatagtatttgtagggtttttaacagaagttactttaccggttgaaactaataaggtatctaaacaatggaaagttcattcactcccactgaagagttgcttaattgccgtgttacacagcaaaaagagttgaacaaaagtttgccctatcaagagatattactcactcgcttatcgatgcatgtccagggtaaattactggaaaatcgtaataacatgctgagagcgcaaggaatcaatgaaaccttgtttatggcactgatgatcctggataccaaagaaagtcgtagcattcagccatcagaacttagtgctgcattgggttcttcccgcacaaacgcaactcgaattgctgatgaattagaaaagcaaggctggatagaaagaaaagagagccataacgatcgtcgttgcctccatcttcatctaacagataaaggtacagatttcttaaatagtttacttccacctcaacatgactgcctgattaaactttggtctgcgcttgaacaggaggaacaaaaacagttagagaaattgatgagaaaattattggctcgattggataatatcggggattgttttaaaaagtgattctatttgtaccgaacagttcgcatcaagaaaaacgtgttatggcaacatgacctaaaaaatcttttctgctagcctgtatcatctgatacttcatatggctgactattatcctcagataatatttgaatccatgtaattcaccctttccagtagtgtaaatgcacactactggaggtgtgttctgtctacagtggttttaaaaaacagcaagttcaacaagaaaaacacggagattcgccatgaatatcaaagaggaaataaaatccccgacagctacaggccgcaataagaaaagacagcgccgaaatataatcatattactgactttactctttcttatccttggtgccgcttatactgtttattggttcctcgttttacgtcatcatcaggaaaccgacaatgcctatgtgacaggaaatcaggtacaggtcatgtctcaggtcactggcagcgtgactaccgtctattttgacaataccgattttgtaaaaagcggcagtgttctcgtacaactcaatccccttgatgctgaactggtactgaaaaaagccgaaaatgagttagctatagccgttcgaactacccaccagcgcatactcgataatcaacaatatcaagccgtcatcaacctgaaaaagattgctctcagcaaggcacaaaacgatctaaaccgcagggaaatactcggtattaaggaagtcattggtaaagaagagctgcaacatacgcgtgagagtgtcgcgattgccaaagctgatctggatgtagcaatcgcgcagtacaacagcaatcaggccaccattctggatactccactggataaacaacctgcggtagaaaaagccgcttccggggttcgtgatgcctggctagccttgcagaggactaaaattgtcagtcctgttgatggatatgtttctcggcgtcatgttcaggtaggctcccgcattaattcaggaacacctttaatggtcatcgtccctgccagcaacatgtggattgaagccaatttcaaggaaacccaactcgccaccatgcgtatcgggcagccagtaaaaatcatcagcgatttttacaatgatggtgtcgtgtatactggcaaagtagcaggccttgatatgggaaccggtagtgcgttttctctattacccgcccaaaacgccagcggtaactggattaaggttgttcaacgcttgcctgtccgtattgagctggatcctgagcaattaaagcagtatcccctgcgtattgggttatcgacaaaagtcacagtagatacagcagatacccgtaaaatgacactggcaacctctgaacgccatcatcccgcttatcacacgaatgcactgacgatcgatatggctcctgccaataaaataattaatgacgtcattaatagtcattcaagaaattagttttaaggggacgttatggtgacacgagaaccacttacaggcgctaaattggcgctactgaccatttcccttgcaatggctactttcatgttggttctggactccacaattgccaatgtcgccataccgacgattgcgggcaatctgggggcatcaaactcacagggaatatgggtcattacctcctttggtgttgcaaatgcaatctccattcctattaccggctggttagcaaagcgcattggcgaggtcaagctgttcatttggtctacagcactctttactttctcctcatggctatgtggtatctccaacagtttggaagtactaattttctttcgcgttatccaaggagtggtcgcagggccgataattccgctttgtcaaagcctgttattgaataattattctcctgccaaacgaaatatggcactggcactctggtctgtggtgatcattgttgcgccgatttgtggcccgattctggggggatatatcagtgataattaccactggggatggattttctttattaacattccccttggaatcgccattatctttgtcgcaagacacacactgcggaacagggaaactaaaacagaaatccacgccatagatactgtcggattagtactgttgatccttgggattggttgcctgcaaatcatgcttgaccaaggaaaagaacttgattggttcaactccactgaaattattgttcttaccgtgatcgccgttgtctcattaaccattctaattgtctgggaactcactgacgatcatcccattatcgatctatcactgtttaaagagcgtaacttcaccattggtacactgtgcctcagccttgctttcatgttttactttggcacgatagtcttgttgccacagctattacaggaagtcttcggttataccgcgacatgggcaggtttagctgccgcaccaatcggattgatgcctttactgctctcaccgctcattggaaagtatggccataagatcgacatgcgttatatcgtgacagccagtttcattatttacactgtttgtttctattggcgggcatatacatttgagccaggcatgaattttgccgcgattgcatggcctcagttttttcagggatttgccatggcttgcttcttcatgcctctgaccacgatcactttgtcaggtttaccaccggaacgtatggcgtcagcttccagcctgtccaactttatccgcatattgtcaggttcaatcggagcctccattacaactacgatatggacacaacgtgaagctatgcatcactcctattttacagagcatatcaatccgtatgattctaattatcagcaaacgtatcagcagttgacgcagttgggcatgaatgatcagcaaatttcagcttatctggcaaagcagatcactcatcaagggttaattatctctgccaacgaaattttttggcttgcggcgggagtatttttggttttggtgctactggtatggatggcaaaacccccatttagcgtaggaagcaaagatagcggaggcgcacattaggactattcatctttaatctatctgtttagatcgactacttatcaacgggagtgaatgctcccgttcaattaagctcagaatttaattcatcatcccttaatccattaccacaataccaattcgttctaacagttctgcgacctgataagactctaatttaacgcctttcaaatcaactttccgaatatcaagctcacccagtgtagaattggtcagatcacaataagtaaagtcggccgcattccaatcaaaagagataaattcaccaccggaaagatcggaaccactgagcctcgctcccagaatatgggtttcatgccagcggttttcccataattcacatttttcaagaataacatccgcaaagtttgtgtaacttaagttacttttggtgatataagcagagcagaactggatgttggcactcaccctattcataaaactggcaccccgaaaatcagcgccttgaagcctgcacccgcaaatctctataccaagggcattaatatacctgaagtctgccatggacaaatcacagtttttgaaactagcctctttcagcatagcgtgtttgaaattacagcccagataacttgttggctcataaaactagcaatcgataaactgagtatctctcaaatcgctactcgaaaagtcgcaatttaaaaacttactgtttttaataatttccccacgaaattggtcacgttcgattttctcttcatataattcaagtccttgcataataactccaactgttgaggcagaactgttcttagcagagatcttgaagcattcgtactgatgtgtctacccgatggctataaaaattctgttaacttaattattcatcataaaattaaatcataataaaatagtatttttataaaatcatctcattatacattagataaattagcgtatattttaatataacttatctattattaaacttaaccactctattcaaagtaaattgcatggtggtttttcagtatagattatttaactaaataaaatttagagatatgaacatataataaaacctcatcataattatctgtctcttgagtcaaacttataatcaagagacagtcgtggctgatgaggtttaaatcgtttcagatacagataagttgataattaaacaacatttgcaatgttcttaacaaacggggcaattggattagtcagattatcagcaaacttaaaactcagtgcgggatcagataaatccagcatttgtcgattattggcaatttgcaatctgttcaagcagcagcgttttatttctggcgtaaacagttcataacgcaaaaattgtttactaaattctggatgatgagattggtaatccagaatgcaatccgccacagcctgccagaatcgttcttgcgaatatccgccctgctcatcaagaattgccgataaatagcggaacacaccatcgaacacatcagataaaatagtcaatgttttcatctcttccggcatactgactttcactcggctggccttttctggcaaatccgcatcggggtttacgaccagaatttcttctgccagatctttcatgaagatgtattgcggaatatgattctccagcaccataatgatattttcaccatgtggcataaacatcaaatcgtaagcatacaaacagtgcagtaatggcgacaaatagcaatccagataacgacgtatccattcctgactcggcagacctgaggcagatatcaaagctggcaggaaggctttcccctgctgatcatgatgtaataatgcagccatcgtcatcagcttctgatttggttcaatcaatggcagaggattttccctccacagcatcgccatcattttcttataaggcgtatcaccatgaatggcctgctcataataactgtttctaaaaccgatgctcgcaacttccctcaacaaccgaaaaccatagccctgtaaaacagcgtccttttgtaccaaatcaaacagccagtcattaatacctggcgttgttgccatataataaggtgacaacccacgcataaatcccatattgaggatagataatgctacttttacgtaataccgttgtgggtggctgcgattgaacagggttcgtatcgattgttgagcctgatatacatccgttccttgccccaaatagaccagttttcggttggcaaggtcgtgcgcaaatacggatggtagtttattttgccactgccacggatggaatggcatcaacagatattcttctggattaagcccaagaaggagcagttgatggttaaacttggctatttctgcctcccccagttcctgctccatcaattgttggtaactaagttgctcaatacaagcaaagtgagctttacttttatgcgccgccaaccataccaaacgcatgtcagaagctgactcaggactaaatttgtggaaatcttccgcatcaaagccgatacgcccattgttagcgacgaagatcggatgcccttccatcatttcagcttcgattgtctgaaaatcagcattgaccagctcttctacatcgataccgtttcggtgatatttgaatgcactgctatgcagtgtgctcgtcagttcttccaggtaagtcggcatcacggtatcactgataccaagctgttgtttgaattcaatgataaaactgataaagtccagctcgcaccagtcacctgcctgcattttccgcaacgaatcagcatcaatcaaccagtgatctaaagccaatcggcgcgctctgaaatgataattaactgagcattcaggattatccaaacgatagtggtgataaccgtcttgatctgctttttctgtcaattgttcagggaacagtaaacattcatgggaaaattcagaaatggctttcctcaaatgcagccgattaaccttctgccagatggcgggatgtaaatggctgacaagagaatgagtctggttagaaggtactgttaatttagctgattgtaatgccatttgatgttgctcccgagtacaaaatgccaaccctgcggttttgtgggataactgcacagttttgtcgtaaacaaagccagcccgcaagttgagccgatggattttttcatttcgtatatccggctcgacgacaattctgttcacagcaggatttttaaaaataaacgcgataatggtctggaaaattccccatgtgaattgactgattttttgttcagatggcgcaaccagaatatgcattcccatgtcatccgaacgggctggatagtattttcctatttgatcatcctgcgcccaataacactccagtaaaaatacaggctgctcttggtaaattccgataaagacagaatcaggctggcgattcaacagatcttgataaaaagtttttacctgttgttcggtatgactttgcatcccccaataataggcatattcctgattaacccaatcggtaatagcagcaatatcttctgtcagatctagtggacgcaatgaaaaggtgcccaaatcaggcagcgttttttcaaatgaaatagtagcaacggcagacatcagaatactccttcactagcaacaccaaactgctgaaacgcaatacttttctctatatcataatgtgccgttccagtaatttcctgaatcaggcaggagttacggtaactggccatgcctaaatccggcgtcacaaaaccatgcgtatgaagctcgacgttctgtacaaaaatttcgtttctgcaatcgatgctgtaattacgctgaacatcataacgcccctgcttatcccagcggataagatgctggataccctccataaaacttgggatctggtattgataacccgtggcgagtaccaatccctctgtttccaaagaaaatgccgtttcctgttcatgctggaataaatccagtatcaatttctgttcttctacgatgccttgtctttccgctataaaatgtacttgtcgcaattcgctgttggtatacaacgagacatctaattccccactcaatcgcttggtatacatcaagtcaaaaatttcattgataagcgaactgttaattcctttataaagtgactgttgtgaacgattcaatgcttcacgtttgttctccggcaggctatagaagtaatccacatattctggtgaagtcatttccaacgttagcttggtatattcgagagggaaaaaacgtggggaacgagttacccaattgagttgataaccatgggcatcaatatcctcaagcaaatcgtagaaaatctccgctgcactttggccacttcccaaaacagtaatcgatttcttctgctgtaaagcagccttattttctaagtaatctcccgatgtcaccatatgatcagcaaacggtctgcaacattttggaatataggaagacggcccggttcccaacaccaattttttgcaggaaaattggtgtttttgcccagtcagagtatcagcgcaatgcaaggtataaagtgaagtagaggcgtcataagtgatattctcaacctgcgtattaaaacgcagattagatagttgttccgccgcccactgacaatattggttatactctttgcgcatcaggaaaaaactttcccgaatatagaacgagtaaatacggcctttttgtttaatataattgaggaagctcaaaggatgggtaggagatgccaatgtcactaaatccgccatgaacggcgtttgcattgtggaactctcaagcatcatgccgggatgccagttaaaaccggctttttgatcaataaacaggctggtaatctcttttatcggttgcaccagacaagccaatcccagattaaatgggccgattccaatcgcgataaaatcataagttttagttgtcataaccactcctaataaatataagatgaatttataatttcgattaccatttcagcaatcaccgctggcaatataagcggaaaattaatgtatataacatatttgtgatgctaaaaataaaaggaaaatttatcttatttaatattctttttatttttataataacatcaatggtgtttttaaaataatgctattgattatttatattcaataaaaattaataaaatacataattatcaataaatgataattttttacttttataaaaaatgaatttagctgattctatttatgctgtagattcaagagggcaatcgtgacaattccccacacccggcaatttgtttctttggcagcaactgcgacgctgtatgatattatttttcaagatcatagtacgataaagcggattatccctaccatctggtagtgcctgttcgaagaaaagattttgtatcaacgattcatattgttcagtgctcattcttcccttgaaattatccaagtaccagtgaatcacataaccaatattgttccataataagcgcccatttattccccgataagattcgattttctcacacacaggaataatatgacgatcaagcaaagaatgataacgttccaatagagataaagattcgttcaaccacgttaattgataatacacaatatctggcctgccactttcatgaaattcaatctgaaaaagatgataatctgtatctataggttggggatattccagcaacattagcatcataggaggaatagttaaaccaaaataccattgtgcccatagagaataaagccctttctgatttggtttctgttcattattaccataatatgcatcttgatagcgtttcatcaataatgagaattctttttcgctcgaccattgataaaattccatactatctgaaggaatattctccgcattcactttcattgatgaattaaagtgactgaatgcgctatcaaatagtctaataatatcttcaatctctattttagatgcccattcactagagatgtcattatttttgtttatcattaaaaattcccctattatatattttcatcctaacccaaacacgcgctatataaaaatagcattgttggttatttattcattttgtatttaggaatgatcaatggtttgtgggattcaggatcccggataattctgcactctaaaccaaaaacatcggcaatactttgttcagtgacaatatcttcaggtacaccttcggcataaatctgaccatttttcatcatgatcaaacgtgacgcataacgcagtgccaaattgatatcatgcaataccaacaccagcgttttcccttgtctgtgcagacgctgacataaatcgagtaactcaatttggtgcgtaatgtccagataagtggtcggctcatccaacagaatgatcggagtttgctgtgccaatgtcatagcaaaccaagcgcgctggcgctgaccgcctgaaagttcactgaccaatttctgcgacatctcatctaaatccaccgcctgcaatgcttcattaaccacgcgctcatcttctgctgaccattgccgcaggaaagattgataggcataacgcccacgggaaactaaatcatagattgtcattgcttccgtcacggtagcgccctgcgtcagcagtgatagctcgcgcgccaccgcctttggcttataacgatggatattgattccatcaagctgaacttcacctcgctgtggctgcatatttcggctgatagcgcgcaacagtgttgattttccacatccgttagagccaataatgacactgaattcactatcgtgaatcgcgagattcaccccctcaataatggttcttttaccgtatgccagtgaaagatcatgggctttcagccgtgaagtaaccactggggaattagcatccgatgacattatcgcgttctccttaattcggcatacagtaaatacatcaaatagataccaccaaccaccgcagtaatcactcctacaggcaagcgagctaccgttggtaatatcagggtaattaaatcagaagccagcatcaacaaagcccccaccagagcagagcaaaacaatgcggctcctttcgcccgtaccaaccgtcgggcaatttgtggtgcagatagcgcaatgaaagcgacaggccctacgactaataccgacattgtggcaaaggttacggccagcaatatgctgacaatccggatgaaacggacaggtacaccaagggtattagcaatatcatcaccaaaatgggtatagttcaattgcctacccagccaacacaaaaagggaataaaaatcaccatgccactgataagcccgacatcctgccagcgtcggctggcaaggctgcctctcaatagcgagctgatctgctgagcctgctcaatacgaatattcgagatagcaaaatcgacaaatgccatgaaaaatgcggcaacggcaatccccgaaatcactattttgttagcctgcatgttgccaacacctgaaccattgccgatataaaccagcaatacagcaaggcaggcacccaataacgctcccaaaggaaccggcaatatacttggccagaaaagcaatacaaccatgataccgacagccgctcctgcattaatgccaatgatatccgggctaccaagtgcattgcgggtcgtcaactgaaaaagggagccggacagtgccagcgtcatgcctgcacctattgccaccagcgctctgggtaagcggatctgcaacaggataaattcctgataaggcgtttccatcgccagaaaaggattatccatgccttctcggcctaacgacaaagccagataaaagagcgccacaagcagcagcaatatcgacagaatcactctactcgtatgcaatgaaggtgcaataaaaacggcattgcccaacgtgaaggttttgatttttggctgccctgccgtgaaatttatctgcgccatgctctactctgccattattttctgtgaacgatgtttagcgaccagataaagcaacggagcacccatgccagccgtaataatacccaccatgatctcttgtggtgcaatcagcaaccgggccacgacatctgaaataagcagcagacaggggccagcgaacaggcagtaaggtaacaaccaacgaaaatcactgcctaccagtgcacgcattaagtgcggtgcggccagaccaataaatgcgatggggccggccattgccgtcgctgtggctgccagcatggtaaccatcaccagcgataatatgcgggtacgggcaacattcgcccccagggaactggcaatcccttcaccaaagaccatcacattcagagaagcactgagcgaaagtgtcacgaccacagccaccagcaaataagggatcaacaaactggcttcgttcaacgacattgcacttaaagaaccaattgtccagaaacgatagttgtccatggcctgtgcatttatcagaacgataccttgcaccaacgcaaacaggcagatattgatagacgctcccgtcaaaaccaaacgtacagggtttgtattgcgaggccctccactcaacaaatagaacaacaatgttgacagacttgcgccaataaaagcggtccaaaaacgcggcagtatgtccagagcaggaataaaagagaagcagactacggcagttgccgcacctgcattgataccgagcagaccgggatcacccagcggattgcgtagcagcccttgggttactgttcccgcaagcgccagtgccgctcccgccattaaaccaatcagtgtgcgaggttcacgggcattaatgaccaaatcgtaataactgccttgatctcccaaccaataatgctgccagatcgctgacagcggcaatgattttgaacccaaactcaagctggcagcaatgcaaagacaggttagcaatgccattaataccaaacccaatatgagggcagttcgccgtttagcgttcattatgttttgctatctcctgcttcagcaacggcataaaccttggcaacccccaacgcagactgagtggtgagccataggacatggacacgacaattgattgatcggtcaacggaatatatcccccttggcgaacagcacggatagagctaaacagaggctgtgattccgtatcctgacgctctttttcgctggaataccaagtcaccagaatatccgcaccattgagcaagtcggcattttccaaaccgatatcgactgaaaaactaccaaaaggtgcagttaaggtgtcagccaatgggagcaaagacaggccaagatgtaccatcgtatcaactcgtggatcatttttgacatagatcgacaaaatgctccctgtcattcccgccttaatataggcaaaacgataacgctctatattgggaaccgtactgcctgcctgcgacagcatggtatccagttcggcactgagtttttctcccagttgtattttatccaatgcatgagctaccagcgctatctgccgctgtggtgtcgtctgccacggtttttccggataagtaatcacagggacaaaataggacagatgatcgtactgttcctgcgtgatgcctgattgcgttgccaaaattaaatcaggcttcagactgataattttttcgatatccagttcagggtacatctcgataatggctggcagtttttcgccacgccgttctatctcatccctaaaccatggcaaatagccttcagcgtccccgccccagcgatgagattcaatcccaatcggaatgattcccaaatccagcaagatatcttcgctgcccgttcccaacgccacaatcctttgcggcgattggtttattaccgccgttcccagcgcggtggtaatcgttttagggtagccaacggcatccgtcggtaaattctttgaggccgtcggcttatcacagcctaccagcaaacttaccagcaatatcaacggtacggcgaccagcattttgcaacgtgttaataccattaccagtaaccctttacagcccgttgttgttcagatgaataaaaatacatcgtcgccgtccgtgattttcttaaaatttataactcaatgttgcttcaacattacgtggtgcgccgtagtagtactgggtataaccaccgaacgaggtgtagtatttcttgtcaaaaaggttcttcaagttcacgctcagggagagatccggtgtaaattgataacgtcccatcaggttaaccgtggcaaagctgccttgctcatcttggcgtttaccagtaggtgtatcaagctccaaccatgttttgtcctgccagttgacaccaccaccaagcgttaaatcgctcatggcacccggcaaagtataagttgtgaacagtttgaataatcgacttgggttatccgtattgatacgtttaccctttggatcagtcgctcggaattgggtgtaacccgcataaacccgccaatcatcggtaatttgaccactaacttcagcttcgaaaccccgggtttttaccccattgatcacataataagttctgatgttatctggacgtcgtggagcagtactatccaattccgtaaaattatcctgacggatatcaaaaattgccaatgagtaatcaagaccgttgtccagagcaacccccttcaaacccagttcatagttttcacctgtgactggcttaaggagtcggccattacggttaattcgactttctggatcaaagattttggtataactaccataaacggagaagtctggcgtaatgttataaaccaacccaccatacggtacaaattcatcactgtagctggcattttgtggcatactaaaattatcgccacgagttttccaactggtgactcgcccaccaagaatcaatgttacaggatcagccagtgagatttgagtgacggcatagcccgcagtttgttcgttatagccatcagagccattgtttctagttttgttccatgttggctcagcataaccccatgacgaattagtaaaatcacctattggagaagttgaacaattacgtggcatacaggcagcccagtaataatcattctggaaattctgtttctgataattcagaccaaagctggcgtgatgggtacgcccaagcaatctatagtcaccgtttacctgcaagtcgaaattacgctggcgacgagttccatcaatcaatgtcatgttgcccggatacattccctcattcgtcgcccgatcaggaaaacccgttgcccacaatactttttggtcaagagtaccgtgatcataagtaaaggttcctttcgcactccagccgttatcaaattggtgttgcagactggtaaaggtagagaatgagcggactttagaaaacgcccaatcaggcgcataactgttactgcgtttgtaatcggttttactgccatctttaaaataaataggcaaaccaccaaacatgccgccacgggtatggttgatctggtaatccgcaccgacggtcagcaaagtattttctgtcagatccgcttcaagaatgccatagaagggatacttctcatgtttatcacgatcaataaaagaattggaacgttgataagcggtgacaaaacgccctctgactgtcccgtcttcatttagtgggccagacagatcaagaccagtccgccatttatcccatgaaccaccgcccagcgttatttcaccccggaaattttgggttggacgtttacggatcacgttaaccgctgctgaaggtgtgcctggccccaccattaaaccagccgctccacgcaccacttcaaggcgatcaaaaatggtggtatccatcaggttatcaccataattaaaacggatatcataaaaagttggcacaccatcacgtagcatgtttttgatcgtcatgcctcttgaagtgaaagtaaaacgatcactgtcagcctgacggacagtcatacctgtaatactaccaatagcgctctcaacgctgttcagattttcatctaccatccgctgtttggtcattacgctaacactttgtggtgtttcacgcgcagacatattcaaacctgtcgctgtcaccattgaagatgtgttgtacattccagtgtcttccgttacaccttcatgccttggtgcacctgccgttacgataattttatcgtttttgctctgtgcttcttctgccatagccgtgctattccccgctaaaatcagcgggatcatgagagaaagcacttttttcttggttaaatgattcggttgcaaaattggatttatcactctacttatcccattaccaaattgatttgttattatatttactttgacgttcccatcagttatctgtctcaacagtgacagcgtatttttcgcgtagggcgtgaagtgggttaactaaggttccggcaaatttcaggtttttttcacgatcatcgagatcaatcatctgttggttgttcgccatttgcagacgattcaagcaagtacgcacaaaatcatgcttaaacagatcaaatttgcggaatttttctatctggttcagatgttgtgactggtagttgtaaacacactgagccactaactcccaaaaacgcgcttctggtaatgcaagatgtttttgtaacagaggggtcagatagcggaagaagcagtcaaagatatcaaggaagatataattaattttcatttcatccttgatggtcacatgcaggaaatcaatctcttcagggagttggatatccccattcaaaattgcaatttcttcaccaatatctttcattaacatttttaccggcacattattttccaataccagcatcagattttcgccatgtggcataaaaaccagatcataagtgaagaaagaatgtagcagtggagaaaaataggcatcaagataacgcgttacccacttttccgccgataaacccgaatccttaaccaaggcagcaacgaccgcatcaccttctctatcgacatgtaacaatgaagccatagtcatcagacgttgagtctctttcaggatcgtcattgggctttcacgccacaacgctgacaacatttttttatgcggattatcttttttaattgctgcttcaaagtaatgattgaaatagcctattgctgcacgttcccgcaatatggtgaaccctttttcctgaaagaaaatatcggattctactaaatgattgagccattcattaacttgcggtgtcgtcaccatgctatgtgggtccaagccacgcataaaccccatattaaggactgacagtgccgttttcacataatttttcttgggctggctgatattgaaaaatgtgcgaattgattgctgggcaagatagcgatcatggccttcaccaagataaacaatttcttggttggcaatatctgccgcaaaactgatggcaatacggtgcagccattgccaaggatgcacaggcatcaggtaataatctgacagatttaatcccaatgtctgcatgtgttgttcaaagcgggctggcaaatatttttccagttcttctgccaccagctgtgaataagagagcgaagataatgcagaaaaaacggttttattccgatgtacggcaatccaaattaatgtcactggatttgcgctttctggtgcataatctaagtaatcatcagcatcaaaaccaatacgaccgttattagcaataaagacagggtgcccttcggtcatcgcagtttctacagcctgataatcagcttgagtcaagtcctgtgcggtcaaccgattattttgatatttaaaagcgcagccataaagcgtactggatatttcatcaagataaataggcagcatcttctcagaaatatccaacagtggatgcaactcaataatcagttgaatagcatcaagaggctctggctggttatgactgaatttcgttattgacgcagcatcaatatctagatggtcaagttggtaggattgtgccttaaaatggtattgaaatttatcaatttcaatcgagtaagatttatccgtactctgatttaccggaaagattaatttctcatgcaaaagttcacgcaatatttttgctacaagatgcctgttggcatgtaaccagttttctctagttaaatgcgaggtttgaggactcaatttagtgtacaacggactcatttaataaaacccttcattcatatccagcatcatcccgtttccatgcataaacatgactgacagggtagatacacctatatataaactttggatattgctatccagctctgggggattaattctggctcactaaaattacgatctttctattttttcttgcatgaatgataattaaaatcattactattaacaaccataaaatgtaaagactttaaatgaaattttactaaagaatggggcacaagataagtaacgaccgaattaaccatgcgaatagaatggtttttagatatactgtttaaaattttgcagttataaaacgcaatatctttataattaaagaacgatattataaattttatatttaattacattggtaaaatatctcataaaatttttaatataaataattttaattaattagtggtaaaataaaggccctggttaaataaccagagccttattaaggtactttaatctctgtatcaggctttattctggcgccaccattccgccagcataatacctgttgcgacagaaacgttcaggctttctattcgacccgtgccaccaattgagagtcggatatcaccatcttcccagatactgtcactcagaccatcactctcctgacccaataccaaaaccattttttcaggaagatccgctttggccagcgttgtgcttcccttatggcttgaggtggtcacaatggtataacctgcacagcggaattggttcaacgtcgttgtgaaaccatcagcatcaatgcctttgatgtgttcagccccaccttcagcagtacgaactgccgcacccgattccagcatcgccacatcctgtaatatcacgccctgcacgccaaaatgagcgcaactgcgcataatggctccaaggttgtgcggattgcccacattttccaatgccagaacacagtcttttgctggtgcttgctgcaaataagtttctacatctagcccattacgctttttaatcaggaagcatacgccaccatgatgctcagtgcctgatgctttgaccagctcttcgtcatcaaccacgtggtaagccttgcgatttgccgccatccatttcaaagcatcacgaaaacgaggtgtcactgattggacaaaccaggctcggacaatggcttctggacggttcttgaacatcgcctggcaggcattttcaccatagatccgagtctcttccagccgctgacggcgaagctgttcaggatcaatctggcttttaccactgataccgccatggtcaggcgtcagggattcttccaccggtcgggagacggttttccaaggagaacgatcatctgaatacgctggacgttcattatcacgacggcgcccctgatctcgtcctttaccagacgacgggcgtttattgttactacggctgtcattattgctgcggcggtcattgttgtcctcactgcggacatacatcactttgactttgccatttttaccactataggaatcgttcatttatttctccaactgcgttatggcgcgcagattacccgatgtgcgcgcccgaagctacctctggcaacgacaatccattaaaatacccgctaattttttatccgctttattcacaaacatgtttgagttcaaaatgagaaataacaacaccgtttatcaacttcgccaacagcgtctagcccgttctacccgtccctttcaggcaaggggctgccgagtgcagcgttgcctgcattgtttattaccccaaaaaagctgcctgtgtgaaacaatttcaccagtaaccgcgactagccgcttctgtctcatcatgtttgatactgagccaatgaagcccagcaatacgggaaagttgattgctgatattctgaccgatacacacgcttttctctggtcaagaaccgagcctgatcaacggatgcttgaagtgctgcgcgacccaactcgacagccctatttgatcttccctgagagttatgccacacctccccgtactgtatatcagcaactccctgataaccagaaagcgccgctattcattatattggatggcacttggccagaagcaaggaaaatgtttcgaaaaagcccatatttggacggtatccccctattatctatcaataattgcgccaaaatggattatttactgcggataccatccagaaaagaacagcattgtactgccgaagttgcagccgctgcacttgagctggctaatgaccttgacgcatcacaaacactactccgccatttcaatcattttcgtgaacaatatctggcagggaaacctcatcgtcaagaggagtcaatcacagtaattcttgacaatccccgctaaagtgtctgatggtggctaaaattattcatagtaattgtttaatcaagggtgattgtttattgatgtgataactaatgaggaaccccagaaatgagtcagcgcggactggaagcattattacacccaaaatccattgcagtgattggtgcttctgaaaaaccagagaaagctagctccatgttgatgcgaaatctgctaatggggcattttactggcccaattcttcctgtaacaccaaataaaacagctattctaggagtactggcttatccctctattgataaattaccactgacgccggatttagccgtgatatgcactcatcacagccgtaacctatctttgctggaacaattggcgcaacgaggatgcaaaacggttattattctctcctcaccgccttcacagtttgccgaactgaaacagttcagccaaaaacatcacatccgcatgctgggacctaacagcctcggtattctggctccatggatcgggctgaatgccagtttttcccctattcctatcctcaagggcaaactggctttcatctcacagtcagcagcaatatccaataccattctggattgggccaaccaccgtaatattggtttttcctatttcattgcattaggagacagtgttgatatcgatattgacgatctcctcgattttctggcgcgagacagcaaaaccagtgcgattctgctacacctcgaacatatcagtgatgcccgtcgttttctgtcagcctcacgtagcgcttcgcgcaataaacccattctggttgtaaaaagcagccgcacccgcaaagctcaggaattattgggagaacaacagaatttcgatgcagcttatgacgctgcgattcaacgtgctggattattgagggtacaagatacacatgaaatgttttctgcggtagaaacattaagttttatgcggccactgcgcggggaacgcctattgatcgtcagtaacggttcagcacctgcggcaatggcactggatgagctactcaggagaaccggcaaacttgcagtgttaggagacgaaactagcaatcaattgtctgctattctccctgataccctgatcctgcgtaaccctctggatctcggtgatgattcttcatccgaacaatatattgccgcacttaaactccttctggatagctatgattatgatgctttgttgttaatccattcaccctgtgccatctcccatagtatgaatactgcaatcaaagtcattcagactattaaggaacatcctcgcgggaagtggctaacaatttttaccaattggtgtggagagtattcttctctggaagcgaggcgtttattcagtgaagctggtatcccaacctaccgtacaccagaaggtgctatcacggctttcatgcatatggtggaatatcagcgcaaccaaaagcaactcaaagaaacgcccgctatgccaatcagcattacatcaaatactgcacacgcccatgagtgtatccagcaagtccttgatagcggaaatacgctattggatacccacgaagtacagcctattcttgaagcctatggcttaaataccttaccgacatggatcgcatataccagcgatgatgcagtcaatatcgccgaaaagattggctatccggtcgcattgaagctacgctctcccgatatttcccataaatcagaagttcagggagtaatgctctatctgcgcaattctgatgaggtaaaaacctcagcacaagcgattattgaccgcgttaaacagaacttcccccaagccagaattcatggcttatttgtgcagagcatggctaaccgtgcgggtgctcaagaacttagggtagctattgagcaagatgagatattcggccccttaatcatgcttggagaaggtggtatcgattggattaatgaaacgcagactgctgtcgccctgcctcccctgaatatggcgctggcccgttctttagtgattcaagcgattaaaggcggcaaaataaaatccggtggctcgctgctaccactggatattcctgcactcagtcaattattggtcagagtatccaatcttctgattgactgcccacagatctctcgtatgaacattcatccactgctggcatcaggtaatgaattcactttattggatgtctcaatggaattaacgccagtaacaggtgatcctcacagtaaacttgcgatccgaccttatcccaatgagttggaagaaactatttatcttaaaaaagattttgaatgtctgctgcgcccaatcctgccggaagacgaacccctgttgaagacatttattagtcaggtaacaaaagaagatctctattaccgctatttcagtgagatcagcgaattcacccatgatgatctcgccaatatgactcaaattgattatgaccgtgaaatggcattcgtcgcaattcgccatgcagcaactacaccagaaattattggtgtcgcccgagcgatggctgatcccgataatatcgaagcagaatttgctgtattagttcgatcagatttaaagggcattacgttaggctatcagctcatgactaaattgatccattatacgagaggccatggtatccagatactgaccgccattaccatgccagaaaaccgtaatatgattcaacttgcgaagaaactgggatttactattgatattcaattagaagacggcgttgtcaatcttgtattaagactttaatcctcactttcgtgatagattgcacagacttaaagcaatcaacacttgagagttaattcatactcacaattaaccaaactaatggtattatcgccagatcattttgattcatacacctgatgatggaactccaaccatccaaactaagagaaaaaacgcactgtgatgttgtctaaatttaaacgagccaaacaccaacaacaccttgcacaactgcctaaattaccgcagtcagttgctgacattaagacactttatcaatcaaaagtgttccgcagcaccttactggaacacattgcgaacgctgaaaaatatatttatatcgccgctttatatttagaaaatgacgacgcagggcgagatattatggatgctctgtatattgccaagcaaaaacgccctaagctggatatcaaaattttcgttgactggcatcgtgctcaacgtggccgtatcggcgcagaagcagcggcaacaaatgcagattggtattgctctatggccgaaagctaccctgatgccaacatttccgttctaggagttccggtgaatacccgcgaagcactgggggttttgcatctaaaaggctttatctttgatgatacggtaatttatagcggtgccagtattaatgatgtctatctgcatcgccatgaaaaatatcgttatgaccgttaccatttgctgcataatgcaaaactcgcagccattatgaagcagtttattgatgataatattcttaccgctgatgccgtaaaaaatttagcctgccacagtcgccctcgtagtcttgaaattaaaaatttgattcgacagttccgtacttcattacgcagtgttgaatacaacattgagaatcaggcatcaaatgaggaattggcagtcacacctcttgtcggattaggtaaaaaaaatctactaaataaaacgatatgccacctgatctccagtactgaaaataaattggtcatctgcacaccttatttcaatttaccggcggttctggtacgcgcaatatcacgattgctccgacaaggaaaacaggttgagattatcattggcgataaaacggccaatgatttttacattccaccggaagaaccctttagaattatcggggcattaccttatctgtatgaaattaatctgcgtcgttttactagccgactgcaatactttatcgataaccagcaattaaccattcggctatggaaagaggcagataatacttatcacttaaaagggatctgggttgataacaaatggcaattaattaccggcaataatctcaatccacgagcatggggactagatctagagaatgctattctcatccacgatcctcatcaggaaatgcaagaacaacgcacattagaactagactgcattcgtactcatacaaaaattatcaatgattaccaggagctggaaagtatacagctttatccggtcaaggttcgcaaactgatacgccgtttacgccgtatccgagtcgaccgattaattagccgcatactgtaaaatagataaataattatcgactcatcaatcctttcttgctatcgctagagggaattttttgtatcttatttatcaacaagctatgatttacagaaatataaatcatggcgtaaatcacaatgataaaacctgtcataaatataataaaaaatgtattggtaatctctcctctcctatttacaatcgcgtgttccaatatgtatcaggccaacgataattggacaggtaaagataaagctcaacattttctattttcttcggctatggcggctgcgggtaatgcttatggggagcggcaaaattggacacatcaggaaagtgcacagtttggcctactcctgtctatcagccttggtacagcgaaagaattttatgatagtcgaccaccaggaacaggctggagttggcaggattttgtttatgatatcgccggagcaatggctggctatagtttgtatcagtctttgaagtaagttttatactcaagacgcaaaaaagccacccggtgggtggcttctctggctaaatagatgtctggcagtgccctactctcacatggggagaccccacactaccatcggcgctacggcgtttcactgctgagttcggcatgggatcaggtgggaccaccgcgctatggccgccagacaaattctgtgttcaatcccgaacaagctgctgtttttcatttgaaactgcgtctctctctctcaccaaaacaccttcggtgttgtcaggttaagcctcacggttcattagtactggttagctcaacgtatcgctacgcttacacacccagcctatccacgtcctcgtcttgaacgttccttcagtatcctcaagggacaagggaagactcatctcaaggcaagtttcccgcttagatgctttcagcggttatctcttccgcacttagctaccggggcagtgccattggcatgacaacccgaacaccagtggtgcgtccactccggtcctctcgtactaggagcagtccctttcaatcttccacgcccactgcagatatggaccgaactgtctgacgacgttcttaacccagctcgcgtaccacttttaactgcgaacagccgtccgctttggacctacttcagacccaggatgtgattgagccgacattgaggtgcccaacaccggccggcaattatgaactcttgggccggtatcagc

SEQ ID NO: 14971 - DNA, 89568 bp, Xenorhabdus bovienii
  unsure (1)..(89568): unsure at all n locations
  Genomic contig Name=Xb4151_4152.C430
atgatcattaaattataatgagatggtatatgtcaatcgataacgggttcagtagatgataatccaatatgtaatcggacaggtgtaaatcttaatgtggttttaagtctgatcaaaatatacccattaattctaaattgacntcaaaaattttaatgaatgccacgccatctanccatatgtttttcaataaaaaatagcgataattatcattcagttactactgaattacatattgataaaaatctcagaacaggtgatatagttagctttgatattgtacctaacgctcatgctgttggcttttcgacaaaaacgattnaattatactgctcatgaggtggacttggattcattgggtatttattttgaggaagatgttatacccgcattgatgacagatgaagttaatatacctccaaatgggaaattatatactcgggccattgcaatggtcaaaaacataaacggttatccactttctgaagtgccaattactatcattggaggatatttacctaatttagataaagtcaagatattcctttctaatcaagatccaaatacagaggtatcgaaacagtcgttatacggagagcagtctattgttttaaacacagataaaagtggcaaactggagttttatatctacttaagtgataagtctcaatttgtacttgattttaaagcgagagtgtccggtaaaacaggttttgtattttcaagaaataagttatatattattgatgacgatcctggggcgccatccaatattgctaaacagacgttgaactctcctaantattatagattatagcggtgagcttaggggaaatgatagttcttctacatttttggtttcaattgatagttataataatgccgaagagagacgataccaatttattttactgtagatgggaaagtatttcccaaaagaagaattgttgttaatgataatcaaaaaatttaaataattaattttaattcaatttgccctaaactatttttccactaaataagtttgttactttttttacgttgttgtctctattaatggaaatatccaatcttcagctggatcaatatgttaaatatgttggtggaggaaaaaatcaaccactggatgatttgacaagagtttatgatatgtgtactgtatattccagctttggtccttttatcccatctaatttggtctttaaagacgatatagtacactattttacaatatctcgttacatgaataataaagagcatgatggattatttgttgtcattacaggaaccaatgatcctacagataaaactaaagtgccatttggttctgaggttacattaagttttcgcatcgactcttataaaaaacaagtctataaaacattcactaaaacaatgccaactcagccagatcagggaagtaagaatacagcaacattaatttttggtatttcttatgaggatgttagtcatgtagagtcagattctaatagtgtagctggccgtatttattttgattatcagattaatgagttaggtaaaataacttatggtaaaatttggaaagcaaggatagatactgtacctcctagtcctgatggcgatactgattaaggaggtagtaattaatttctaatgtggcatgaagaaataaactttatgatttattcatttttaatgagcagcccaaattcgtgaacgaaaaaccatgagatgggctgcatactatatcaatagtattaaaaatattttcttctgtaagaaattatgagcaattttataattgtcataatcctgggatttctaatcgagaaataaaaaatttaatcaatacactttcttcaggtggtgctttcgctggtagtggaatgactggagtaatcaggaatcccgaaagtatagttacatcaggtaattatataattggtgcaatttattctattgctgttgaaaaacctgcgggttatatttcaaatggatattaataaaaagagtgataacatgaggatcttcatgagtataaaagaattcatttataatgttagattgaattctcttttaatagaattgatgaatctagatcatagattgaagataaatgattcatcattaaaagaagaaatcggatataaacaatttaaatatcattttaatccagttacgtcgaaagtgtattttttattggggataattggatttagtttggtcttatcatcttcaatgcttttggcggttctgatttcttatgtaatagatagtggagttaataagttagctatcatcacatgtatgttattggttttttctattctttcattaatattttttggttttttatctttaggtaagggaaataaggaagggatttacatacatcgtatactatatcaatctacattagtcattagtgttttattattattatttgatagttcgccatttttgcattttttctattatgcattagttatggttttttctttattaattaaatttattatgaatagttatttttattttaatgcggtaagagatatgaagcttttcagaattactcatatttttttgactaaagatacacaagaaatattaaacatgactcggaaagagtctaaaaaacgtattaaagaagttgaatttcagagacggcgtgagattaaagagaagaaaagagtcaaagaagcagcaggaaaataaaatttatatacctatcgtcattggagatgcttgatttctcattcaaatcagataatgttaaccaagcaattaaagataggatagaacagggtggtacattaaacgttatcttatagaatctatacagaaggcattgcggaaccatctgagagactctctcatcgcaactggtgggtttgtaggtagaggaatgacaggaacaattaggaattcagaaaatatattaacgtcaggtaattatatgattggttctattgtctctgttgcttacgaaaaccctgttagttagttatctgaataattatattgattgcattaatacattgattgtgataacaactatatgaatatgaaagattttattttaaatacagaatttaaaaaacttttgggtaaggctaaggatctggaagcaaaaataaaaaatgctgatccagtgttaaaaaatatcacgttgaatgatcttagttataataaatatttttcttaccctggtcggtttaagataggttttataatattttttattatgatagtttatatggctttcttttcaggtgtagcggtagctatacctagtttattaatggaaaatccaagttatgaaataaaagcattttcttttattttgtcattaataattagtgcttttatttcattttctcatattgggcttactttgagtggttattattatggtcctgttgtccaaaaatatacaaatactgttgtattcttttttagtttgtttatatcttatttgaaaggagtgtatgactctgatttcttctatttttctgctatagcgttatgttgtttgtttatcaagttaatgttgaatagtaaatattattctggttttatattggctaaaatgttcatcagggttgaacgtgttatttttaatgatgaattggataaaataaaaggatttaataaaaagcagttaagggaatattcaagatctataaaatcgaaaaatcgtaagaaataatagataaaaaataaagaaaatagaaccgaatagggaaagctaaatggacataaaacatatattaactaacaaccaattcagaagtattttgactctgtataaaatcacagataatagaatcagaaatagtgattctttacttgtcgacgaaccggatatcgtcaggattaaggataaaataacgtctgccaatgaatccgcacaaaaatcattatgttatttaactcattgattatgcttgccgcaatcgtttactttttttatcttttcagggtaacgatttgaataagtttcctgtaggataggtcgaaaacttcgttttttgggaataaatatcatatgagcacacttaattctggtcctgcaaatcaacagggtctgcttcagcgcgtgtttaagttagaggaacatggcacgacggttcgtactgaaatgatcgccgggtttacaacctttctgactatggtttacatcgtctttgtcaatccgcaaattttggcggtggcgggaatggatatcaaagccgtatttgttaccacctgcctgattgccgcatttggcagcattatgatggggttgatggccaatcttcctgttgctgttgcacctgcaatggggctgaatgcgtttttcgcttttgtcgtcgtcggagcgatgggcatttcgtggcaggtcgcgatgggggcgattttctggggcgcggtagggttgttgatcctcaccatttttcgcgttcgttattggatgatcgctaatatccctttgagcctgcgcatcggtatcactagcggtatcgggctttttatcgccatgatggggctgaagaatgcgggcattatcgtgccaaatccagacactatcgtctcaatcggcaatttcgcttcccataatgttctgctgggaacattgggcttttttatcattgccattttggcagcgcgtaattttcatgccgccgtgctggtctccattgtcgtcacaaccgtcatcggcctgatgatgggttatgtggagtatcacggtatttttgacctgccgccaagcgtgatgagcgttgtcggaaatgtcgatgtcaaaggtgcattggatatcgcattgtccggtgtgattttctctttcatgctggttaacttgtttgattcttccggtacgttgattggggtaacggataaagcgggtattgcagacagtagtggtaagtttcctcgcatgaaacaggcgctgtatgtggatagtatcagttcggttgcgggttcttatgtcggaacgtcttcggtgacagcctatatcgaaagctcttctggggtttctgttggcggacgtaccgggctgacggctattgtggtgggtatgctgtttctgttggtgatgtttgcttccccgctggctagtatggtgccggcgtatgccaccgcaggagcgttggtttatgttggcgtattgatgacatcgagcctgacacgagtgaagtggaatgatctgactgaatccgttcccgcttttatcactgcggtcatgatgccattcagtttctctattacagaaggtattgcgctggggtttatcgcttattgcgctatgaaactgggaacggggaaatggcgtgaaatcagtccttgcgttatcgtcgtaacattattgtttgtgctgaaaatggcgtttgtcgatgctcactaaatagcagggatgataagaaaaagccggatatgcactacccggcttttttagttatcgttactgattattttcaggggtaacgaaaccgatacagacggtttcagttttggcactcggctgtggccggaaggagaattcttccttgtagctgatgaccaacactggccattgcttgagtgtagactggaagttttcctgttcgcagctcttacctttctctcccaccaataacgcaccctctttcacaatactgctctctttgatatggcgattatacacattagggggctcaccattacctaactcccaaggctgtattgtttctgggcggtaatgactgtaaaacgtcagccattgatgcagatattctccgccaacataacgcaatggagtcggataaagctcattccagcgctgatccagttggttagcgaacgtttttataccaacgaacttttgcccggcaccacggacattggttatcatcacaccgacatagccaatccaaaccaataccgcaaagactgccaaaccccgtagtgtgtttttcaggggcttgcgggggagtaccgtcagtgaaccgacgagcagcgcaggtgctaccgtcataaatggttgtagccactcggtcattcgcccgccctgattgaaggaaaaccagccataaatcagcagcaggggcagcaggataacgatattggccagcgcgttggattgctgtttcggccagccaatccgtccgcctgacaggtaaatgaacgcaccaacgatgagcaagggatagaacacggaaagtaccgctcgcgtggtgtgcaggttaaagccttgctgaatctgggagtcgacccatttaaatgcggcgaagtcgttatgcaccagccaccagacgttgggcaatatcagcatgaaccagagtgcgatagcgagataaaacaggggctctctatagctacggcgtactctgggtacgaacagagagagcaaaaatacggagccaatgatagaaagtgaagaatattttcccatcgttgccagccctgtggtgagggcgaatgccagccaccatttgggatgatcgtcaatggctcgtaggaaaaacagtagtgcccacggccagagcatgactaacaggtaattatcattataaggaatgatatcgaagttgatgatgccggacagattcagtgtcagcatggcaagccacgccagttcaactttgcctgtcaaccggaaagctaatcgccagacacccagcattccgatggcaatggcaagaaagtgggtcaaataccagtaaaaactgagggaaattgtgctgatgtgaatggcgggtagcatcactgagcccactagccacggatttttgggtgatccccattctccatttataccccaatttaaggcttcgacagcatcataaggtacagtagggtcgagtgtgtagcttgcgactacccacaaaagcgcatagcccgtgatccaaagaaacaacggcatgcgataagacgaagtatcaaaaaaacgcatagcggcaaatgatcatattgattgagttaaagttccgtagaatattagctgaattttgaacaattagtgaatgacattggatgttataggtggtttctgttagattccgcgaaaaatattctgattaagcgagtaggatcacaagctatgaaccagttaaagaaaaagtcaccagcgaaattttcggctggtaagcaaaaaagaaaaagccgtgaagagttgaatgctgaagggcgtgagcgtaaacgccagaaaaaacacagtggtcacccatctggtaaccgtaatcacggtaatgacagtaacaagaatcgttctggagacaagcaggggcaagatccgcgtatcggcagtaaggttccggttcctttgattattggcgaaaaagtcgtggtaaaaccggttgtggaaaaaccgaaagccagccagaagccccgtctgtcaccacaggaggagctggcaatgctggagcaggatgagtatctggatgagttgctggcacgtctcgagaagggtgaagaactctctcaggaagaaaatgcttatgttgacgagaagctggatcgtatcgatgagttgatggaagaactgggcatcaatctggaagaagatgacagcgaagaagagaagaaagaagatatcatgcagttgctgaagggtaagtaatttcagcataaatttgtcgcgatcataaaggtagattcattctgataaccttacttataaccacagtattagtatgttatttattgtggttattgggtaaactatggcagctattgagacgtaaaaattggttgactcgtgccatcggaacacagcgctgtaattcagtaaaagcgttgcgtttcggggggcgaaaacaacggaaggaatcagtatgtcagagccagtcattgtttgggatttacctttggttcagaaatataactattcagggcctcgttacacttcatacccaacagctctggagtttaaccagcagtacgataatactgcttttgcacaggccgccgcgcgttatcccgatcgtccactttccctctatatccacattccgttttgccacaagctctgttatttctgtggctgcaataaattggtcactcgccagaagcataaggcagatgactatctgaatattctggaaaaagaaatcacggcacgagccagattattctcccagcggaaagtcagccaaatgcattggggtggcgggacgccaacttatctcgacaaaacacagatcagccgattgatgtcggtgctgcgtagccactttgattttctgccggaatccgagctttctattgaaattgatccacgtgagatcgagctggatgtgattgaccatctgcgccatgagggttttaaccgcctgagcatgggagtacaggattttaataaggaagtgcagcatctggttaatcgtgagcaggatgaggattttatcttcgaactggtcaatcgcgcccgcgaaacgggttttatttcgaccagcattgatttgatttatggcctgccgaagcagacatcagagagttttgcctttacattgcagcgggtgctggcgttgtctcctgatcgcctgagtgtgttcaattatgctcacctgccggacttgtttgcggcgcagcgtaaaatcaaggagcatgatttaccgagtgcggaacagaagctggatattttgcagggcaccattgctaccctgacgggcaatggttatcagtttattgggatggatcactttgcccgccctgatgatgaactggcgattgcccagcgggaaggtgttttgcaccgcaattttcagggatacaccactcagggagagtgtgacttattgggcatgggcgtttctgctatcagcatgttgggcgatagttattcccagaaccagaaagatctcaaaatctactacgcggcggtggaagaacagggtcatgctttgtggcgtggtttagtgctgacacaggatgactgtattcgccgtgatgtgatcaaagatcttatctgcaactttcggctgacttttgcggatatcgaacagcgttatgggttgaattttgccaactattttgccgaagacctgcaactgttggctccgctagtggaagatgggctggtagatatcacggagaagcagatccaggtattgccaaagggacggttgctgatccgcaatgtctgtatgtgttttgatagctacctgcgtaatcagatgcgtcagcggcagttttcacgggtgatatgagccagtaaattgataattacgcgatccctaactccttcaatttccgggtaatcgtattccttccccatcccagcaaacgtgcggcttcttgtttatgaccgttcgtatattccaacgcacaattgagtaaggtacgctccagcaacggcaaagcatcggaaaggagatcagtgcgtccttcttttaaggcgttctgtgcccactcagccaattgtcgcggccagtgttcaggcagtgcagaacaggaggagggaagattgccgatttgttccgttggagggttctcaatcagatcggcaggcaaatcctgtaccagcacttctttgctggctgccatcactgtcagccagcggcagacattctccaattggcggacattccccgaccatgacaggcgcatcagagcgatttcggtatcgggatgcagcactttggcctcaacgcccaattctttggcagtctgttgcagaaaatggtgtgccagacgggaaatatcttccacgcgatcccgcaaagggggtaattgaacacggatcacattcagccgatggtagagatcttcgcggaacttaccttccgtcacacgctgttcaaggttctggtgggtggcggcaataatgcgcacatccactttcaccggcgcatagccacccacccgataaaactgcccttctgccagcactcgcagtaagcgagtctggatatccagcggcatatcgccaatttcatccaggaatagcgagccaccattagcttgctcgaaacgcccgtgtcggacttgattggcacccgtaaaagcgcctttttcatgaccaaacagttctgattcaatcaagtctttcgggatcgccgccatatttaaggcaataaaaggggatgaagctcgtgggctgtggcggtgcagcgcgtgggcgaccaactctttgcccgttcccgattcaccattgattaagacactgatggaggaacgagaaagccggccgataatccggtatacctcctgcatggagggggcttccccaattatctcagaaacagaggctgccacttgcggattgcgcgatgattgatgttgttcgcggtaatgactcaatgcccgctcaaccaatgtgacagtttcatcaatatcgaagggttttggcagataatcgaatgcaccttgctgataggcactaacggcagcatccagatcggaatgagccgtcatgataatgacgggaagctgtggatggctctgttttatctggttaagcagattcaggccatctaaacccggcatacggatatccgacagcagaacttccgggcagttctgtgagagtgctgtcagcacggaatcggcattttcaaaactgacgcactccagacctgcgccactcagcgcccgttcaagtacccagcggatagaactgtcatcatcaacgatccagacttttcctcgttgcattattatcccctatttcttgctcggttatttcttgataggcaggtaaatggaaaattccgtgtgacccggccaactggtgaattcgattttgccagcgtgttgatcgataaggttacgggcgatggataacccaagtccagttcctccttcatgcccactgaccatgggataaaatagcgtatcctgaatgttgggaggaatgcccgggccgttgtcttcaatatcaattctggctaccagacgatagcgttcaccatgtaaggtaatttggaacgcggttcgggttcgcaggatgatcgttccacctttttcccccagagcctgtagtgcattgcgggtcatattcagtaaaacctgctcaatttgatctggataatgcgccagctctggcaggctgggatcataatctttgatcaaagtgacattggcgggcatttccaatgataccaactgataaacccgttcaacaacatagtggatgctctggctgattcgggttcccggatgctgtggacccaacaatcgatcaacgagggcgcgcagcctgtcagcctgctcaataatcacttgggtatattcccgcagggagggatcgggcaacgcttttgcaagcagttgcgccgctccccgcagtcctccaaggggattttttatttcatgtgccagcccccgaaccaattcccgcgcagccgcctgctgtgcctgttgtatctgctcttggcttaaacgacgctggctatccataggagcgagttccagcagaataaactgttcggaaatgggttgggcactgagcgacattacatgagagtgattgttgatcaccaatatcacttcgttatcggtaaaaccatgacccctaatcaaactggaacgcatcaattctgtgtccagtgagagatagctgaatagcaccggaaggggagtaccgaataatttacgcgtactttgtgccagtagttgcatggctgaatggttggcatagcggataatcaaatcgttatccagtaccaagacactgttaatcagtgagtcgagtatgtgttctgctttgggaaaatcaaccatcatcatccaacctttgcacttttttggtgcattgtaccttagttaagcataaaccgggcagtctctccgtgcagtctgtgatttgtttatcaagtgtcatctgccgtcgcaaatgtgcaggaaaaggacccatccgaagatgggtcaaaagtttcacggcaacaaaaagggcaattgtgatgctatcaagtattacacgctgtaatacagttcaaattccagcggatgtggcgtcatgcgtactcgttcgatttcaccatgcagtaatttgatataagcatcaatggcatcatcagtgaaaacaccaccacgagtcaggaattcccggtctgcatccagagcggctaacgcgtcatccagagaagaggcgacggttgggatctcttgagcttcttctgccggcaggtcatatagatttttgtccatcgcatcgccaggatggattttgttgatgatgccatcaagacctgccatcagcagggcagaaaaggacagataagggtttgcggccggatcagggaaacgcacttcaatacggcgggctttggcgcttgccacaaccggaatgcggatggaggcagagcggttacgggctgagtaagccagcatcactggcgcttcaaaacccggaaccagacgtttgtacgagttagtggttgggttggtaaaggcattcaatgcacgggcatgtttgattacgccgccgatatagtaaagcgccagttcggacaggccaccatatttatcaccggcgaatagattagtaccatttttggacagcgacatgtggcagtgcataccagagccgttatcgcctaccagcggtttcggcataaacgttgcggtcttaccgaatgaatgggccacattgtgcactacatatttgtaaatctgggtttcatccgcttttttggtcatagtattaaagcgggtcgcgatttcattctggcctgcggtcgctacttcatggtgatgagcttcaaccaccagccccattttttccattgtcagacacatggctgaacgcagatcctgagaggaatccacgggaggaaccggaaaataaccgcctttgatgcccggacgatgacctttgttaccgccttcatagcgtgtcccactgttccatgcagcttcaatatcatcgatatggtaataactgcccgaaatggaattgccgaaacgaatgtcgtcaaacaggaaaaactcaggctctggcccaaacaggacagtatcggcaatatcacttgcacgcaggaaatcttccgcgcgtttggcaatcgaacgcgggtcacggctataaccctgcatggtaccgggttccagaatatcacagcgcaggatcagcgtggcgtcatcaaagaagggatctcgcattgcggtcgttggatctggcattaacaccatgtcagattcattgatccctttccagccaccgatcgatgaaccgtcaaacattttgccatcttcgaagaaatcttcatcaatctggtgggaaggaatggtgatgtgctgttctttacctttggtatcagtaaaacgtaagtcaataaacttcacctgatgttcttcaatcatggacaaaacatgttcaacggacatactgagttctcttggttgacgtcagcctgataattcggcgcaagggacatgcggcgttatctaatgggctgaaatgggctgatgatgtgtgtctctgtatagggtcaatgtttataaaattgatgcttatgagaagagtattgcgagaagtgtgccaactttttaaaagtctttaagatcagcggatgagtgggttagtgggtaaaaacggaagaaatcacagtcaagttttaagtaaaattgcactaatttagtgaagtaggtgagcaaaaaaacaaatttgcaccattatagtgaaaaataagggaagtgcagaccattttgactgatagtttatgcttagtgctacagacgaaaagattgcataatcaatttattagaagctgaatatacgggcgcagtcatgatctcaactagaaacattgctcttgctcatataaaaactctgaaaatgcttaccgtgggaggccattcccacggttttctgttaattccggtggcattttcttaattaccacgttgtccttagtccgacttggcccttcagatcgtagctgtctgcaaaattattcaggctggtgctggctgaagcctgagcatagacgaaagattttccattatcccaactataggaaccacccgcccctccgtctccccaagtgcgatcattgccactgataaaggcaacatcggcgactttagccgagtcatttcttcccaaaacctcttgattaatattgaaaaaaccatataaacgtgtggctttttgacgatagtctatcgtcgtgcctacacgaagtttcagactttggcttcggtcaaaacggattttggctccaaacggatcatgaaacccattcatatttatggaagaatatacgagttgtgcttgtggggtcattgaccatttctgattcaagccaatctcttgtcctgcttccagacccaatgcataccccagcgcggatttactatttcccaaagctcggccggcagtctttgaatgcagatcgttgtcaaagtaggtcatctgggctaagccatccacataaaacttattcttgccgtaccacgtactggtcgcaccaaacgtataaccatttgcacgaatgttaccgtcaccatgcggagagcctacgtctgcatcaatcttcgaatattgcaggaagccaccgcccgtgactgaaccctggttattttcataaaaacgtttgtccataccaatctgagcacgaaccatgttataggtggttgcattcgcatcggatgtagagacacgtggcgacaatttaccgtaagaagcggttattcgcccccataccccagtgggcatctggcttgtactatcgtcagtgctgtcttcggcagcagagcttctgaattcacctgtgccaagcacccgatccttacgtcctccggttcggtcacgcaaggactctggcgcattcataatctgcaacatccgtccataactctcgtaaacgctaacgcctgcctgatatgtgggttttgaattatccgacgatgagcgcagatacaacgaattgtcggcgctattcttataaagacggtaggcatgagcacccgttacaagagttggattacccttatggctatagtcaccagccaaactgaaatttccgcccgctgcacctttcatatcaacaactttgataccttcgttcgttttggcaccctttccaccaacatttttgatcacgagatgagttgtacccgatgttttgccattcaccacaagtctgtcagtctttgagctatcatctcccaatacagttgataaactcaccgtaccgttattacttctatagtcacccgtaatcgtcagcatactccctacagcgttgctatctccgcccatcacgactctaccactgttatttaaagcgggaattgtcgtattaaatccccccatatcaagcgtaccacgttgcccgattgtataggatgataatgggctgaaagacttctctgcgccttggagaagtgttccttgttggactgttgtcgcgcctgcatagttgtttgccctctgaaaaatggttgtgccgctacccacttggtgaacagagcctgcaccgcttatattatgaccataaatcactttatcgctgcgattgaaataaaactctccatcattaactatattgccagaaatttttcccgttgtatgtccgtcgcctaaacgtaacttatttcccgatgatatcttaacagttccgacattcatgttgtgggtgtatgtaaaatctagatttttcgctttatcagtacggttcatattcccaatagtaacaatcgaatctttcgtcccagaaacatctcctttaaggattgccttcgggccagacagataaagtctggcgcttccaagctcgacattgccgtcaatcgtgcccgcattatcaatgccgttggtgatagttcccttattatggatagagaatataatcccttttatcacgcctgtatccgtattcgtgattgtctcaataacacctttatcgtcgacataaataccttttgtatttccatatatggtggaagcgttggtaatctttttaattctggacggctggattttcttactatcactagccgggccttgcccagtaacttcaatggcattcacaccggcaattattcctttactcccaacctgattattgaggcctttgagagtcgacccttggctaactataatgcctttattggatacagccactgttccataattattgaaaattccgacatcagcgccgtatgcagcagtcaaagctccgggaggcaagaagttactactactcgactgagacaatattccataattattaagatttgtaagtgttcccccgttcataatgatcccctgaatcgatcctcccttctgattctggatggtatctatttttccgtaatgaggatttttaataacaagctcaggtatgataaatattgaaccaccagcaccagcagggtctatgattgaaccataattctccagtgtcttcagggtaccagcaacagttacacctgatagtgcagggccgccgcttatggtgcttatggttccacgattaaccagtttttcaacaagaccactgggagttactacgagtccattagttcctttcaaaattccgttattttcaatgttatgaaccgtaataagcggatccttaatatcctcattaccgacattgacagcagaggttttcccagagtatttatcatattggcttgccatgaacccttctgtgggaacaataattgatacacctttatcgatagtaagattttcattatttgagagataacagggtgtcgtcctattttgggaaattgtgggtccacatgttgatgcagctattgcattaccgcttattccagaaaaaaataaagctactttaagagccattggcaatacagcgtatctgtatattttcataagagaagttcctaaaaaacctatgtttcgtttaagtcagggaattacgcacctgatgtgtactaccaccctcagccaatataattgtgcttgaaactcattatttgggtaatgggcgtataactcgttctatcttatgtggtacatgtatcagtattatagcaattgctatatatgcaacatttagacaattattttaaagcgttaatttaatatttttttattttttaatgagatatcatcatggctgttacgatagaagtgacttattgatattgcgaccaagctgaatctgtacgcaaacacggaacaggtaaggccggcttccctcgctacttaaaatataatatttaattttatattgaatgacagacaagctgcatagtggcttttctgattattgataatgtgtacttgtgcagattcactctggtagttatcaaattgtgtgtcagatcaagttactattaacctgaatcaggctctcctttcttccttaaaatactaattgaacagtaaaaagtgcaccaacattaataaattatttaatatcaatatatgtaagtaataaggcgcaatctgtcatataacatcaacgttgattgcgccttctggtttagagtgaactaactattattctggtatcagatatcatattaatccatataataggtcagcttaccctgtaatagtgcttgtacttcattgctatctccaccaccatcagaaccaccccaggtatggactttgttatctgctgtcagagcaagaaatgctgttcctgttgagtagatggctcttacattctttatttcaggttggggtataaagttaacgttactaggttcagcattttgccaggttaatacggtaccatcttgacgtaatgccgcagatgcattagctgagcaagttatttgaaccacatctttgagagccataaattcttcgaacactgggccgtcgttataattctgtattccatcccaatatatttttccatgtggaggggtgcctcctggcataagaaatttttgtttagtggttgctatatctactccattactacatgaatcgccatcggagctgctggctggaaccgaccaagcatataatgtaccatcacggtgaactgcgtaattaccgaatgggacgttaaaattcataagaaagggagtaattgaagcagcttgtatgaaatcctgatgtgagggattaaagccgacaaatacacttgaatcaccccaagtagaaagatcaccactttcgtctataacggcgaatccccttgccattgatgtaatgtaacgtggtttcgaaacagaagaataacgtggatctggatctaactgccagttctccattgatgagccccacaaactttgtatctgttccgtaccgggattatatatagtaatagcaaaactatttcctacaaaaacattctttccatctccaggataattaaaaatacccgtcattgctccccaggcttccatctgctggttagtgtgcgagatagcaaaaaagctatttccacctgcccccacatcatcaaaggaaccagtagggaagttagagtgattagaatcaccgtgataccataatgtccctgaatccacattaagcccagcataagaggggccatttgtagtaatggttttaactccagattgagtataggaattaccgaaggttcctccccaaccaaccatggtgttgtcattgagcagcacagcaaaagcagagggatattgctcttccaatggatcgttaaaatctgcctttggaagacctagcgtaccaccattaccaaacacattgattgggtttattttgagcttgttaccttgctcgtcttgaactgaaatggggagccacggagcagaatcatagaaaaatggggaattaatatgtgaaaaaggagaagtaaatgatggtgttccacctatataagtccatgttactggatgtggcttaccctctttagtccaggcagtcagcctctgtggtgttttaagcccattagctacagcaaggtcagcataacgagcacccataacgataaagggttctttgtctgatggtggggttgtcggtgtgccatcgataacttttatgtgagttatgggagaatacgatatattatcgtcattatttattacagtataatgaaccaagtattggccaggcgaaattttatttttgggtattttaatctcaaaataagattcagtataattacggactgtataagattccccacaaatagtgttgaaacaggccataatactatcacgatcaaagaagacttgagcgctgttgtctatttttataataatatcaccctcaattttttttaaatctaaagtatcattattgatttgtggcaaaattggggctggaagtttattactcataattttctctctattatattgttgatatgataatgtattaatatcaattctattaacaatcatcctctccggtagaggcggtatctattcttcctatccaagtctgagaatgggtattttctgatcgtacttgatagctaaactcgatacggccagccgtgcagtccttaaattcatggcagtccctaacaaattttctggcaatatttatagtagtagttgtagtttgaccatcagggccagctacagaaggtatctgtttagaataagtttttattacagttctaggattagattttatatgcaatgttaagtctaccatactacctaatggtggcttggtcttatcagtgatatcatttgttccagtaatttgaacaaataatgcgggatcatcaaggtcatgacttttagagattgctttacaattcacagtattatgtgaagtggcgtgctcacaatctttagggtctgcttcttctataatattattgggatcattaaccccaaaactagaataaactacgcatttgtcataataaactggcttaggccatgactctcctgtatatgttagtgtaagggatcttgaatataacgtatctctgccttggcgaaaaactacgtaggaaaaggtagaaactgcgcctactgtaaaggcaaaataaggcattgaaaaagaagagtaattcccaagctcacttaattgcaaaagaggatattcatatattgtactgacattattaatgcgaattttaatcatatctcctttttgcgcaccggggtaaggaggaatatctattaagaaatttgtttgtccatggtttgttagttctccgccattatcatacccttcaattccaggagcggctaaataatcattcggattttctggtttatcatttacaatattcaatgcactatcagcaggaatctcattcgtaataccaaatattcttgtataaaattcaagagatataggctgcagttctttagcataaatataaaagactaaattaccgtgccagtcggtggacagaaaaatcccttcgtcgttaatatttttttctattcctatttttgttttgttgtcagattgatacaaattgactttttctatatcttttggatttaaagaagaaataaatacaaagactttaggtatagggttaccttgctcatctctaactgttgccataactctagtccgtgatttaccctcatttccactaggtggataatttggttgagttggcacctctaaagcatttttgtcataagaaagtgttaatgaatcattttttaatgttcttccagtatacataactgttgtatttgggaaggaaacgttacttgatatatatagtccaaagttgatgctatccccatcatttatatctggagatatttctaaaaaaagcgtaaataacccagaatcctcatctgaacgggaagagtctaataatgtaaccttattatctgcatttataatttgaatataagtgttatctgatattttaacatcagatgtcagagttacattcaaattcaatctttgacctattataacgctagaaccataagggacagaaagagaaacaggactactcattacattacctcattatttctatttttaagtttgatttttaatgaataaattaccaataaataacaattgtttcatgagtcatttatacactagattgcttatcaatcaataattggggtgtctatacgtccttgccagactttaccatatgtgagatcatcgtcattatcaaatccaatttgataatcaaagtaaatatcaccgcctctatctggataagctaaacaatcaattaaacagctatggggtatattaaatattaactttgccgaattattatttccgtctggtaagttttgcattgtttttttaagtgaatgatgaactgttttagtactagaattaatatataaatttagaaaaacctctgaaccaagaggcacgtttgaattgtcttttagatcgttggttcccataatttgaacaaataatccagcattgtcaggattgttcctatagttagatatttcagtgctatcaacataatccatttcttgtagaatgttatcaggggaaataccagcactattataaactacacaagtattgtatattctattgatgtctggctggggtgtattaggaactcctcctttaaaaacaatactcaatggatatgaataataaacattttcgttaacagaaaaaataatataataaaatgagcaagcgacgtctttatatttctcgaaaattttatagggtagttttatagaatacccacctaaatcatcaatgctttcgatagtaaatgcataaccagtaaatatattgttaacaaagaacaatattgtgtcttgagattttgcattatcatactggtctactttggttttgaatataaaagaattaggcgatgtcaagttttctccatgtatattttcaatatcagggggatctaataagctatcattaccttgaggttggctactggcaacatataattcgttcatagaatgaatagaagatgttgcattataaatcattgaatctaaagttatcttagtagcgactcctatatgaggataaacataaaatatcacttcacccttttcatttgagtttataaaaaaacctttcataggagcagaagtaacttcaattttatttttctcagagtcatagatatcgaaatccttaaaattatatagataaggaataaatattggcgttccagataatggttgtccatctgaagatttaatagttgtcatgaccttactgcagatttctccttgtgaaggaaaattaggttgatctggtgtaggtaaatattttttataaaatttaagagataatgtttcttgttgtatatgtttagctacatattcaacatgttttgtgccaaaatatgaggatttgatatcaaaagaaacaagctcacctgaggtgatcttatcagataccaataatctgacaaaaaatgatcctgatgtattattataagatggggtgaaggacgaaatttttccaacaggggagatataactcgtattttctaaagagatggaaatagaattatctataggtatattggatgttaattttatttctgctatgaattcttgactgatgattacatcagagtttggttttacagaaacactaactttaatcatatatttattcctttaaaattaatgcattacgttatgagtcattcttcttttttaaataaaatagatttaaaaatgaatttaggtttatattctattgttttttcttcttcaatttttatggttgtaataattgttttatttttagtaatctttaatttaaggtctttctgtgtcaatttttccttgccaaattttcccataatatttagttccagagtttcctgggtcagatggatcataagcataatagtcaaaatagatgtttccagcagaactattaggatatgactctatattatttagataatcaataggaatctcaaatatatgtgttgctgtatgactgctgtgtggaacaggggttgcaggcatagtaataactttaaatgaatgttgaaattgtttgttataagaatctatatataatgtcactacaacattataacccagtggtactttggttttgtcagtaatatcattagtcccttctatttcaataaataacgctgtgctttttttcttattagaatcatgagatatagagaaataatttattaaatcaccttgatggattagagccgttccttgtgaagcaccaaaactagaataaacaacacatggatcgtaaatcctattgatatcatcaagaggtgcgctcttacctcctccactgtaggtgaatcctagtgatgctgatttttttatttttgcatcatgtgtaacaacgatataagataattcaatattttcatttttgggtataatcgagtaaggtaaatcaataaaataattacctagattatttttattttcaacaatgattttttgatttgagtaactcccattgacatagaataatatagtatcatttctatttggatgattgtatggatcaacttcaacagaaaaagttgttgaatcagggtctcctattaacgcaccatctgatacttctagaatagagggaggggctaaaaaatcagtattaatatttgatagattacccggattagttggatcatcatcaataacaaataaactgttttttgatagttgaaaactttgtgtgtcagttactctggcttgtaaattaagtataaattcggtattgttatccggatatacataaaaaacaaccataccatcttgttctgtttctaaataaaaaactggtctgttatataaggttttttttgttatttcagatgactgacttttattttctctgaaagttctaacattatctaaactagtattatgatctgacattatagtgataggaattccagatacactttgaccaccgtttttagcttttattgtggcaaaaactttagagtatattttaccagttggtggaatattagaactaacattttctactttagttatggcatttaaatattcatttccaaaggtaagggataatgagttattgtctatttccacaacagtataactaaaagatgttgtaagaaatccacttgcattatgaggtacaatatcaaaactaactgtacttcggtctgctaattctttttcaagagtaaatgcaatctctattgagcctcctgtctgtattgtataactaggatgtactggcttaagattaactgattttatgatgtcaaatgaggcattaggtgaaaaatttccttcaggagtttttaaaaaagtaattgtcatttttagtaattggactttggctatatttgattttgttggtattgatgaaattatagtattttccactgtataatcctatgatttataattaaataacaatgttaatttgtattgttttcggtaaaagattcactatgtttacatattaatttatattaatgcactgaatctcataaagatcccttactcctcgctcagtggggagtaaggaagtgtcctgtaattttgaaatgttattagatattaaaatattttcagcagttttttatctataatcattagatagccaattttcttgttgactaaattattcaatatttatctatttgtataatgaaaaaaagttatcagttgataactaaatactattggttaggggaaattctacattgttcgtaactcaattaaatataagttcattgtaaaattctctaaatagctgttccaaataatagatcacttgcagagaactcaatccgaattggacgatctgattaatcgctaaaccaaaaaaagcatccatcggactgagttattccaatcatcacatcgataccgcgcaatgagcgccgtttaatgcaaaaaactattcagaaaacccgcgataaaatcatgcccaaagaattatcgccatactcatgctgtatcgcggagacaccgtcagctatgtcacgcgctcgcgtgcagtcgttcttctggcgctcgctggatacactttatggcctggaaggcttgaaaccactctcttctggtcgtccacgacgttggccatttgaattgatttgttctttgctacgtcaccttatttcagattctcccgacgtattgggttatcaacgctcacgcggggtcattgatataatcaattataaatcaatgagataaccggatggtgttctgctaatgcaacagaaccctaaaaatagctttttagataaatcaccatacccataaaataacttttagttatcaattgataattatctttcatcacaataataaaaatattttctaatattgaggattaggctgttaatcataatttgatgtacttttgggtggttatatatgtcatcatatatttgtaaaatcattggtttttttatctttatttgtccattatttatgccttctatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtatagtatatgggaagacagagtattgtaaaaaacaaactaagcatatgtaaccatatgcttagttttatatttttaattacacaccttcatatttttgacatatttattaggtgcaattaaagaagttttttcacatttaatataaccagattttttcaatttatgatcagcatatatagatacaggaaaactagccacgatagataatataaaaatcaacacgcataaattcaaaaaaaaaccataaaatggcgatggtttatttaataaacaattttttattgccaaaccaaacatatagtaaactattggcaagccaaaacatgcaaaaaacaccctccaagaaaaatatattatgtcattcatgttaatgaatgacatgaagtccctccaagaaaaatataaaaacaatgttgtaataaataagaaaataattgacattactacacaaaaaattctatttggtagagttatgtgaattttattttttttattaataatattttacctataaaaaattggaggtcttggcatattatattttgggtttgctaagtgctcccgaaaccttttttttgcttcttcatttctcaatgcttctatgagtttctcacttacttgatatttatcatcaagataatataatacaccggctacaactaaaccaaaaacaatcaattatgatataagtttataatttcaatgtttctaattctaatgataagactctgccatcagaaacacgcatattcaccccatctgtctgagttgatgacaatagttgaaaacaaaacatcatcatcacagccagcttatcctctgatttcaccggactattgatcaataagttacttattttctgcatcaattattctctctcatccatacgacatctcctatcatgaattaacaattagaatataacatctttatataaaaaatagccatatcaatcatataacaattaaccctttaaaaaagcacaaaatcatgcattactcctccataaggaacaattgtaattttaaatatttttaattttatctatcgaaaattacataaataagtaactcatacgattaacctcatattattgattttattcaatccgttaggaagtctgtggaaaaactgacaagtttgataagtttgagatattagtggtttatcttaacgtctataactatttgataattaacttagaacagcacttttgatagattttttccaacataaccaaaatagtatacttttttataaatataattaagtaacttattgaggttttagtaactttacatttttgtcaatttttccactggaccccatccagcgaactggaaaccccatttaatgttcaattcccgctgaaactgtatggggacatgggtctgtcaggagccggatgcggtagctctgcaagtccggatttcatcgatagcctagacacacacgctgttcagtttgttcgtactatccagtccgtcaaatataagatcctcgatcttgctcacagatctacatatttttcctgatggaaatgcagaaagttacatgtatgtatatgaatgacttctttattttacatttttgctacaagtttgacgaaaatgcaactattaaatatattaaatcataggttatattttatgcattcaatccatcgggggtaagcatgccggtaccaacgtttaagcatttcattaatggtcagtatattgagtctcaaggttccgagtattttgatctggtcagcccggtcactggtaaagcttatgcgcgttctcctaacgcgactgtagcggatgttgatgatgcttatgcatcggctaaagaggcatttaaaatatggggacgcagtacaccctctgcacgtcagcaggcgttactagcgctggctgatacggtggaaaaaaacgctgaacgtctgattgagtcgcaaagccgtaatacagggcagcttaagcacctgattgcctccgaggagattgcgacgtcggtggatcatatccgcttcttcgccggtgcagctcgttttctggaaggcaaggctacagcggaatatctttctggtatgactagcagtatccggcgtgaaccgctgggcgtggtagggcaggttactccatggaactatccgttgatgatggcggtgtggaagatagctcctgctctggcagcaggtaataccgtggtgcttaaaccgagcgatactacgccggaaagtactctgttgctggctgaactgtccgctccgttcttccctgccggcactttcaacgtggtgctgggtaatgccagcgcaggttctctggtcgtttcacacaaaacgccggctatggtttccatcaccggttccgtacgtgccggtttgcaggttgcgtcttcggcggcagctaatctcaccagagcgcatctggagctgggtggcaaagcgccggtggttatttttgccgatgcggatatagacaaagccgtgggaaccattgttaccgcagggtatttcaacgccggtcaggactgcacggcagcttcacgtgtgctggtgcatgaatctgtttacgatattttcgtcactaaactggtggcggcagctaaagctacccgttttggcgatccagaagataaagaggcgctgtatgggccgcttaataatgttcgccagttggagcaggtcacagggttccttgcacgtctgcccgctcatgcccgtatcgaaacaggaggtcgtcaggctgatcgttcgggatattactttgaacctacggtgattactggtctggagcaagaagatgaaatgattcagaccgaaatttttggccctgttatcacagtacagaagtttctaacagaacaggatgctatcgagaaagctaacgatgtgaaatacggactggcctccagtgtctggacccgcgaccatggtcgcgcgttgcgcctgtctcgtgagcttgactttggaacagtctggattaacacccatattcctcttacggcagaagcaccccatggcggcttcaagaactctggatacggtaaagatctgtcggcttatggtttcgatgaatatacgcgtatcaaacacgtgatgagttccaacgactaatacagggtacccataatggttcaaaatagatcttcacgtgacttggtatcgcgtgcgcaccacgagctgtttactgatcgtgatgtgagggcgcttgaacgttattttgcgccaaatttcatcgaacattctccgttggttaaagaggggttcgccggattgcgtgagcgggttcaggcacatcctgaactgcaccatgaaatgtatcgcgtactacaggatggtgacttagttgctattcacggccgttttacgggattagatgagcagccgttggtcggtttcgatctgtaccgggttgccgatggtttaattgtggagcactgggacggcttagtgccgcagtccgcgcccaacaccagtggccgaactcagttagacggcccgactgaaacgggctatagccatgacagagagaagaaccgcgagctggtggttaactttttcacccgtaccctgatcgaagaacactatgatgagtttggaaactacaccaatggtgaagagtttcgtcaacacagcccggatattcctgatggtacggttgcggtcattgagtttcttaagcaactcaaggatgaagggcagggcctgcattatgccaaaatccaccatacagtcgccgacgggcagtttgttctgagccactcggagggaagtattgccggagtacgtcacagctactttgagctatggcgcattgagaacggcaaagtggctgagctttgggatgctatcacaccggtaccggaggatgcgcaagcgctgcatcgccacggtatgttttaacgttgtttgccgacaggctgaaatccgatgctatttcaatcaggaattagagaatgacggattattccatcatctatgcaccgctcgatcaggctacccggactgaacaggttgtcgaacgtttaagtaacgcaatcatctccgggatattacagactgatgcacagctgcctaacgaaaatgaactgtcgcggttgttaggtgtgtcaccggtaactgttcgtgacgccctgaatacgctgcgcgccagacagttgatcgatactcggcgcggacgtcatggtggtagttttgtatgtcaggttcctgttgaggcaatgcggaaataccatccgttgcggctgatggcttcaggtgaactggcggatttcagtgaatttcactgtgccgtgatcggccacagcgcgaggcttgcggctcaacgttcaacgcagggtgaactgagaaagcttgagcaactgatcgacagctttgcggccgcgacacaaccggatgcccgtattcagacagatatgcgctgtctgttaacgctggcatcccagtcacagtcggctaggcttgccaatcaggagctggagattcaggccgaatggacgcctttgatggggcttctgtaccaagaggctgccgttcacagcgaggttgtcgccgcctggcgtacactcttggctgcgctgtatcagggtgatgatctggcctgttaccagttggcgcagaagatgattactcaaattactgaccacctgcttgaatgcaaattgcgtgtggatactgatgcgccattcttgcagagatctgatcgcgagtaacacggctgcattcatcccaggagagggggaaggcatatgtacaacgatatacacgtagaacgggccaggagcatcctgaacgatattctggtcacggcgcagcaggccaccgcagctctagcggataagacagcgcgtattttattggaactgccgttatgtcatacggtaggtgtccgcttggcgcgggagcaacgcggcgcattgcaaaaacatatccacgatgtactgcgtaataacgtctggtgtaacggggcgggatttgccagttatgcagtcccgaagacggttgggaaggagggatactggacgctggagtggtggcgtcaggaaggggataccattcaatatgcgccactggaacacaatcaggagcagcgcaggcgcctggatttccggttgtttgagtggttcaggcagccggccaactgtcatcttcccgtcattgacggcccctatgtggattatgtctgtaacggtgcctacacaattacgatagcccatccggtgcttatcggtgaggaatttgccggtgttgcggcggtggatatgctggtctcgacgctggatcggttacttctgccggctctgggcgctatcggtaagccagcattgattattaatgacgatgcgcgtgtcgtgacctcgacagtgccgggagtgcgttcaggttcgctattgaagagccaaggcgttaaccggtcggtcgatggtgaagtcccttcactgcgtctggtaattttgccgtcatcacacactgaatcacacagggcatttgtctgctgaaacccacttattcagattgctcaggagtttttatttatgactgaatctatgttagctaaaaggcgcagcgcggctatcgcaaaaggcgtcggcgtgacgacacaagtctatgttgaacgtgcggaaaatgctgaaatctgggatgctcaggggcaacgctatattgattttgccgcaggtatcgctgtggtgaataccggccaccgccacccgcgcgtcattgccgcagccagagagcagctggaacaatttatccatacctgtcatcaggtcgtgccttatgaaaattatgtagcgttagccgaacgactgaaccgtctggtgccgggtaatttcgtgaagaagaccgtttttgttaccaccggggctgaggcggtagaaaatgctgtgaagatcgcgcgtgccgcaaccgggcgcagcggcgtagtggctttcagtggcgcttttcatggccgtactttcctcggtatgtcattaaccggcaaagtcgtgccgtacaaaatggggttcggctcgctggttagcgacgtttatcgtgttccgtttccggtagcgctgcacggtatcagcgtggaacagacgctgaacgcgctggataatctcttcaaaaccgatattgagccgacgcgtgtcgctgccatcatcattgagccggtacagggagaaggcggtttctatcctgcgcctcccgaactgctcaaatccctgcgcgaaattgctgatcgctacggtattgtccttattgccgatgaaattcagaccggtttcgcgcgtaccggcaaactgtttgctatggaacatcatgaggttgcagccgatctgaccacgatggcaaaaggtctggcagggggatttccgctggcggctgtaacggggcgagcagagctgatggatgcggtagcaccgggtggcttggggggaacctatggaggtaatccggtggcgattgcggctggccatgcggtgctggatgtgatcgaagaagagaagctggctgcgcgtgcgacgcagctgggagagcggctaaaacaatgtctgaatgaactgcggccgcgtgtcccgcagatcgccgacgtgcgtgggcttgggctgatgattgctgtggaatttaaccgtgcggacagtcaggaacccgatgccggctttaccaacgccgtgcgtcagaaagcgctggagcggggtctgattctgttggcgtgcggtatacacggtaacgtgatccgttttcttccaccgctgactatacaaaatgatgtttttgacgaggcgctcaacgttctggagtctgtactgctcgatctgaaccgtaccgccgtttaaccggagggtaactaaggagggattaacccaaaatgagcgtggcggcagggaggaacccgctggttcataagagaggacaacaatgcactggtatttaaatgtattaaataactatgcctgtttcagggggcgagcccagcgtaagacgttctggtattttgttctgtttcagattctggctgttctcatcatttctttcttggaaaggctgtttgctgttgccaatcccgaaatttatatggggtggttcagcgctatctatctgctgctcacctttttaccagcgctggcggtaaatgcccgccgcctgcacgatatcaactgtagcgcctggtggctactgttacatcttatcccgtttgtcggcactgttatcttactgattctcgccgctctgaaagggcaggcgggcagcaataaatacagttcagagagccgggtccattcacagggaaatacccagagccaagctaacgggtgatttccggtcataaaggagtgctgaaatggcaatgaacagaagagattttatctctactactgctgcccttgcaggggcgggagtgctttcatctttacttcccaccacttctctgctcgcccggactttaactgcggccgatgcttcggctgttaatattgaccaactccggccgacactgttgaaggatgcacagtacagaaccagccggttggggttggatccgcgcatttggaactggcatagagacgtggctgccacagccatgccagccaactattatgaagcctctctggctgattggccggcttttggaagctttcccatagaccagaattgtgaggttgtggtcattggcggtgggttgctgggggcttccactgcgctgcatcttgcagaagcgggtgtggatgtgattctggttgaaaaggataacattggttcgggagcctctggccgtaatggagggcagatgacccccggaattgcccgctgggaagctgaaactatgctggaaaaactttcacccgatgaggccaaacgtttatggcgttttgcatcggttgaagcgatgaatcttgtggatgaactccgcgaacgttacggttttgaatgtgatcgtaaatatggtcatattacagcagcgatacatccgggtcatatggggccattggtggctaatgccgatgcccggcgccagctgggagatacggcggtgaaggttattgggccacacgaattgcaggaaaggtatgtgcgttcgggtatctatcatggtgccaatatcgacagcatcggtggacaggttcagcctctggcgctgctgcgaggcctaatttatagctttgctaaactgggggggcgagtttatgacggcacgaaagtgaagggcatcaggcaggatgccagcagcgcggtcatagaaactgaacggggagtcatcagggcgagtaaagccgtggtactgggggtacatggctccaccgaagagtttatctctggcccttccactaccgtgccttttttcacctatgtggcggtaactccgccgttgccggtggatatcaaagagctgatcccgtcagatctgccagtctatgatacacagttacagatagattattatcgcgcggtgcgtgacaaccgcctgctgtttggtgggcagggcaccggcaattcctggtcatcgcgtgatgtgaacaactatttgcttgagcgtatcagaaccgtgtttccacaactggaaaaacccgaattggaatactcttggggcgggatcagcgatctgaccctgaatggtgccaccgatgcccgcaaaagcggtgacagcgtccctgtgtatatggtgcatggctggagcggtcatggagtggcgcagacggttcgtattggcaaagccatcagcgacgatctcaccgaacgcaatcacgactttaccatgcttactcgcatcgaacactcgagtattccgctgggttcctatttctctccggtggctatcccattgattaaaggcgctctgggggtgataaacacagtgaatccggcagatatggtttcgttctgatgcagcgtggccgcaaaagtctggagtggttttaatcattcaaaataagttatttgtaaattgaaagtttcgatggctctgtgcagagacaataaatgttagtttcactagacgaaatcgactgcgctgagccagcaggaaaataacaaactggtgttgaccatccggggaagcctttatagtacgatttttcccgttttctgaggcaacccctagatacaaaaaaggcgaaaaaaatccctcctcaatggtagggattcatgatacttgttttgctagttcgtaattgggcatcacaacaccaagagattgctagtacctaaccaatccagacgtttttacgatgaaaaatagtttctttgtgaaagaatttattgtcatccttaactgttattaggcaagctaattaacaatcgatcattcgatatgataagaactctgtttgaaagaaagtcatcgcctaacaggccatcaaaatctatccgttcatctggaatttgaaagagaaacgcagagagcttaacaccgtcaggcgtcacaatggctttcttcgggcagtgctgcgataacttagcacatccctcctttgagcgcgtgaaaagcattgtatgacttgcgccagtatcaataaccatacgacgtattttctcattaccagatgacacactgatttctatcccgttccttgtgcgggtaaacgggatagattgccagcggtagccatcaggaagcgctttaagatggtcagctatcgtcagcatctttgaagcgtagttgataataagcgttttgtttttggcgacacccagccctagcactccatttatgataagttgtccgttgtcgtctaacataccgccgttaccccacgttttgaaaatttcaacgttaacatctgaaaggcgttcaccattaacagtaatatgggatgctcttgccgttacagcagacttctcaactccaaaaacatcaatggaattttgcacggttgttgtgcgatggtttagctctgaaaaaatcgaatcaaagacggttcgagggagataaaaagcgccggaagccccagtatcaattgaaagcctattaacttctttaccattgatattgagcgaaacagaaggagtgacatgctcaaggtaaacaatcggcgcagtaatatctgcctttactgcttcaactggaatcattgtaagacacaacgccacgcatacattcaggattctattcatattcagcgatccgttaaggtcagtggataatatttagtgctaactcgtttcccatattaaaacatagcgatggaaggcttagactacaatgctgtttattttgaaattacttataattgattgattttagatgtaatagacaaataaagcatgtgagtatgagcttaggtcttttttcttatagacggcttttagatcatagaaccaagaattgacgataaaaacaaaatgactgcctttatcgtagagcgtgggtaaagagcttaaattcggacaatgactacttcaccaccgggtgtgaacgatacatcagagtctcgatagacatcggctgattgaatgagttttgccatgctgtcttccttctgagtacaaaaagatactggctgcatacgtagtacatacaaccagtatctttttgatttccagagttacaaacgtgcaacggtatactttctacacaacaaccagtgcctgtgcgcaagcccatgcggaactccacgcccattggaagttatatccccccagccagccggttacatcaacaacctcaccaataaaatacagtcccttcaccttatgagactccattgtttttgacgatagctcattcgtatctatgccacccatcgtcacttccgctgtacgatatccctcagtgccattcggttgtacctgccagtattgtagggtagcgatcagttccttttgctgagcaggattaatttgtttcagggaaacatccggcaattgctcaagagattgcagacactctaccaagcgtttaggcagcaatttagccaatgtgttctttagattctgattaggatgggattcccgctctttatccaaaaacgcatccagatccatatcaggtagtaagttaatactcacatactcaccgggttgccaataactggaaatctgcaaaatagcggggccagaaagcccgcgatgagtaaacaggatattttctctgaataccgtgccgtccttcgcggtaacaatggaaggaaccgcaacaccggaaagtgtttgtagctgttccaataacggtttatgcagggtaaaaggaaccagtgctgcatgggtaggcaagatattgaggccgaattgttccgcaatgcgataacccaaaggagacgcgcccaacccaggcatggacaggccaccagatgccacaacaagtgagtgtgcacttacttttttccctgccgtcgtaatcacaaaaccctgctcgtctttttcgatttgtgtcacttcactgcgtaaccggacagtcacctgacctgcctcacactctttcaaaagcaggtcgataatctgttgagcagagtcgtcacagaaaagctgacccaaagctttctcgtgataggcgatcccgtgttgttgaacgaggtcaataaaatcccattgggtatagcgagcaagtgctgacttacaaaaatgcggattggcagaaagatacgcggcaggttcagtgtacatattggtgaaattacagcgtccgccaccggacatcaaaattttgcgacctgcttttttgccgttatccagaaccagaacgtttaacccctcttgccctgcctgagccgcacaaaataaaccggccgcgccagcaccaataatcactacatcaaatttttccattcgtttgtctcttttagccgagttattttgcaggaaatgtactttatcgtgggggactgtccgcgaactacggagaaaaagatatatttggtttaactttttatcgtaaaaagttatttttcgtcaaaaaaatatcaaaatattaaaaccaaataatcaattgatataattgataaaaataactggttggctgtcatttcattgtcattaaatcgaaaaaaggtcatatttctcttttcccgctcgcgtttgtcactgataatgcgccgcgttcatgtcctactaactggcttaacgtttatgctacatctgtttactggcctggatttttataccagcctaatgttagtacttgctctgttgtttgtgcttttctatgaagccatcaatgggtttcatgataccgcaaatgcagtagcaactgttatttatacccgcgcgatgcgttcgcagtttgccgttgtcatggcaggggtttttaactttttgggtgttctccttggtgggttaagtgtcgcttatgcgattgtacatctattgcctacagatcttctgttaaatgtcagttctacccacggcttggcgatggttttctccatgctgttggcggcaattatctggaatttgggcacatggtatttcggcattccggcatccagctcccatacgttgattggttccattatcggcatcggcctgaccaatgcgatagtggccgattcttcggtagttgatgcgctgaatatctccaagatgatacagattttcatgtccttgatcctgtctcctctcgtgggtttggtgattgctggagcgatggtatttttactgcgccgttactggagtggtactaaaaaacgtcgtcgtatccatatgacgcctgctgaacgtgaaaaacaggatggtaaacgtaaacccccattctggacacggactgcgctgattctttctgctgtaggggttagtttctcccacggtgcaaatgatgggcagaagggtatcggcttgatcatgcttgtgctgataggtgtcgcgcctgccggcttcgtggtcaatatgaactcaacgagctatgacattacccgtacccatgatgcagttgcttctttgcaaaagtattatgtgcagcacggcccggcactttcccatgctattgagcagactccggcagtgtcttcggtagaagattcggcggatcagatgctccattgcgacagctcacaagcgcaggatgtgctgaatacggctgctgtgatgctgggaagtattcagaacttcagtgagttgaccccagatcaacgtaacaatatgcgccgtatgttgatgtgcgctgctgatacggcaagcgctgtggctaaattgcctgaaaccagtcttgaagatgcccgtttcctgaataaattacgcaaggatttgctgaataccgttgaatatgccccgatgtggatcatcattgctgtggcacttgccttgtctctgggcacaatggtaggttggaagcgtgttgctgttaccatcggtgaaaaaattggcaaaaaaggcatgacctatgctcaaggtgtttctgctcaggtcacggctgccgtttccatcggggttgccagttatacggggatgccagtgtctacgacacaggtactctcttctgcggtagcaggtacgatgctggttgatggtggtggtgttcaaagcaagaccattaagaacatcatgctggcgtgggtactaacattacctatttcaattggattatcaggcattttgtattggattgctctgcaactgatctaatgatgttttagaaaaagggttagcgactatatttccgtaagctaaccctttttattcccttcttgttactttcagaaccacttcaaattgccatggctatctatttaatattcaaatgagatacccatattttcatacagttaagaaaataaaatggtaagttgtgatcaaaacaacactaaaaagatatattgagcagttatagtataaacagcaaatcgtggcgttttagtgttgccaatccatttaatcagcattatggaaggagttcacttatggcttacaaacatattcttgttgcggttgatctatctccagaaagtcaggttttggtagaaaaagctgtttcaatggcgaaaccgtacaatgccaaagtttccttgatccatgttgatgttaactactccgatctttataccggtctgattgatgtgaatcttggtgatatgcagcagcgtatcgcggatgaaacccgcaatgctctgaaagatctgtctgttaatgcagactatgagattcaggaaacattgagtggttgcggtgatttagggcaggttcttgttgatgctatcaagcaatacgatatggatttggtcgtgtgtggtcatcatcaggatttttggagcaagttgatgtcgtcagcccgtcagctcattaacaccgttcatgttgatatgctgatcgtgcctttgcgtgatgaagaataatctacagttgaaattttattctataaaatcgccggcttatgcaggcgatttttttgtctgaagaaaagatgatgaaactgttttggaaattgtcaaaactatttttaaggaaacttataaaaatagttgttgaaatataagcgtaagaaagtggtatattcagaaagcaaaccacaattacctcacattttcgacaaaaaaataatatggaaaatggctgggggacatcacctctgaatgacaaaaggaagccctaaatgaatatttcaccctctttggtctcatttcttgattcgattcagtctcacaacccacatcaaccggaatatttgcaggcagtgcgggaagtgttgacatcactctggccttttcttcaacaaaatccgcaatatcgtgagcaaagcctattggaacgtctgatagaaccggaaagagtgatccagttccgtgtctgctgggtcaatgatcagggtaaagtacaggttaaccgtgcatggcgggtacagttcaattctgccattgggccatttaagggagggatgcgttttcacccttctgttaacctttctatcctgaaattccttggttttgaacagaccttgaaaaatgcgttgacgacactgccaatgggcggtgcaaaaggggggtctgatttcgatcccaaaggtaaaagccacggggaagtaatgcgtttctgtcaggcattgatgacagagctttatcgccatctggggccagataccgatgttcctgccggagatattggcgtgggaggccgggaagtggcctttatggcaggtatgatgaaaaaactgtccaacaatacggcatgtgtttttaccggtaaagaactctcttttggtggcagcctgatccgtcctgaagccacgggctacggtctggtttatttcacccatgagatgctcaaacgccacggtatggggctggaagggatgcgggtatcggtctctggcgcgggaaatgttgcccaatataccattgaaaaatgcatagagctgggggcgaaagttgtcaccgtatcggattcaggcggcactgtgctggatgaagaaggcttcactccggagaaactggctcatctcgaagagattaaaaatcaacgttacggccgtgtggaagagtatgccaaagagcacggattgaccttccttaaaggccaggatccgtggtcaatacctgtcgatatcgcattgccttgcgctacccagaatgaactggatctggatgcggcgaagacgctgatcaaaaacggcgtgaaagtcgtcgcggaaggggcgaacatgcctgcgaccatttctgccacagacgctttccttgaagctggcgtcttgtttgcaccgggtaaagcagccaatgcgggaggtgttgcaacgtccggtcttgaaatggctcagaacgcagctcgtctgagttggaaagcagagaaagttgatgtgcgcttacaccacattatgctcgatatccaccatgcctgcgtggaatatggcggggaaggcaagcagaccaactacgtacagggcgcgaatatcgctggttttgtcaaagtggctgatgcgatgctgtcgcaggggattttgtaattctcgtgtaatcaaatcaatggtgttttggcggataagccccatgtacaaacacggggcttgttttcttaatcgcagccgtatcgattaacaaggataaatatcgaaacgatgatttttagtcgtaatcgctgcggaagccttagcccctgccagcggttccgcataatcaggccgttttaccacaacccgccgttttgccagcgcacgggcaggctccagcaaaccatctgcgtcttcatcggcgcccactaatgattggaaaacgcgcatctcttttttgaccagcgcgcttttttgccgatggggatacatgggatcgagataaacgacatcaggtggcggtgtaatatccgtcaaggccgtaatacttgaggtgtggatcagcgtcatacgttctttcagccagctaccaatctcttcattctgatagccgcgctgtaagccgtcatccagcagtgctgctaccaccggatggcgttccagcattctgacctgacaaccgatggacgccagtacaaaggcatcgcgccctaacccagcggtggcatcgacaactgtgggcagataacctttcttgatgccgacagccttggcgacggcctcaccacggccacccccaaaacggcggcgatgtgccatcgtgccggcaacaaaatcgacataaataccgcccagctttggctcatcgagtttgcgcagttccagccgttcaggtgtcaagaccagcgccatgacggaatcttcatcgtgaaccagattccagcgttcagccaattgagataaggcgctgctatcagcgccttgttcacagattaaacaaatcttcacaggttattatccactgatgccagagcttttcagcattgcatccagtttcggctcgcgaccacggaagcgtacaaacagcgtcattgggtcttctgaaccgccacgggtcaggatattatcgaggaaagactgcccggttgtgcgattgaaaattccctcttcggcaaagcgggaataagcgtccgcagccagaacatcggcccacatatagctataataacccgccgcatagccaccgttaaaaatatggctgaaggtgttggggaaacgtccccattccggtgatggcacaaccgcgacctgttttttcactgactgcaaggttggcaggatttgcgccccttttgccgggtcatattcaacgtgcaggcggaaatcaaacagaccgaattccaactggcgtaggattgccatcgctgcctgataatttttggcggccagcatattatccaacatctctttcggtagaggttctttcgtctcatagtggccggagataaacgccagtgcttctggctcccagcaccagttctccataaactggcttggcatttcaacggcatcccacggtacaccgttgatacccgcaacatctaacgtttcaacctgagtcagcatatggtgcaggccatgaccaaattcatggaacagcgttgttacttcattgtgagtaaacagggcaggctgatcgccaaccggcttattgaagttacaggtcagataagcgacaggcgtctgtaattcgccggaagtatgacgcattctgccgacataactgttcatccatgcgccgccccgcttatgctcacgggcatagagatccagatagaaactaccgagcaatgtctgtttttcatcatacagttcaaagaaacgaacatcaggatgccatgtttctacatcgcggcgctctttagcggtaatcgcataaatgcggcgtataacttcaaacagaccttcaatgacacgctgttcagggaaataagggcgaagttgctcatcgctgatagagaaatcatgttgtttctgcttttcactataataggccagatcccacgcttccagctcatcgacccaatagtgtgattcggcaaaatcggtgagttcttccagctctcttttaccttgagcatgagcacggttggccagatcgttcaggaaatcgagtacttgcttaggtgttttagccattttggtggctagagagttctcagcatagtttttgaaacccagcaatagtgcgagctcatgacgcagtgcgagaatttccgtcatgacggcactgttatcccactgaccggcatttggtccttgctcagaagcgcgggtcgtataggcgtaatacatttcctgacgcagttcactgtcatcggcataggtcatgaccggcaaatagcttggcccattcagtgtcagcaaccagccctctaaccctttggcttcggctgcggccttggcggcggctttggcactgtcaggcataccctccagatcgcactcatccgtgatcagcttggtccatcccatcgtggcatccagcaaattattgcccgaactgggagccaagctcagataaacgggcggagatctcaccgtagcgtttctgtttttccttcggcagaccaatgccagacaactcaaaatcacgcagcgtattttcgatagctttacgctgtggctgagatagtgctttaaaggcttcgctctctttcagagccttataagcctgatataacccttcgtgctgccccatccaagtttcgaactcagaaatcagaggcaggctttgttcataggcttcgcgaagttctgggctatttttgaccgcattgagatgttcgacaggagaccacacgcgggaaagatgatctttcgcttcagaaattggctggcacagattatcccaagtaaatgtgacatttccggccagaactttctcaatcacttgacggtagttggctaacgtctctttcacggctggcacgacatgttttggttcaatggcagcgaatttgggcaatacagaaggagtcagtaacgggttagtcatagtgagcgccttagttgtatgtttgggtatataaaccgctatatcccaatgggttgttgtcgataagatggggataagatacagcgagttcaatgctgatgccgcacttttatgcggataatcggggtctttttatatcagatatctgtgagatgacgaatgagtttagatgtttcgtggggcgggctataatccctgctcttcattattttttatggaagatcatcgcccccggtggggcggctgggcttcaaatccagacgggttcgccagcggctcccggcaggttgactacgttcatttgctgctgttcagtaatttgaaatctattggataatcatttcttataagaaaggactgtccaattaatggcaagagccaatgttgcggcaataacctctaatacgttattaatatggacaatgttgggatactccgtttttgtaataatatcgcgttatataatttatattttattgtcgttggcttaattggataaggggcaggatgagtttatatcctccgtcttccaagttgctgctttgctggctgtaacctgaaagacgaagaggataactatatcggcttctggattgagttataaattgcatcaagctggttaatacgctggtgataacgttgtagcaggcatgtcttatcgcctttgcatttctggcgttgtttcagccaagcctgttggctgtcatacatttcacccgacatgcccatagcaaataaccctcgtaggaaatgatatttgacgctcatttctatatccagatcattaagccggtgatcagtacagattgctttttcatctggtaccttggcttttgcacagtcaaaactggcagccaaactaagaggagacagaataagcagcataaataatgtatatctcatctactccccttttttaggaaggatcaccggctctggcccggtctgtaattgtggtggtaatgcttttaacaatttgaatgaccgcgcttcgccggttttgggatctaactcacaggagaatctgatatttttccagccaaatccttggcgatacatccctgtacctatgaggtgggaatcaaccaatctgatactgtttggcgattcatcaccgagaaacactttgtcagcctctttgtgctcttgttgaataacagagagtgctaaaggcctgcaaataaactcggctacttttttagtatctgaccagctttctacctctttgaccgctgatttatctgtcatttgtttatctatttgctgttgcaggtatttttgttggcttgtagacaattgggacgatgacgattgtgcttgtacgaatacggaaaagagaaaaaagctggcaccaaaataattcaaacattttaagtaagacatatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtatagaagttattatttaaattagaaacagtatcttttgttatattattggtgggtgatttgcatgattgatatgaacccgcagaaagttgcgggttagagttttagttattttttatttcttcgagaggagaatagcgtgactctattttaacattaacaaggaattcacgagaattatcaccgtaatcacctggggagtcaaagaacacaaatattaactccccatcctcaggaaccgttttatgaagcacgccgtttcctattccataggttttattaccgattttagcaatgagtgagtcgcgtagcgttggttttctaagtagagtaccttggggggctgcccagtagttgtctggatggccatacttcacccatcccttagcaacaatagatataacatccccctttttgagaataagtcctgtaggttgatcttgttcaagtttagcaggaacagctccagaccaatcgtacatagtattacctccaatcattatgctttgaaagcgactttatcagtctatgaaggcgggttacttctccgccagtgaacatccataaaataggttcatcaatactggagagaacttctgattaggatggcacggaatggctgtttggaaattaataaaatccatatcccactgataaaactatgagtttaaaaggggacaatactcccctttaacccaaccccttgatttcattaaattcccaccctgagcggtaattacgaaaaatcaacaagttatctaaaggtgggaatttctcaccttttaattcaatctttccgtttcaaacggaatgcctactttggttttatacttacggtgaaggtattgggatttcctcaataccttttgtttgtgcagataccccgtatgtcaaagggcagatttctgccctatagtgacagtagttttctttcccgccgttccacaatctcgggactctccattttttggcaaaaagcgtacgtcagctaaatatcatcaaaaaatctgaatatttaaaagcacggtttatgtgtacagaaatgcgtcagtttagagagggattttggcggtgaatttttcgaataaataatgatgtccgttcttcgatatgaattccagagagagtgatctgaggggtaaatcagacccaaaacaggcaaaaatggcgtgtatttttgttacacttttttacaagtggaaatacattagtcagaaataaaaacacctcagagggggagtctgaggcgtttagaaaaagagccgcgtatcttttgcgtatctttttaagtccttttactgtcatggcagtgtcccatcaactttgctaactgactgtttttcaagttgttgtcctgacactgacccaccaaatttggtggagctggcgggagttgaacccgcgtccgaaattcctacatcctcggtactacatgcttagtctagtctttacattcgcttgccagctgcggacagacacgccactaacaaactagcctgattggatttaacgcttcaaccccaggcagggcatccacgcgatctcttttgggtttgacctctcttgatccccgtcctaagagcggaggctagggagagagggctctaagcaggttattaagctgctagtgcgtagttttcgtcgtttgcgactattattttgcggcttttaacgaggccaaccgcccctcggcatgcaccttgggtttcgcgaatcccgtcgaatccagaatcagccccaagtatgttaaaagcgagtatatcagaatattggatgataatgccagtgattaacgccctgaattcttcattattcttgctttgtctactttccactcacgttctttgatatctgaacgtttatcatgcgcttttttacctttcgcaacgccaattttgactttgctccaagcgttcttccagtacatggaaagcgcaacgattgtataaccttcacgattgactcgaccatatagtgaatcaagttcgcgcttgttaaggagtaatttgcgtgaccgtgtcggatcacagactatatgggaagaagcgacatttaatggtgtgattgtggcaccaaaaagataagcatcaccatctctgagcaaaacgtaactctcactgatgtttgccttgccagcgcgcagcgattttacttcccaaccttgtagcgataagccagcttcgaattcttcttcgatgaagtattcatggcgggctcgcttattcatggcaattgttgccgaaccgggtttgtgtgcttttttctttgtcataatgcgttgtattatactgtatgcgttaatgaaataaatctcttctgagtgatatttagcaataaatgcatatttattgttccaaacgccatcaggtttttatttaaccacatttaaatgatactattcagtgctgttacgttttacaggaaatgatatgccacagattagtcgctctgcgttagtgccttacagcgtggaacaaatgtacaaattgatcaacgacgtgaagtcttatccggattttttaccggggtgtgtgggtagcagtgtaataagccgtagtaataatgaaatgacggctgccgttgaggtctccaaggcagggatcagtaagacgttcgtgacgcgtaatacgttatctgataataaaagtattagtatgcagcttgttgatgggccttttcgaaagctgatgggcgggtggcattttaccccacttagcgaggatgcctgtaaagttgagctacatctcgattttgagtttaccaacaagttgattgagttagcttttggtaaggtgtttaaggaattggccggtaatatggttcaggcttttacccaacgtgcgcgtgaggtttacagtgtctgatatcaatgtcgaagtcgtttatgctctgcctgaacgtcaatatctgtgtaatgtgaaagtacctcagggatcgactgtcgaacaggcgattgtcgcatctggtcttttgacattacgtagtgatatcgatttgattaagaataaaatcggcatttatagtcgtccggttaaattgaccgatacgatggtagaaggggatcgtgtagaaatttatcgtccccttcttgccgatccaaaagaaatgcgtcgtaaacgggctgaacgagctaaaaatagcactcaataacatctattccgatatctatttattcgccagatgcattactggcgaataaataaaattccgcgtcttactgatcctctggaaaagctttttcattcttgatatcagtcaacacaccattactatcaaaggtgagcgtcaatgtttcttgtgtggccttcttatggcctggctgatcacggaatatgtagtaccaaatttgacttccaaacggatcagtcagcattggtgttcccaaagtgtaagcgacttgttgttgagtcattcctttgtggatttttgataccgcagccggtgtcaggtaattcccttgattaatatcaggacgataaacaactcgctcaaacatggagcaacccgcagtcagcataacaagtgatacggtagcggcagtcaacaatttacagcgcatagtaattacattcctttaggagtgaggctgtcgatgataataaacattgaagagattgaaaacctctcagcgttttacctatgacttcaagtatacaaaaaagttgtattaatttatgccgctaatagctcttttgcgttggccagtgtgttttttgtaacttcattacccgccagaagtcgcgccagttcttgaagtcgggcttttttgtccaataattgcatatgggtttctgtttcttccccgtcggtttgtttgttgacataaaaatgttgatgcccacatcctgcgacttgcggtaagtgcgttacgcacataacttgggtcgactctcccaattcgcgtagcaatcggccaacgattgccgcggttgggccactgataccgacatcaacttcgtcaaagattaatgcaggcgtttccatttttttggctgtaatgacctgaatagctagtgcgatacgggaaagttcaccaccagaagcaacttttgccagtgactgatgaggctggcccgggttagttgttacgttaaattcaactttgctggcaccatcaatattcaaatgttcgggttcaaatgtgaggtcaatggtaaaacgaccatgaggcatggagagttgatgcatgctgttggtaatcagttggcttaattccgcagcatattgttggcgaacctgatgcagtttttctgccacattgagcgcttgttgataatgcaggctgacaagttcactgagatgggcgcaatcatcttcctgttgggagagctgatgctgctcttccaaaagttgttggtgcagggcaggtagttcttctggagcaacgtgatgtttacgagccatgctgatctgttgtgaaattttctgttccaattcaaacaggcggttagggtctaattccagtagatcactgtaatggcgtaattcatcactgacttcattaatttgaatggctgcttcttccagcatgttaagcagttcgttgaatttgtgatccatgctggccagttcagtcagttcgtttcgtgcgtaattcagaaggctgacaatgttctgttcatcattatcatttaagatctggagaacgttctgactgacagatagaaactgcccgcaatttgccagccgcttatattcgctatcctgttcttggtactcacccacttgtggtgccagttcgtttagttctttcaaatgatattcgagtaattgctggcgagagcggcgttcaagagcctgctgttgaaatcgggcgagtgcctgacagctttgccgccattgttggtaagcctgcttcatttcatgttgccgttcaaattcgccagcgtaaatgtccagtaaacgcctttggtgacggttttctaaaagtaactggtgggcatgttgcccatggatttggatcaggtgtgaacctaattcacgtagctgggaaagggggacagccgtgccattgataaaaccacgggagcgcccatctgcggtaattgtgcgccgcaacaggcactcattgtcgtcatcacgactttcatcaagttggtgggcttcaagccatttacgggcagaaggtgcatccgccagtgaaaaacgggcacagatgtcagtacgggtagcaccagcacgaaccatattggcttcgcctcgattgccaaggcataagcccagagcatcaatggcgatggatttacctgcgccggtttcccctgtgattgcagtcattcctgagcggaaatcaatttccagttcgcgaacgatagcaaaattactgatggttaactgagtcagcatcgcgttcctcctacctttcctgtatataaaaacatgtctgtactttcacacagtataaactggttctttatacagtaaagtgggaggcttacgtttttagaacatttttttcgaccaacccagcttcgtactcaatgtattgaaataattgtaatctttcgggtgtatcaaatgcaggttatattcactgcgtttgataatgacttcttcactgtcctggatcggtaacactatctggctatcacagcttacttcatagtcattgctgttccgggagaatttcagacggatgctgctttcactgctgataacaagagggcgcgctgaaagcgtgtgtggaaacatcggtaccagcacaatggcgttcaagtttggtgtcaatattggcccaccagcagacaacgagtaggctgttgagcctgtaggagtcgcaatgattaagccatcggagcgttgggaaaacgcaaaacgctcatcaatataaacttcgaagtcaatcatgtgagcgactttgcccggatgtagcacgacttcattcagcgccgtactgcgccgtgatttctgtccttttttcgtgacttgagcttctaataggaaacgtttttcgtctcgatattctccattgagtacctcggaaagctgctgcaaggcattatcgggatctaaatccgtcagaaagcctaaattaccacggttaatgccaattactttgatgtcatagcgtgacaatactctggctgctcccagcatgttgccatcgccgccaacaacaatcaccagatcagctattttgccgatttcggtcaatcctccagtctgaacaccttttaaaccaatgtctctagcaacttgtctatccatgatgacgtagtatcctttggataccagccagtgataaagcatttcatgggtggccagcgcttcagggtgacgtggacggccgacaataccgatgcatttgaattcgttattcattgctgttgtttccttcagcatatggttttgccctcacaatatgattgttcccttgaatccctcgttttgatccccataataagcgggagtagcgcaaataatacaaaatacgcggagatattcatgagtagtaaagaccaaaaagtacctgacgagcaagtctcagaaaatacagaaaatgtatttgagcaacaaatggatgcagaaaaggcagacacgccagagactgagagcattgttgacccgcgtgttgccgagttggaagaacagctaaaacaggctcaaattggcgaacgcgatgcaatgctgcgtgctcgtgctgaagtggaaaatatccgtcgtcgcacagaactggatatagaaaaagcacataaattcgcactggaacgttttgcgaatgagcttctgcccgtgatcgacaatctggaacgcgcactggaagcggttgatcgctctaatgacgcgctgttgccaatgattgaaggcgttgagttaacattaaaatcattcactaatgctgtaggtaaattcggcattgaagtggtgggtgacactaatgttcctttcaatcctgaagtacatcaggcgatgaccatgatggaatccgatcagcatgaacccaatcacgttatgttagtgatgcagaaaggttataccttgaatggtcgtttattgcgccctgcaatggttgctgtttctaaataaaaattacgctatcccgtgattacaatgccgccatacacagggcggcatttttgtggttattctattgtcactcaggcagtgtgggataccaatcaattggcgtcaatccttgagcttccagtagactgtttgcctgtgaaaaatgcttgcatcccagaaaaccgcgatgagctgacaaaggagaagggtgtggtgcttttagaacatagtgctgttgggtattgatgaagtgtccttttttctgggcatgggaaccccaaagtaggaaaatgacgccgtgacgatgttcattgattgccgcaatgactttgtcagtgaaggtttcccagcctaaattcgcatgtgaatgcgcattgccacgttcaacggtcagcaccgtattgagcagcaatacgccctgctttgcccaactgaccaagcagccatgattagggcggctaaacccagtaatatccgattccagctccttatacatgttgacaagagaaggtggtgcaggaataccaggctgtactgagaaagccagaccgtgtgcctgatttgggccgtggtaagggtcttgccccaaaatcacgactcttacatcggacagttcggtatagcggaatgcattgaaaacatcctgctgtagcggataaatcgtctttccggccttacgttcattggcaacataggtcaatgtgtcaacgaaatagggctgtgtcttttcatggccgatgacttcgtgccatgtgagagatgcggacatcgcgaatccctttctatatgattgtcagataggcttaagcttaccgattcccttcgtatagggaaaccctctgatcttcatctgaagctaattgatagggtgaaattctgattttataaattattttgaaaatttataaaaataatttcgtgtttttcttttataaaaattcatttactgatattcctttcattatatatgggtattaattttgttaaataaaaattaaatttgttgttaatgtgttacgattttttgccgatagagagtttaggtttgttaattatgcctaacctgaataatctgtaggagagttttatgactttatcaataaatggcagttttttcagcgaattagggatttattcattacagggaagtccactacaacttcaatcgagttctccggccaaatcatcatctgacaaggctgatgtgactcactccacaacacaacccacaacagctccgctttcagaaaatacccagcaaaataataatctttatcaatcattgattcgcgatcgtcatctaagtgccatggcattacctgaattacatgccaatgatattgcaggaaaacattctaaacgcatcgattatgatctgtctctggtcacccgtgatgtttaccgtatgaatagcatgggaattggtgattatgtgcgtcttacgaaagatgaaatatcaaaagcgggcattgatcctgctatcttggaggatagttcaacaggatttcaggcaggcgtttatcgaaataagggtttatatatagtgtcatttactggctcgaacgaaatacaggatttcatggcaagtattcgtcaagggcttggatttaaagaagagcaatatggtcaggctgtaacgttggcacaagcagcgttaaaagcatttggtgaaaatgtcattttcacaggtcactcaatggggggaggattggcatctgtggcagcgctgacaacaggaaaacccgcagttatttttaatgctgcaggtgtgtcagattcgacattgagaagtatggggttatcaccggaagcaagtcgtgaagtggcagaaaatgggttaatccgaaattatattgttgaacatgactggcttgataacctgcaaaaaactttgccaattccccagcccatgggaaataaaattttgcttgaatatgagtacgaaccggaagggatattagattccatttttgcctatcggtatgcttttcactcattcaaggcgcattttatggaagccgtgcaggaattgctgaccgtccataaaccttggttgaataaagcaggtgaaatgatagctgctactgaggacagtatgcaaaataaggctatttctatgcaaaaacaggctttgaatacatggggaatgaatatgaatgaggccgaaatcagcgaccagctaagggaagagcgtcatcaattggtttcacaacagcttgagaagtattattcagtataatattcgtacaaatggaataatgagtaaggctgaatccattgtttctgtttgtcggatataataaagcgggctgtttgcccgcttttgccagtgagattaatcgttggttggttctgacgtttctggtttgggatcaccggaaggagtgcggcgttttccaatgtttttactatcgcgatgacgaactttcactcgtgttttcttcgcttcttcttctacctttttcttctctttacgtttctccagaactttcttagaaggcttatagctctttttctcactgggtgctttagtttgtgggcgcaattcatcgacaacccgtactttcaatggttcgttgagataacgggtgactttaccaagcagtggatgatcgtgagactcaaccagtgcaatagcggttcccttacggcctgcacgggcagtacggccaatccgatgcagataaacatcggcagtacgtggtaaatcaaagttaaagacatggctgatattttcaatatccaacccacgggacgcaacatcagttgcaaccataacgttgactctgccatcattcagtcgcttgacggcatctgtacgtttggtctgcaccatttcaccttcaagaaaacaggcctgaatgcctgccttatgtagataatcaacaatttcacgcacacgctcacgtttgcgcacaaaaacaatcgattttgttacatcaggttgctgaagaaggtgacacagtaaagctgttttatgctccagattatcggcacgataatagaattgctgaatttttttgcgttcacggcgagaaggttctgcatcgatttcaacaggatcggttaacagacgctctgcaaaatcacggatggtttcaccttctaacgttgcggaaaatagcaacgtttgtttgcgccagcgtgtctcaccggcaatggtctcgacatcattggcaaaccccatgtccagcatgcggtctgcttcatcaaggatcagcgtttccaccgcacggcaatcaaaattttcttctttgatgtattgcagtaggcgtcctgtagttgcgacaacaatatcctgattctcactgaacacttctgcgtgattcatgtaagcaacaccgccagtgattgtggcgacatccagattagtatgagccgcaaatgattgtgcctgttctgcaacttgcattgccagttcgcgggtaggggtcaaaatcaagatacgtggcgggccggattttttacgtggaaaatccagtaaatgctgtagaactggtagcaggtacgcagcggttttgcctgtgccagtcggcgcggagccaagtacatcacggccatccatggcagcaggaatggcttcagcctggattgctgtcgggcgttcgtagcctttttcgttcagtgcattaagcaggcattcatcaagttcgaattcggaaaagtttgtcgcagtcatcatatacctctatttgggtcgccgattataaacaggttggtcgtattcttcatcctataaaaatatcctgtgggcaggtcgcttttatccgtgggctataagatttatgctatgacccattttaatttcaatagacatgattcatgggattgatacataaacccgcttttcgctgcggtggttttacatttaaacagttttttgttggacatgataaatgtgcaatgaaagttgggacagatggcgtgttattaggcgcctgggctccggtgggtaatcggaaaaaatgtctggatatcggttgtggcagcggtttggttgccttgatgatagcacagcgtactgacgatcattcggttattgatgccgtggagctggatactcatgctgcgagacaggcaatcgagaatgtgcaggaatccccatgggctgatcgtgttaaagtatatcagcaggatattcatgattttactcagcaaaaccatttgcaatatgatttgatcgtgagtaatccgccctattttgaacctgccaacgcgtgtagaaatgaagcacgtagtcaggcgcgctacacgggatcattgacgcatcgtggattattggattgtgctgaacatttgattaagcccacagggctattttgtgttgtattaccctataacatcggcgagacatttgagcaaatggcggcagaacgggggtggtttactcatcatcgtgtcaatattcgtgataggcaggataaaccgctgcatcgtttgttgctggcattttctcgacaagggcaggagactcaggtgagtgaattgaccattcgtgtctcaaatggcgtatattcaaccgaatttcgtcagttagtaacagatttttatctttattattgataaggttactatcaatggagtaatgatatgggttttattactcaatgaaatgaatcgttcttttttcttgttttaaaatcgtatttcctgggaaatagagactatgatttgtactatacataaaaggtgagatacgaaataacaggtggttgtaagataaaattacgatcaaagttgaacttcacacgaaatagaaactcgaagtcatgcttgtttgggaagaaaggcatcatgactggcgtaattaagtataaatgtggagttttacctcaggagagtgagcctcggatgagcgagcagttaacggatcaaatgctggtcgaacgggtacaaaagggcgaccagaaagcatttaatttgctggttataaaatatcagcacaaagtggcgagcctggttgctcgttacgtacctcaaggcgacgttcctgatgtcgctcaagaggtgtttattaagacttatcgtgcgctttattctttccggggtgatagtgctttttatacgtggttgtaccgtattgccgttaatactgcgaaaaactatttagttgctcagggacgtcgcccaccatccaatgacttggatgccaacgatgcagaaaattatgatgcgtcaagttcattaaaagaaatttcgaaccctgagaacttaatgttgtctgaagaactaaaggaagtggttttccgtaccatcgaatcgctcccagatgatttgcgggtagcgattacgctcagggagttggatgggttgagctatgaagaaatagctgagatcatggagtgtcctgtcgggactgtccgttcacgaatcttccgggcaagggaagccattgataataaagtcaaaccactgatccaacagtagtgggacaaaacaatattgaagggtactttggcatgcaaagagagaaacttttcgcattaatggatggcgaagctcttgatagtgaagtcgttcgtttgatcgctgaagacactgtgatgcagaaacagtgggaaagatatcacctcatccgtgacacattgcgtggtgatgtaggtgatgtattacatttggatatcgcgagccgagtcgcattggcacttgaaaaagagccggctcatatcaatccagccgctattccagaatctcagccaaagcctgaaacatggcagaaaatgccgttctggaacaaaattcgcccgtgggcgagccagatgacgcaagtcggcattgctgcgtgtgtgtcactggcggtgattgttggagtccagcaatataacagcgatggcagtgttgatgtggatacacaatccgatacgccagtcttcaatacattacctgttatgggttccgcttcacctgtcggtttagctgcgcctgtagatgatgaagctttaggcagtgatttgaacatgcaagtgagggaaagcaataaacgcattgatgctatgctgcaacagtatgaactttcccggcgcatttattcagaacaaaaccagaggttgccaccggttgataatactcaacctgtagcagcaaaaatacaacaggctccacagcaataatgaaacgtatctgagaagttaatgaaacatatttgttttttcatcttcttgttggcaggtagcctgttcaatcctttgaaagcctcggcgcagcaaagcgacaccgaggctttgttacaggatatgggaaatgccgtacacactctgaattatgagctcgctttcattaatctagggcgagaacttctgatccccctgcgttaccgccatgctattattgatggtcaacccattgctcaaatcatacagatggatggatcgcgtcgcgaaattatccaacgcggtaaccaaatcagctattacgagccaggcttggattcttttagtctacgtggcaaccacattgtggattatttcccaccgattatttttgcggatttctcgcgattacagaagtattatcgcttcattgatgcgggcagtacccacgttggtgatcaccctgtgtactttgttcgtatcatatcgaaagatgaaactcgttataattataacctgttgattgatgcaaaaagtcatcttcccttgctgattgatctgttggacaaggatcataatattgttattgagcaattccgcgtagtgtcatcaacagtgaatgacagtataaaaaaagatctgattgctattgtcgatttgaaattaccgccaatgctggctatttcgccgtctgaaaaagtgaaattcgattggcaggtggaaaaaatacctgaaggtttcaaagaaatctcccgtaatagactcaaactatcagaaacagaatcgttggaatccatcatgtatagtgatggactgtttcaattttctgtaaatgtgacccatgctgataaaggaacggtcaataaacaaccatttagacaaggtcggcgaacggtttatactttggtcagaggtaaaaataccattgcaatcgttggcgaactgcctttcgcaaccgccaagcagattgtagcaagtgtgacgtttacgggagatcattgatggttaaagaatgggcgacggttgtccgttggcaaaaaggtcgtgcactattgcgttatggctcatcttcaggttgtggcagttgtcaggccaacgccgtctgtggctcttatttattggaaaaactggggccagagaatattcatcagttggaactagaaatttaccaacctcttcaacccggtcaaaaagtagaggtaggtatacctgaaagtagcttactgcgttcagcaatgttagtttatttgaccccattattagggttgttcttagggggggggctcttccaatattgggtaactgaccagttatgggtagttatgggaggcgttatcggcggggttactggtttcttctttgcccgcaagatagctaagtattgggatgatcagcaagtgtaccaacccgttgtgttacaaattggtttacctcctgatacgattaaggttctacagcaggaataatctgctttaccattaacagctctcactttttggtcataccgaaaaccacaggcatgactaggttttcacaggtttggcatgtagaatacgcctctttggcctgtggccaaacctataaactgtcgctttatgtccatctgtgtgtccataggcgaatgattcagaaatattaaggcaaaaaagtttaataatgaagcaaataagaaatttctccattatcgcccacatcgaccacggtaaatccacactctctgatcggattattcaaatctgtggggggctgtccgatcgcgaaatggcagcacaagtactcgactcaatggatcttgagcgtgaacgcggtatcaccatcaaggcacaaagcgtcactcttgattaccagtcaattgacggacaagtctatcaactaaattttatcgacacgccaggccatgttgacttctcttacgaagtttcccgctctctggctgcctgtgaaggggctttactcgttgttgatgcggggcagggtgttgaagctcagacactggctaactgctataccgccatcgaaatggatctgcaagtcgttcctgtcctgaacaaaattgacttgcccgccgctgaaccagagcgtgtagctgaggaaatcgaagacattgttggcattgatgcgacagatgctgtccgctgctctgcgaaaacaggtgtgggtgtgcaggatgtcattgaacgtctggttaaagagatcccgtcaccagagggggattccgatgcaccattgcaggccttgattattgactcatggtttgacaattaccttggtgttgtttcgcttgtccgtgttaaaaacggtgtattgcgtaaaggcgataaaattaaagtgatgagcacgggacaggtatataacgctgaccgtctggggatctttacaccgaaacgtatcgaccgtgatatattgaactgtggtgaagtaggttggttggtctgtgcgatcaaagacattttgggcgcgccagtcggggatactctgacaactgcgcgccagccagcggacaaagcgctgccaggtttccaaaaggttaaaccacaggtttatgcaggtctgtttcctatcagttctgaagactatgaagcctttcgcgacgctttgggtaaattgagcctaaacgatgcttcattattttacgagccagaaagttctactgcattgggctttggtttccgctgtggcttcttgggcttactgcatatggaaatcattcaggaacgcctggaacgtgaatatgatcttgatctgattactactgcaccaacagttgtttatgaagttgagacagtcagtgatgatattatttacgtggacagtccgtccaaattaccgccattaaacaatattaaagaactgcgtgaaccggttgcggaatgtaacatgctgttaccgcaggaatacctcggtaatgttataacactgtgtgtggaaaagcgtggtgtacagactaatatggtttatcacggtaatcaggttgcactgacttacgaaatacctatggctgaagttgtgctggatttctttgaccgtctgaaatctacttctcgtggttatgcgtctctggattataatttcatccgttttcaacactcagacatggtacgagtagatgttttgattaacggtgaacgtgttgatgcattggcattaattactcatcgtgagaactcacaatatcgtggtcgtgaactggtggataaaatgaaagagttgatcccgcgtcagcaatttgacattgcgattcaggctgccatcggtgctcacattattgcgcgtgctactgttaaacagttacgtaaaaacgtacttgcgaaatgttatggcggtgatgttagccgtaagaaaaaattattgcagaaacagaaagatggtaaaaaacgtatgaagcaggtaggaaacgttgaactaccgcaagaagcgtttttagcaattttgcatgttggaaaagataactaacaaggttgtaaggagtctaaatggctaacacttttgccttgatcttaacgttagcaacgttaatcactggtattatctggtgtatagatcggtttaaattcgcccctgaacgcaggaaaaaacttgctcagattcaggaacaaacagcaggtgcggaatctcaggaagctttggctacagagattaacaaaccttcatgggttgagacatttgcatctgtctttcctgtgttagccattgttttgcttctgcgttcttttgtttatgaacctttccagatcccttcaggttcaatgatgccaacgctgctgattggggatttcatcctagttgaaaaattcgcctatggtctgaaagatccaattacacagacaactttgattaaaacaggtaagcctaagcgtggagatattgcagtttttaaatatcctgttaatccgagtctggattttgtaaagcgtgtcattggcttgcctggagataaaattgtttacgatgacataaataaagaacttcaggtttttcctggttgtggttggaatacggtgtgtaagaatttacctgttacttatcgagatatgttcccaagtgaatggactatcaaagaggatattactcctgaaggcgcacgtgtgagaggagtttatccaattcctatcgaagaacaactggggtcaaacagtattcgccagggggaacgggttgagcatttaggtaatgtgtcacaccacattttgattgtccctggagcatcaaatatcccgtttttcagtcagccaggattgccacttggaacttgggttgtccctgaaggccattatttcatgatgggcgataaccgtgacaatagttcggatagccggatatgggggtttgtgccggagaaaaatctggtagggcgagcaacagccatctggataagttttgaaaaacaggaaggcgagtggcctactggcgtacgcctgagtcgaattggaagaattcactaatatttatatattagcgaagcattaattcatctcacagtgtagaatattctgccaaacgagatgattggctttttagaatgatggacattttaggaagccagtgcaaacgcaacagttttgtaggatctatccccacaggtctgttgcgtgtgcttttttgatgaattctgactgaattggtagcacatgaactccataataattaataggttacagcgtaagctgggatatacctttatacagcatgatttgttacttcaggcgctcactcatcgtagtgccaacagtaagcataatgagcgtctggaatttcttggcgactcaatcctgagttttgttattgccaatgcactttatcaccgttttccccgtgttgatgaaggggatatgagccgtatgcgggcaacactggtgcgaggcaatacgctggctgaattggccagagaatttgagctaggtgaatgtctgcgtttggggccaggtgagttaaaaagcggtgggcatcgccgcgaatctattttagcagatagcattgaagctttgattggggccatttttctggatagcgatattcagacaattgaaagaattatattgagttggtatgaaactcgtttgaatgaaattagcccgggcgacaagcaaaaagatcccaaaacacgtttacaggaatatctgcaagggcgtcatttgccgttgccatcatatctggttgttcaggttcgtggggaagcacacgatcaggaatttacaatccactgtcaaatcagtggatttgaacaacctgttagaggagtaggttccagccgtcgcaaggcagaacaggcggctgcggaacaagcattaaaacaactggagcttgaatgagcgaagaaaaaaactattgcggatttgtggcaatagtcgggcggcctaatgtcggtaaatcgactttattgaatcagttactgggccagaagatatccatcacttcccgtaaaccccagacgacgcggcatcgtattatgggtatccatacggaaggagtttatcaagccatttatgttgatacaccggggcttcacatagaagaaaaacgtgctattaaccgtttgatgaaccgtgcggcgagcagctcaattggtgatgtggaactggttattttcgttgtcgaaggtacacactggactgcagatgacgaaatggttgttaataaactgcgtaatttgcattgcccagtgatattggccattaataaagtggacaatgtcacggataaagccatccttctgccccatatcggttttctcagcaaacagatgaatttccttgatgttgtgccgattagtgcagaaaaaggcatgaatgttgatactattgccaaaattgtgcgtgctcatatcccggaagctggacaccatttcccagatgattacattactgatcgctcacagcgttttatggcatcagaaatcatccgtgaaaaactgatgcgttttctgggtgatgaactgccttattctgtgacagtggaaattgaacaattcgttactaatgaacgcggtggttataccattcacggtttaattttggtagagcgtgaaggccagaaaaaaatggttattggtaataaaggcagcaaaatcaagacgattggcatagaagcccgtcaggatatggaaaagctgtttgataataaagttcatttagaactgtgggtaaaagtgaaagcgggttgggctgatgatgagcgagcgctgcgcagcctcggttacatcgacgacttataaggttgatttgtggacggctggcagagagctttcgtacttcatgggcgcccttacagcgagactagtttactactggatttctttactgaaaatgaagggcgggtacgtgttttagcgaaaggtgtacgccgtcgtcgctcccatctgaaaggttgtctacaacctttcaccccgttgcttgttcgttggagtggacggggtgaaatcaaaatattacgggatgctgaacctatctcattagcgcttcccttgacaggaagtgtgctatacagcggtttatacgtcaatgagctattatccagagttcttgaacaaggcgcggcatatcctgcgcttttctttgattatcttcaatgtttacaaattcttgcggcgagtgaatacacgcctgaatatgctttacgtcgttttgaactcgccttgctaactaatatggggtatggagtagactatcttcattgtgcaggtagtggtgaacctgtgtcagatacaatgaattatcgttaccgtgaagaaaaaggctttattgctagcctggttgttgatcacttcagttttactggtaatgaactaaaagcgttggcaaccggtgaatttactgattcgcttactttgaaagcagctaaacgttttactcgcattgcgctgaagccttatttgggggggaagcccttaaaaagtcgtgagttatttcgccaattcgtacgtaaaaaaactgatattcctaataagaaaaatgaaaattgaaatgtgatttttctttatgatggcaagtgtatactttcttgaatcttatgttattacaggagttaaaaatggctgaggtattattaggtattaacattgatcatattgcaacggtacgtaatgcccgtgggacacagtatcctgatccggtacaggctgcatttgttgcagagcaagcaggagctgatgggatcactgttcacctgcgtgaagatcgccgccatattactgatagagatgttcaactattagcaaaaacgattcaaacccgtatgaaccttgaaatggcagtaaccgatgaaatgattgatattgcttgccaaattaaacccgttttctgttgtttggttcctgaaaagcgccaagaagtgacaacggaaggtggcttggatgtattagggcaaaaagtgcatattgctgctgccgttaagcgtttatcggaagcaggtatttttgtttccctgtttatcgatgcagatcaccagcaaattgccgctgcggctgaagtgggagcgccatttattgagatccacacaggtgcgtatgcagatgcagaaaatgatatccagcaggaacaagaatttttgcgtattaaagaagcggtgacttacgccgcgggtaaaggcatcaaagtaaatgcgggtcatggtttgacgtatcacaatgtacagcgtattgctgccttacctgagatttatgaattaaatatcggtcatgccatcattggccgtgccgtatttagtggtttgtctgctgctgtggccgatatgaaaacgttgttgcgggaagcgcgcagttaatggctattgttggattaggcacagatatagttgaaattttccgcattaaaaaaattgtcgagcgttctggtgaacgcttggcaaacgtgttttaagtgacagagaatggcaataatatcagcatcataactaaccgatttgtttccttgcaaaacgatttgctgttaaggaagccgccgcaaagcgccgggaacaggtattcgaaatggtctgtttttcaatcagtttgaagttattaatgattccttgggaaaaactacattaaaacttcatagtaaagcagaaactctggctgacaaactgaatgtaagatccctgccggatgaacggcgttatgcctgtgcgacggtgatattggaaagttgattttatatcttatctgcgtgatgtaagagcacgaacttatcccacagttgctcttcactttcctgatagtcagggttaaggataatagtattggtgatcgggcagacggactggcaggttggtttttcatagtgtccgacgcattcagtacagcgttctgagtcaatttcataaatttctgcgcccattgtgatggcctgattgggacattcaggttcacacatatcgcaattgatgcagcgtttagtaattaatagcgccatttcagtctcttatataaattatcatttaaaatcatataattaaatcacttccgtattcgttacgtttgtccggttcttgtgtttttatacagtatggtttacattgaaaaaccgtataccgtaacacaaaaccgcaacacatacttatttctgatgcctaaaatatagtaatgtgtgagctattatatcaacgtaatgatattacggagttcttaatgaaaaatgcagtaacacatttacccaaatctcatcaaaatgacgaatatttaagcgctctagctagttgggagtcatgcaaacccctttattgccaacaacaaatatccgcttgaatcactctcgccggaatcaaggcaccatcggtttcactgggtaacgccagcacataggtaacaaaatcagcgtttgaatcctgcttctgctctatcaggtacttactcacggcttctctggttgggtctgcctgtggattgccattgggaaaattgaccgcatcaagataaatttccggcacttggtggcgtgtcacaaccgctcccaaagcatcattgaagtcttggtttatcgcagtaatgaatccattgacgttggtaaatatagctaaatcatattaatatgacataatatctaaatctaagataacaaggcataaaatgagatgggctacagcttagattttcgaaagcgagtactggcatacaaagacaagcattcgttgactttcgaacaaacgagtgcccattttgagatctccatgcgtaccttgttccggtggtgcaataaaatagaaccttgcatgacccgcgataaacccgccacaaaaatccctgatgaggtactcattgcggatgtccaaaattttcctgatgactaccaatgggaaagagcaaaacgtttaagtgtttcacaatcggctattcattacgccttgaaacggctgaatatcaccccgaaaaaaaacgctccaaccccctcgcgctgatcctcaagctcgtcaggcatttatcgagcacatcagcgatgatgaacagactggcagaccccttgtttatttggatgaaagtggttttgctcaatcgatgccacgtaaacagggatattaggaaaaagggttacgctgttttggtacgcatgactggcacgcaaaaggccgtatcaacgtcattggcgccattctcgaaaagaccttcgtcaccttaagcttatttaccgggaatattaatgccgatgttttttatgcgtgggtgacgcaagatttgctgccaaagcttccacacggagccgtgatagtgatggataatgcgcctttccataaacggaatgacacgacacaagcaatagcagacagccgatgtcaactggaatggcttcccgcttatagtccggatttaaaccctataaaacacaaatggggcggagcaaaagcgataaggaggcaaaaaagatgttcagttgatgagttgtttacggagcatattgaataggtcaggttatgttaattctgctatatcacaacgtccgaaggcggtgactgcaccaccaaactttccgcatgaacaatattgtgaaattgccccccggacaattcaaaacccattggtagtccatcactgtctacggctaaatggattttagttgagcgtcctcctcggcttttcccaatcgcttcatctttcttttatgttgcgcctgaactgtgttgataagcgcggccaatactgctatcaatgaaccaccattccgtatcagagtctttatataattacttgaataataactccacaaccaccgactttagtcggtggttgtggagtttagcggccaatgaacggggtgaagaatagcttgatatggcgactttattggctaattataaggcacaacaaaaaccggatcggatagaagcgctattaatggtgatgacctgttgtctgatggtctatgcagcgctggagcataagatccgccgcgaactgaaaaaaagcgtcccgtttttccctgatatgaggaacaaacggacacaatcgccagccgcgcgtgaggtctttctgattatagaagggataaactcctttgaatttcaataacataaaatgataactggaatacagtcttaccacaatgaacttttaagtttattaggctcacaatatcaaacggtttattcttgaatttggatgtggaatgacgagtttatacgtagtgcgctgcaagagtaggaaaacgtcaataagcactggaacaatatacagttgattggatttttaattatttgatttttatataaaaataataaacatcgacaaataccgaaacatgaaactaatatatgttaggtgtattcatttctgctttcatttgggttagtttatggcgatagacagtataccttttagtctcagtaaacgcattttcatattgattccaaaataaaagtagtgataattaacgttgattcaaccgtttattaaataggctgactaactatggaaattcgggtatttcggcaaaatgattttgaggccgtcaccacactttgggaacgctgtgatttgattaatcccggtgatgatccagaagtagatattgagcgtaagttaacccatgatgctgatttatttctagttgctgaagttgcgggagaggtagttggtacagttatgggcggctatgatgggcatcgtggacatgcttattatctgagtgttcaccctgaattcaggggcaggggaattgctaatgctttgatatcccgcttggaaaaaaaattattggcgagaggttgtccgagtattttgattttggtttcagaagaaaatgatgcaacgatttgtatgtgtgaaaaaatggaatatgattatttggggcaagaaaatactatttttagtaagcgcctgattattgattaaatataaaatggctgaacagtattattttattcagccattattgaattatacagtactaaattaattatctttataataagatgactcaagaatatctgatgtttattttgtaaaataaataatttttttgacgcaatggggatattatctccgatactagagacaattctaacttgaatttttccttcgttatttctatatagttgataatgatcatggatgggagattctgatttcccttctaatataataaagctacaaggagattgaatatgaaattttctctcctgaaatatcgtggttttttcctgatgcttttcctgatttgtaatgtgattcaacttgtcatgaatattagaaggcaaaaccgatttttgatctgaggctctcgccatgacagatacgcttaaagagataataaataccgcaataatcaccttttcattcatcatattctaccgtaacatcattctttagatgaaagtgatgttatcggtcattgtgtcaatctatcatcaatgttgtattgttcttgttttttttgcatttttgttgatgaaatttttcgtatttacaaatgaatgtttttttaagagtgtgttttgcataacccgtcaatagatataaaggtaaaaacagtaatgggtaaattttttgtatttaatttattgtccaaacagcgagttgtagccgttagtagtttattgggaagttcgctgttactaagtgcctgtgctggaataccagaattttcatggtcttcgttatcaccttgggagtggtttggcagtgccttacgtgtctctgaacaaggtgttggggaagtgaataaacagacagacatggatcaatctgcgattgaacaaggcttgaaaggcaaataccgcctgcgcagtgggatggaaactcaaaatggcaaattcgtcagcatcattcagggaatggagggtgatcaggtaaaaatcgaattgtctggtttggctaaggggaaagttaatcgtattgatgtgttggatgatagggtgaaaaccgtatggggaacaagaataggcacacctttctccgagctgtatggcaaagcgtttggtgtatgtcatcgttccagtgatttcattatgcagccaaccgtgatttgtattgcaccgcaaagccagcatatcagctatgtgtttaccgggcagtgggatggcccagaagggttaatgccttctgatgatgccctgaaaaattggaaaatttcgcggatcatttggaaatcctgacaaagccttaaagagagtttgcgctgaagcagagctctcttttcatctgtttatatattatcttttgaattgataattcctacatttcctatagcttatcgcgtttcatcatttctcataaaaactcggtatataaaacaggggatagtaaactaccctgttataaatattctggatacagtatgaagaaatcgttgtcgaataggcgtgacgggtaaggtgttggatgaaaatagtggcaataaacaataaattattgggcgggttggttgccttagcatttttgggtcttatcaacgcatacagtgccaacgcttatgccgtcggattattgaatagttcttacgatatttcgcgagagttattttctaccttgaaccctcaatttgaaaaacaatggaatgcacagcatccgcaagataaattaattattaagcaatcccatgcaggttcatccaaacaggcattgagtattctacaggggttacgggctgatgtcgtgacgtacaatcaggttacggatgtccagatcctgcatgatcgcggcaatcttattcctgccgactggcagcaacgtttgccaaataacagttcaccttactattccactatggcttttctggttcgcaaaggtaatcccaaacagatccatacttgggatgatttggtacgtcatgatgtgaagttggtttttccaaacccgaaaacgtcgggtaatgggcgttatacctatctggcggcatggggcgctttccaacagcaaaatgagcatgacccggtgaaagttcgccaactgatgcggcgtcttttgcaaaacgttgtggtatttgatactggggggcggggtgcaacgacttcatttattgagcggagtctgggtgatgttttgattagttttgaatctgaagtcaataacattcgtaaacagtatggtactgacaattatgaagttattgtgcctccggtagatattttggctgagttccctgtgacttggattgataaaaatgtccgcagaaatggaactgaagcagtggctaaagcctatttgaattacctttatagccccgcagcgcagcagattattgcgagcttcaattatcgagtgaatgataaaaatgtcatgaaagcacagaaacctcgttttcctgaaaccagactgtttcgtctggaagaacaattcggtaactggccgctggtgatgaaaacacatttcaacacgggcggtatgttggatcagttattggcggaaggacataaatgatgttagtggcatccggtaaacgcgtcctgcccggatttgggctgagtttgggcagtagcttgttttatacctgtctgatcttgttattgccattaagcgctctggctatacagctttcgagtatgacatggactcaatattggcaggtgattgtaaatccgcaggttgttgccgcttatcaggtgacattgctggctgctgcggccgccagtttcttcaacatggttttcggaatgttgatggcgtggatactgacgcgttatcactttcctggtcgcagtttgcttgacgggttgatggacttgccctttgctttgccgactgccgtggcaggcttaactttggcgaccctgttctctgcaacaggatggtatggcgcttggctgggcaattttgacatcaaggtagtgaatacttggctgggaattgcagttgcgatggcatttacaagcctgccgtttgtcgtccgcacagtgcagcccgttcttgaagaacttggccctgaatatgaggaagcggcgcagacattgggcgctagccgctggcagactttccggcgagttattctgcctgaagtttcacccgcattgatggccggaaccgtactctctttcactcgcagcttgggggagtttggggcagtaatttttattgcaggcaatattgcatggcaaacagaagtggtttccctgatgatctttgtccgtttgcaagaatttgattatccggctgctagtgcgattgcttctgtgatccttgcggcatcgttgttactgctgtttagcgtcaatatattgcagagtcggtttggtaaacggatcggggggcattgatgactgagttatctgcatacacagtggcacagcgctctcctatcaactggggaaaatgggtactgattggtacgggtatactcgtttctactctgctgctggtaatcccgataatgtggatttttttgaccgctttttcgaaaggtttcgatctcgttaaacagaatcttcttgatcccgatatgctgcatgctatctggttgaccgtgatgattgcgcttatcacagtccctatcaatctgatttttggtgtgatgactgcttggctagttactcgattccaatttcccggtaggcagttattgctgacattgatcgatattccgtttgctgtttcacctgttgtggcagggctgctttatctgctgttttacggtgtcaatggttggatgggaggctggctgggttcttatgatatgcaattaatgttttcatggccgggtatggtactggtgacggtatttgtgacatgcccatttgttgtccgtgagttggtgccggtgatgttaagtcagggtagtcaggaagatgaggcagcaatattgctgggcgcttctggctggaagatgttctggcgtgtgacattaccgaatattcgctgggcattgctatatggcatcgttttgaccaatgctcgggcgattggggaatttggcgcagtttctgtggtatcaggggcgattcggggtgaaacctatacgctgcctttgcaggttgagctgctgtaccaagattacaacactgtgggtgcatttacggctgcggctttattggcagtgatggcgattatcactctgatggtcaaaagtgctgtgcagtggcgattaagccaccagtaacgggagatcaggagcaagatatgagtattgaaatcagtaaaatcagcaagtcttttggccgggtccagatactgagtgagatttcattaggtattgaatctggtgaaatggttgcgctacttggcccgtccggttctggtaaaacgactctcctgaggatcattgcagggcttgagcagcaaagtgcagggcaattgaagtttaatggtcaggatgtcagtcgagtgcatgcgaaagatcggcgagttggctttgtattccagcattacgccctatttcgccatatgaacgtctttgataacgtcgcttttggtttgactgtgcttccgcgtcgtcaacgcctcagtggtgaggcgctccgcagtaaggtgatggtattgcttgatatggttcagttatcccaccttgctgatcgttacccgtcacaactttctggtgggcagaaacagcgtgtggcattagcaagggcattggcagtggaaccgcaaatcctgttgctggatgagccgtttggtgctttggatgcacaggtacgtatggaattgcgccgctggttacggcaacttcatgaagaactgaaatttaccagtgtattcgttacccatgatcaggaagaagcgatggaagtagcggatagagtggtggtgatgaatcaagggtgtattgagcaagttggtacgccgcaacaggtgtggagagagccagaaagccgttttgtgctcgaatttatgggagaggtcaatcaattacacggtgaaataaaaggttcccaattatgggttggggggaaaattttcccattgaatgtgacaccattacatcagggaaatgttgacgtgtttctccgcccatgggaaatgactcttagtacccaacaaactgcatcttgtcctttacctgttcaaattgtggaaatcagcccacgcggccatttttctttgttgtctgtcttgccagtagggtggggaaaagacctcttatcggttatctggcagggtgattcacctgttcctgttaggggaaaccagtattttatgggaggcactggagctagactgtatgcaggtgacctgccattaaaagtgctcagactcgctgaatcagcttgatttagctatattttattaccgtcaacccgtctctcgtcatttgggggagcgggtattttttgtttaagatcttgctacagttttctgaatatgattattttgttgtccactctcatatgaattaggtaatgctgtggcaagcttggaagattttataggcaatactccgctggttaaattacaacgactcaccgaaagtgttgatgcggaaatttgggtaaaactggaaggtaacaatcctgctggttccgtgaaagacagggctgcattttcaatgatccagcaggctgaattacgaggagaaattgcgccgggagatgtgctcatagaagcaacgagtggcaatactggcattgcactggctatgattgcggcagttaaaaattataaattgaaattattaatgcctgaaaatatgagtcttgaacggcaggcgtcaatgcgggcttacggtgcagaattgattctggtcagtaaagaatcaggcatggaaggtgctcgggacttagcgcagaaaatggaacaagagggagaagggaaggttcttgaccaatttaataatatggataatgcactggcgcacttcaatacaactggtccggaaatctggcagcaaacgcaggggcgcataacgcattttgtttccagtatgggaacgacggggacaattacaggagtgagccgctacctgaaatctcaatcagataaagtgcacactacgggattgcagcctgcagaaaatagccagatccccggtattcgccgttggtctcccgcttatatgcctggtatttacaaaaaagagttagtggatcagctcttggatatcacacaaatggaagctgaaacgacaatgcggctattggcgcagaaagaaggcattttttgtggtgtcagttctggcggtgctgtttcaggggcactgcgcattgcggctaaaaatccaggggcagtcattgtagcgattgtctgtgatcgtggtgacaggtatttgtctactggggtatttaattaaacgcctatcccctttgggtatatgttatttggcattaaacgtcgctttttgactgagcagcaaaccacaaaaaaatcgcccctgtattatcaggcttaatccggtaaaatgcctgataatacaggggcgattaatcaaccatctgaaaaataagaaggatctgtaaacaggaaaagagcggaaaacgtgttcccgatgatttttctgttatcttttgatacgcatgatgacagattcacctacaactacagatccactcactttagacaattctttaatttcgtccatgttagaaataacaacaggagttaatgttgatttagccctttcttccagaaatgccagatcaaactctaaaaccagatcgcctttctgtactcgttgaccttcttcggcaatgcgtttaaagcccgcacctttcagctcaacggtatcaataccaaaatgaacgaacagttcaactccgctatccgattcgatagaaaaagcatggttagtttcgaagattttaccaatggtgccatcaacaggagcgacaattttgttgccggcaggtttaatcgcgataccatccccaacgattttttcggcaaaaacaacatctggaacatcttcgatattgactatttcacctgacaatggggcgataatttcaatactgccgctgttttttttatcgtctgaaaccagagatttcagtttatcaagcagacccatgaatcttctcctaattgttttaatgggaccgtgttttggctgatgtagctagcagagtgttttttctctggtaaaggtgtcaaccaaatccatcaattcctttgcagtcggctgagataaggcttgctctgccagcgctttcgcatcatcgtaattggcattacgaatgattttcttgatgcgtggaattgatatcgcactcatgctgaactcatccaatcccatgcctaagagtaacagcgcggcacgttcatcaccagctagctctccacacattcccgtccatttaccttctgcgtgtgaggcatcaataacctgcttgatgaggctcaacactgcgggtgacattgggttataaagatgagaaatcagctcattaccacggtctaccgcaagagtatactgagttagatcgtttgtcccaatactaaaaaagtcaacttcttttgcaagatgatgagcaatggttgcagcagcgggtgtttccaccatgatgccgacttcaatagattcatcaaatgctttgtcttcatcacgtaactggtttttgagcaacgccagttctgctttcagctccctaatttcctcaactgaaataatcattgggaacataatgcggagtttaccaaatgcagaggctcgcaggatagcacgcaattgagaatgtaagatttctttacgatcaaggcaaatccgaattgcacgccagccaaggaatgggttctcttcttttggcaggttcatgtaaggcaaatctttatcaccgccgatatccatggtacggataatgatggcttggttgccaacggcttctgcaaccgctttatatgcctcaaactgctcgtcttcagtaggcagcgtatcgcgatccataaacaggaattcggtgcggtatagtcctacaccttcggcaccattgcgctctgcacccatgacatcacgaactgtaccgatattggcacaaacttcaacttgatggccatccagtgtaatagcaggtaaatctttcagttttgccagttctgttttttctgacagatactcgtgttttgcctttttcagttgatcgatttcagcattagacgggttcacataaatctggttattaactgcatccagaatcaggtaactgccatttttgatttgagttgttgcattggtagtaccgactattgcgggtaattcgagagagcgggccataatcgaggtatgggatgttcggccacccaaatcagtgatgaaacctagcactttgtccagattgagttgtgcggtttccgatggagttaaatcattggcaatgaggatagcttcttcttcaatagtgcctaaatcgataatcggcatacccagaatatttttcagcaggcgtttaccaatatcgcgaacatcggccgcacgttctttcaaatattcatcgtctagttcttccagtgccttagcctgatcttcaataacggaataaacagcggcatctgctgttgccagatttttcttaatcagggtaacaatttcctgttccagctcttcgtcttccagcaacataatatggccttcgaagatctcagccttttctgcacctaaatttttttcggctgtttttctaattatttctaactgtacggaagacttgtctcgaccttgtttaaaacgggaaatttcttgttcggtttgttctgtagtaatttttttctgattgataatgatggggtcttctttcagcaataatgccttgccgaaagcaatgcctggtgatactaagatgcctgaaatcatactatatgaccttactgcgggtgattaccttccattaagccttcaggggggaggctataaatatccccaaattttatttatctggggatggaactcggtgaaatgaaacaaattggctttattaagcgggcgattattccaattcacccatcagcttaactaaatgttcaacagcatgctgttcatcttcgccttcagcggaaattgttacagcagtaccttgagtcagtcccagcgtttgcagcttaaacaggcttttcgcactggcagatttgccaccagaagtaagagtgatgtcagaagagaaaccttttgcttctttgacgaactgcgcagcagggcgagtatggaggccatttggtgcagtaatcgtgacttcttgctggaacatagtatttcctcaataacttaaatattcgttgataagccctagaaaattctaaaactagtgtagctgaacccgttctggcttgtacaaccgttaaattgataatgaaataaggtgtatttaggcattatcaaaaaattaacatactcgatgcattcaattgttgattttatgttaataaacactatccgagtatttgttgaattggatggtgcttttcattctggctcagcgattaatttcgtgcatcaaaataattactggttaaatactaaagctacttgaataaatcatctaggaaagttttaaactttgatctgatgcacaaaaaagcacccttaaggtgcttttttgtcaatgaaattgcaaaaactcagagtgatttttaatcattggctaagtcggcaaacagggcggtactgagataacgttcagccgaagaaggcaaaataaccacgatatttttatctttatattcgtcttcctgagataacctgacggcggcagcgacagcggctcctgaggaaattccagcaagaattccttctttttcagtgacttctctcgctattttaatggcttcttcattactgactttaaacacacggtcaactaatgttaaatctaggttatcagggatgaaaccagctccaattccctgaatcttgtgtgggccaggcttaagttcttcaccagcaagtttctggctgattacaggagaatcttctggttctacagcaacgatagtgacttgtgcggcttgtgtatttttcaggtaacgagcaacccctgtgattgtgcctccagtccctacacctgcaacgaaagcaccgatattgccatcggtagcttcccagatttctgggcctgtggttttttcatgaatttcagggttcgccggattactgaattgttgcaggagaatataatggtctggatcgctatcacggatttcgtcagctttatcaatggcacctttcatgcctttcgcgccttcggtcagcaccagactggctcccagcgctttcagcagcttgcggcgctcaagactcatggtttcaggcatagtaagggtcagcttatagccacgggcagccgcaacgtaagcaagagcaataccggtgttgccactggttggttcaataagttctttatctttggtcaggatgccacgtttttcagcgtcccaaatcatgttggcaccaattcggcactttacgctgaaacttggattgcgggattctatctttgctagaatgcggccattaccaaaatgttttaaacgtacgagtggagtgtgaccaatagtcaacgaattgtcttcataaattttgctcattattcgattgccccttaaatacctttaaacatcagataaccatacgctaacatcttatttatggaaatagagtttaagtctattcttattatataaaagaatattcgttgattttttatattatttacgttgtttattataagaataactattcctccatttatgattttatatagttatttctgcgccgtgatggttacagttaattaaaggtaatggctaatacaaaaccctggtgtattcttgatacatcagggcatggtgttatttaaaaaggaaaaagtggtttaatgggatgggttatggtgtaaggcgtgttgagcgcgatagcgatcaacccacatggctgtagctccacagactgcaacgggcataatgaacaggtttactaccgggatcatggtcaatacactaacggctgcaccaaattgaagattgtcaattttgttttgtcgcagggtactgcgcatagtagaaaaactgattttgtgattatcaaacggataatcgcagtattggatagtcaacatccaggcactgaaaataagccagaggacaggagcgacagtttgaccaatacccggaatgaaatatagcaacagcagtacgagcgcacgcggaatatagtagaggatttttactatctcacgtttcaaaatacggggtgtatcttttatcaaatcgaccatgccagtgtccggcgctggaatgccagttaattccgcttccaatttttcggccagtaatccattgaatggtgaggcaataaaattagccagtatgctgaaaaaataggtaaagatcagcaaaattgagacgacagccaatggccacagcaaataacttagccattgcatccaatctggtattttatcgagcgcccatagtatccaaccatccagtttatggtacaaccaccagaatgaaccacccagcaataaaatattggccagtaagggtaataaaacgaatctcttgatgccagagcgggttatcagatgccaaccttgtacaatataatgaaacccgctcaaatgttttggcagttttgtcgaattcgtcatattttcttattctctcctagatgattgagacggtatgatataggcaggattttctactgaccagtagttttgtgcgtaaaaaatatccgaaaaaacagggtatatctcctttatggtaagaaaagtatgtagagacttgcacttgtgctatttgacaaatactcttatctaaagaatattctgccgtggtggcaattaatttaaacaacagagatagcaatgatgcaggatttgcgtctgatattaatcgttgttggtgcgatagccataatagctttgctattacatgggttgtggaccagccgcaaagagcgttcgtcactctttcgtgatcgcccagttaaacgtcataaacaggagcgtcaggaagagctcgacgataatgatggcgataaactgtttgataattcgtcaaagtcgcatgttcaagagtcagtcaagcctcgtaatgaacatcgtgaagagcctgttattaaacgctctgtacctgagttatcagcggaagcgcctgatgaggcttttgatcctttgctttcaaatcagcaatctgaagcatcagcggcaaaagtaaaaaccgctgaggaatatcaggaagagccacagcttggcttatttgagtctactgagcagagtgctgaggcagcagaatcggttgtcaatacagcagttgtggaagaacaactgaacgtattggaaaatgaagctgtgggtgaagttgagcaagtcaaaaaagaaacagtgctggtattacatgtctctgcccatcatggtcaggagcttgatggcgaagcactgcttcaaagtattttgcaatctggcttccggtttggtgatatgaatatctttcatcgtcatttgaacccggcgggcagtggagcggtgttgttcagtctggctaatatggtaaaaccaggctcgtttaatccagaactcatggacgatttcagcacccctggagtttccatgtttatgcttgtgccatcatatggtgatgctaatcagaactttaaactgatgttgcaggcagcacagcggattgcttctgatgtgggtggcgttgtgttggatggtgagcgaaaaatgctcacgccacaaatgatcgaacactataaggcgcgtattcgcaatacgctcaatgcctgcgaataaatcttcttttttagtaccaagcccccgctagccgggggtttttcatgtctggtgagaagttatggaaagtattatcgaaaaaatcaacaaactaagagcaacattgcgtcatcacgagtatttgtatcatgttatggatgcgccagagatccctgatgcagaatatgatcgcttactgcgagaattaaaagtactggaagagcagcatccagagttgattacggctgattctccaacccagcgtgttggtgcggcaccattaacggcatttggtcaggttcgtcatgagatcccgatgctgtctttggacaatgtttttgatgaagaaagttatctggcatttgacaagcgtgttcgtgatcgtctgaaagatagtcgggatttggtgttttgctgtgaattgaaactcgatggactggcggttagcttgctgtacgaagatggtgagttggtacaggctgcgactcgtggtgatggtacgacaggggaaaatatcactgttaatgttcgtactattcatgctatccccctgcgcctgaaggggaataatattccagcccgtgttgaaattcgtggtgaagtttttatgaagcagggtgggtttgaaaaactcaatgacgaagcgcgtcgtaagggtaacaaagttttcgctaatccacgtaatgcggcagcaggatcactgcgccagcttgatccgcgtattacggccaaacggccattgaccttttattgctatggcgtcggtgttctggaaggtggagaattaccggcgagccattacgaacgtctgatgcagttcaaacaatggggtttgccagtcagtgacaacgtgaaattatgccagggaactcagcaagtcatcgacttctaccataacattgaacagcagcgcccgatattgggttttgatattgatggcattgttatcaaagttgactcccttgaattacaggaaacgttgggttttgttgccaaagcgccccgttgggcaacggctttcaagtttgctgctcaggaacagatgaccatcgtgcgtgacgttgaatttcaagtgggacgtactggcgctatcacacccgttgcacgtttgaagccggtgcaagttgcaggggtaatagtcagtaatgccacactacacaatgcggatgaaattgaacgtttggggctgcgtattggggataccgtggttattcgtcgtgcgggtgacgtgatcccaaaagttgttggtgttgtacaggataaaaggccagccgaaagtcaggaagtgatttttcctgaatactgcccagtttgtcgctcggatattgagcgagtcgaaggggaatccgtggcgcgctgtactggtggattgttttgcggtgcgcagcgtaaagaagcgctcaaacatttcgtttcccgtcgagccatggatgtcgatggtatgggagaaaagatcattgagcagcttgtcgataaagaatatgttaaaacacctgccgatcttttccgtctgagcgctggaaaattaacgggtcttgagcgaatgggacctaaatctgctcagaatacgattgatgccttggaaaaatccaagaaaaccacattcgctcgttttatctactctctgggaattcgtgaagtcggggaggcgactgcagctaatttggttgcacattttgtcacattagaaaaactgcgggcagcagatactgaagcgttaatcgcggtgcaggatgtgggaggtgtagttgctagccatgtcgtgaatttctttaatgaaccgcataatcagactgtgattgatgacctcattgacaatatcggaatttactgggaatcagttgaaacgttgcagtcagacacagttggtaactcatttgctggcaagactgtggttttgacaggctcgctaaaccgtttatcccgggatgaggccaaagataagctgacagcgctgggcgcgaaagtgacaggcagtgtttccaagaaaacggatttagtcattgctggcgaagctgcgggttctaaattagccaaagccacggaattaggaatagaagtcattgatgaagaagaaatgcttcgtctgttaggtgaataaatatacccaatagatttcaagttgcagccaataaagcgggtgacttgaaagatgaaggggataaaaatgatttattaaataaaaataaggggggctactgagaatagatcttgatagcaccctatacttgatgtttctttttgcatacccagccaacacgttcctgactaaagtgtgaacgagtttgctaaatgggaatttgtttccgcataatagtgaattattgttatcacaataattcactattatgcgttacataaaatgtaattataaatttgtgcttcgccatgtctgggattctctttatgtctcatataagtactatcaattatcattcgtgcgattggtactgtgttgtccaaagtgaatggcatgggtaaactggagtctttcaatgcggttggctcgttgattctggggcagtcagaaaacttcgttgcttataaaaatgtgctggatagaatgtctgagtgtcgtatgtacacgatggcggcggcaatgtctacggtctctatgtttatcgtagtcgctgcactggtacttaacatgttcagtagctttatcgttctgtcactgatcaacccttactctgtcgagagctaaggggatatccaaatgaacaatctgcacgaatggcaaagtttgattcgcattcaaattaaaaaggctgacatgatgaataaagaaaatctactggagattgccaacacggccatgccgttcggcaaatataaggggcggatgctgatagacctcccagaagaatatttactctggtttgcccgtaagggagagtttccacaaggcaaacttggggcattaatggagataactcttgctatcaaaattgaagggttggattcgttggtcaagccattaaaaaatcgtgactaaaacactctttgtttccggcatttgtccttctcaaacatacagtacaataacatacagagctaaacacaccagagataggcatataagaaaaatccctgaaaacttgcgtcttcagggattcagaattttggtggagctaagcgggatcgaaccgctgacctcttgcatgccatgcaagcgctctcccagctgagctatagccccacaaatgtggttcaagttttgaattccaagtatcgattatcgtttttcattacgaaaaaggataagtatttggtggagctaagcgggatcgaaccgctgacctcttgcatgccatgcaagcgctctcccagctgagctatagccccaaatcaaaatcctgtggaacggggcgcataatatgaaacccagagaattctgtcaatggattcattaatattctctgtgtaagcgctgaaaaagtcatcaatattcgcctgcgatagtaacaataaaggcactgcaataagttgagtgcctttactattttgtgtcatttagataaatgacgatttacggtgcgatttattgcacttcacgctgggtaatataggccagtgctttatcaatgcgagacaatgaacgtgcttgattgatggcatgaatagtgacatcaacacttggagattggccggcaccggtgactgcaacacgcagtggcataccgactttacccataccaacttccagttcatcagcagtcgcctgaatggcatgatggatattttctggtgtccattcagtgacagcagccagtttcgctcgagcaacttccagtggttgacgggcaacagggcgcagatgtttcttcgcggcatcagcatcaaattctgcaaattcttcgtagaagtagcggcaggaacctgccatttcttttagtgtcttgcagcgttcacccagtagtttgatcagagcaaccagttctgggccagtacgggtatcgataccctgctgctcaatgtgccatgccaaatgcaccgcgacttgttcagctggcagggtattgatgtagtgatggttcaaccattgcagcttttcagtattgaatgcactggctgatttgctgatggcatcaaggctgaacagattgaccatttcttcaacgctgaaaatttcctgatcgccatgtgaccaacccagacgaaccagatagttcaacagcgcttccggcagatagccatcatcacggtattgcatcacactgactgcgccatgacgcttggacagttttttaccatcatcacccaggatcatggaaacgtgggcatattctggaacaggagcaccgagggctttcagaatattaatctggcgtggcgtgttattgatgtggtcttcaccacgtacaacgtgcgtaatctccatatcccagtcatcaattacaacacagaaattataagttggcgctccgtcggtacggcgaatgatcaaatcgtccagctcctggttgctgaactcgattgggccacggatgctgtcattaaaaatgacggaaccttcctgaggattgcggaaacgcacaacgtgtggctcatcatggctgtgctggcattcgctatcacggcagcagccatcataacgtggcttttcgccattcgccatctgggtttcgcgcagttgttccaaatgctctttggaacagtagcagcggtaagcagtaccttgctccagcatttcatcaataacgtggttataacggtcaaaacgtttggtctgataataagggccttcatcccaattcagatttaaccagttcattccgtccataattgcatcgatggcttcttgagtggaacgctccagatcggtgtcttcaatgcgcagtacaaattcacctttgttgtggcgactgtataaccaggaataaagagcagtacgcgcaccaccaacgtgagatagccagtaggacttggtgcaaaa

SEQ ID NO: 14972 - DNA, 160310 bp, Xenorhabdus bovienii
  unsure (1)..(160310): unsure at all n locations
  Genomic contig Name=Xb4151_4152.C431
ctggatcgttaccagcaaaccagtgattgtcagtgatgccagctgattatcacctctgtttaacggaagaatcgcggagcgttgctgtttgtcgatctgattaccccgacagagaagaaggtgaagtacgtcagtttttgacagagcggggaatgtcactgtccgagactcctgctgatcagttcggctcttctattgctggctgtgtcatggttggaagatcaggcagctgaagatgaagtccaagcacaaattatgttgtttgatgagtatcttttaccttggtgtgggcagttcctcggtaaagttgaagcccatgcaaccagtggtttttatcgaacgctggcgattgtcactcgtgaagcgttgcaggcattgcgtgatgaattagaatctgagtgacagtgtcacgatattagttcagctgaaggctatgaacaggcaagtgtatcggtcactaattgataaaataaaagggcaaattattaatggataatttgcccttttatttcaatgacgataaaaattatttatcggtcaatccaataactaatttcccgggtttaatttccaaccttttggcgaattgtgaggccgctgcctcggccttgcttttttctggattcagaacataaaccggatgagtatcgaaaaactcactcaaagaggtattcagataaggaatcaatgccttaaccggagccgctgctttttccggtgttgtctggtagtctacgatttccagccctttcacgaaaatagcgcctttttctgcatcaaatacgggtttagccttgatagtgagtttcatatcagcctgaatcgtacccaagagcgttgcaagttgaatttttgcttgcgtggatagttcaattttttcaggatcatgacggcctatctggctggataaatcccccagcgtgatattggcattcgcgatacccggaatgctgatttttttctgataatgcacttttttgagcaaataatcattcatcagaccttcgttgatgctgaagtctttaaattgatcacagccgctgactaatcctaccagcactaatgctgcccctaagaaaaatcttttcatattgactccttcttattttcaacggacagattctacactatttctaataggattagtgtctgccaagcatcacaggatcaattttctttttattgaattggtgatgaagagcataaatggtaatcaaaccagacaatcccagcaaaatccaaggtaattgcggcatattcaagacacggccagtatcatagagccatcctccaccggtgtaacctatcgcaccacccagagctaaacccagacggctaaatcccatataactgccacgcgcccgtggatcagatagtgaagcactcagcgtttcacgagcaggatctgctgttaccaagcctaaatagaacaggcaaagcaggccaaacagtgtatgtaattgattgacccagccgatcggaaacatacagatgctcatcaaaaacaagcccgccatcaagcgctgttccagtcggaaatgtttttcactccagcgtgcgatggggtaaagcaatgtcagggagataacggtttcaatggcatacatccatttgacggcggtaggagtgccggtaatttcatgaataataatcggaaacatcagcatcacttgtactgacaggacaaaataacccgtcaatgtcagcacatagtaaaagaaccgccgatctctaataacccgcataataccttctttgataggagtacggattgtagaaatacggtatgcaggcagtagccaggcgttaaataacgcggccagcacaaaaatggatgcaccaatccagcagacaatattgaaatcatattgcagcaaccagcttccgaggagtgcgccaaccacggcacctgcgctgtcctgcatcatcaggattgaataaaaacgccctcgctcatggggacgggttaacttaatgaccaaagccgctctgggaggatcaaacaaggttcctcccaatcctgatagaacgcaggaaagtagcaatatccatggctcatgtgccattgccatcagagcaaaacccagtgcccgcaataacataccagtaacaatcatcggcttggcaccaaatcggtctgcgatggcacccccgaagatccccaagccttgttgaacaagctgacgaagccccagagcgaaaccaacaatcaatgctgtccagccaagttgttcgacgaaacgaattgaaattagggggaaaacgacaaaaaaacctaaaacaactaataaattatcaaatagcaggaagtatttacccaagctacgtgcttgtgaaaccaacgacattgcgcaccattgaaatatgagagaataaatataaagttcttattattctgaccctaatctcttctttaaggtagagggttatagatgatatttttttatcgtgggtaataggcaataattttaataagagataaattatccagaatttttcaagacaaacatcaggagaaggcatgtttggttatcgttctgcatcgcccaaaattcgatttattacggataggatggttattcgtctggtatatgaacgtgatgcttatcgattggctgagtattattcagacaataaaaatttcctgaagccatgggagccaacaagggatggcagtttttatcaaccctctggatggacaaatcggttgaactatatcgctgagttacaacggcagaatgcgacatttaattttgtattattggactctgatgagcgtgaaattatggggatggcgaattttactaatgttgtacgcggcgcgttccattcttgttatcttggttattctctggcggggaaattgcaaggacaaggattgatgtatgaagcactgcaacctgcgattcgctatatgcagcgctatcagaaaatgcatcggatcatggctaactatatgccacacaaccatcgcagtgggaatctgctcaaaaaattggggtttgagcaggaaggttatgccaagaattatttaatgatagatggtatttggcaggatcatgtgctgacggcattaactgatgatgcatggggtaaagtggatttatgaatatcgagataagtctaatagggcgtaatatagaaaatgtagacagggtctttgtctgttagactttaaacactggctgctatcccgctaggttgctttatatgtcatttttatgatgccttatgggatagctttacatttttatgcttaactccataagaatacaactttagaacaataccatgaacttattgaaatcactggcagcggtcagttcaatgacgatgttttcccgcgtgctgggctttatccgtgatgccattattgctcgtatatttggcgcaggaatggcaacggatgctttttttgttgcgtttaaattacctaacctgttacgtcgtatctttgcagagggcgctttttcgcaagcttttgttcctattcttgccgaatacaaaaatcaacaaggggatgaagcaacacgtacttttattgcgtacatctcaggtatgttgacattgattctggctatcgtctcagtgataggtgtaattgctgcaccttggatcatctatgtgactgcgccgggatttacggatacaccggataagtttgttttaacccgtgatttacttagaattacgtttccttatatctttttgatttcgctggcttctttggctggtgcaattctgaatacctggaaccgcttttcggtgcctgcttttgccccgacactgcttaatgtcagtatgatcttttttgcattgtttgtggctccctattgcaatccgccagtgttggcactgggttgggcagttgttgccggagggattttgcaattggcctatcagcttccccatctgaaaaagatcggcatgctggtattgccgcgggtttctttccgtgacagtgctgtatggcgggttatccgtcaaatggggcccgcgattctgggggtatcggtcagccagatttcattaatcattaatacgatttttgcctcatttctggtttcaggctctgtttcatggatgtattacgctgaccgtttaatggaactgccttctggtgtactgggtgtagcgttagggacgattttgctgccttcactagcgaaaagtttttccagtggtaatcacgaagaatatcgaaaactgatggattgggggctacgtctttgttttttgctggcgttaccctgtgcagttgctctcggtattctcgcggagcctctgacggtatcattatttcaatatggtcacttttctgcttttgatgctgagatgactcagcgggcgttaattgcctattgttttggcttgatgggattgattgtggttaaagttctcgccccgggtttctattcccgtcaggatattaaaacaccggtaaaaattgctatcgctactttaatcctaacccagttgatgaacttagcctttattggcccgttgaaacatgcaggtctggcgctttctattggtctggctgcctgcttcaatgccagcatgctttattggcaactgcgtaagcgtgatattttcacacctttggcgggatggggaatatttctgtttaaattggtggtggcaattgctgtgatggtcggggtactgctggcagtattgtgggttatgccagcatgggaacagggcaatatggcaatgcgcctactacgcttaatgggcgtagtgattgcgggagcaggtagttattttgcagctctggccttgatgggatttaggctaaaagattttgcccaaaggggattgcagtgattccctgattaataaataatttcatttaatacaaccgtccaagcttttattgggcggttaatgagatggtccccaccaccctgtgagcggtatgctggcagggtgtttctttcaggagaagaccatcatgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtgataaaaagactttcaaccgtcttggcagagaacgaacttcctccctatctggcacagttgctgatgcgcttacatgcccattatctttatcttgtggaacagctcaccgagcttgagacggcactggagcaggagctgagcacgtgatgaaacaggacagcgtcttcagacaatcccgggcgtgggtccgataacctgcccagcgtcttatcatcgcagctgggcgatggtaagcagtatggctgtagccgggattttgctgcttcaaccggtctggtaccacgccagtacagcacgggtggcaaaaatacgcttttagggataagtaaacgcggagacaaaaatctgcgacggttacttgtccagtgcgccagagtctttatccagagaatcgattatcagtcaggaaggctggctgaatgggtaaaggctcagcttgagcgaaaacactcaaatgttgtggcctgtgcgctggccaacaaattagcccggatagcctgggcaatcacaacacggcaaactgtgttcgaaaggtaacgacgacgccagtctgactggcaggttaatcgttaattaaagcagttcccaatctggttttgcgaagactgattattgatgacatgaacggcttatcgacctgatggaatcctgacataaaaaatggctctctgaagccgtgcggttttttaggcttatcaggtgcggaactcatcgaggcgcgggcatccctgcccatagtgacgccggatagatttaagcaagccaacatcaatcaaaaatcagtgttgcaaaaaaggtggggaccatagatttttcatagcgggttgcaatacgccgatttcctttcagaaaaccgaaacagcgttcgaccacattccggtcacgataagcctgcttatcaaattgcgtgcgaccatcagtactacctttttcattgattttataaggaataatgctctttatcctcaattttcgcagataaccacggagttttccgcccgaatagcctttatctgccagtaccgctttaccgcgccgtttcatgaaaccatttttgcgttggacgccaatgccatcgagcaacggaatggcggattgactttcatgagcttgcccagcggtcactatcaggttgaggggaaatccctttcggtcggttgccaggtggattttggtgccataaccaccgcgtgagcgacccagcgcatgatcgtcagcgatatcgggatgttttttttcgcgcctgcggcatctttactcgcgcgaatattgctgccatccaggcaaatttcagcccagtcaatcaaccctttttcatccagaatggacagtaaacgattaaatatcttgttgataatgcctgattttgaccaacgattaaatcggttatagaccgttttccaaggcccatagcgttccggtaagtcgcgccacggtgcccctgaacatagcacccagaacatcccattcatcacacggcggtgttcaacatagggacgtcctgcccgttctgaatgaaccaggggcaaacaagattctatcaatatccatgcttcatcaggaatgtcgtagcgtgccatcatcttttcctatattgaaaaccgtttagatgataatactaccgatttacattaagggacacggcctaggtcattttgtgtagggacaccggaaaagtgcgaaaggattcgtatagagcatataggaatggctaaaatttgaatataaaaaataaagccatctcagcataatgaagatggcttgggtatatctaactcccgacttgattaattgcggctttcttgcaattaagatttcgtttccgcttggtgaaagttgttcattaaacggcgaatcgggatgattaaagcaagcagaatagcagaacagataatcaacgatagtgagacgttggaaaacaattctggcaggctatcaagtttatttgcacgcacgttaccaccaatcaggccagcagccagatttcccagtgcgctggcacagaatcataatcccattacctgtccacgcatgcgggaaggtggcagtacagtcatggttgccagcccgattggactgaggcaaagttcacccagcgccagcaaaagaatacaaaatgcaggttggaaatggctgccattcgatgaaatgacagccggataacgttagtcagtgaatgtttttattgtcatcgtacagggatggcataccttcgggacgtgttttaaaacgacggtgtagccacatgtactggtctggtgcctgcataatctctcgttcaaccaccttgttcataaatgctgccgcttcaacttcatcgttttttggaaaaccttccaccgctggctggatcattagctcataaccttttccatccggcaatctacggggagtaaaagggagcagagctgggtcggacaaacggacaagaatcgaagtacccatcgttgttgctgcgtgttcaactgcgaataatggagcgaatacgcttttacgtgggccataatcatggtccggcgcataccaaaccatttcgccgtttttcagacaacggatcatgcctttcacatcttttctgtccagcatatatttattggaacgcagtcgtccccaagtttgcagccaatccatgacggggttgtcatttgggcgataaacaccgatccccggatttaacagacccaagatacgtgcacccaattccagtgtcagaaaatggatcccgataacaatgaatccctgattactggatagcactttttggagattttcttctcctgtgattttgaaccaacgcttgattctccagtcaggccaaaaccatgccatgccagtttcaaccaaccccataccaacagactcaaaatttttgactagtaattcatttcgtttctctggtgacatatcagggaaacagagagctaaattgcgttcagcgattttggctcgttttttcaaaaagcgttgtgaaagccggccaagccgggttcctatccaataaatcaccggataagggagtaaaaccagtaaataaagtatcccgatacctagccaagtcagccaataacgggggtgtaaaaatgaacgttcaaaagatggtgcttgtatcatgtgttttcagtgtattaaggagaacatttaactaaaagccgaactcgccaggctccaggaagtaatattggtgtattgtgacattttttagtggaatatcgaaatattgatacattaaatgcttaattgtcgataaatcaaacaccatatccactatcgggtaatgctgcgccaggccatgattatgatattcctgcgcattatattcaaatgctgttttacatctgttggacatgagttgggcgtgaaatgaggagcaagcacgaattattatcacagaatagcaaggttaaaaatcactattctctaaaggccattttcgttatgatatccagctatcaatgggatagccattgaagttttgattcttttattacagaaatgttaccgaaattcaggaaagtacaccatgccagtgttacataaccgtatttctaataaagagctgaaagagcgcatgttggctgaaattgagccgcgcacgactatctctttttataaatattttacgatttccgaactacaggcttttcgcgatagcctgtatcaaaaatttaccgagttgtctgtttttggacgggtttacatcgctaaagaaggcatcaatgcgcaaatcagcgtaccttctaaaaatgtcgatgctttaaaagcgttactggatgcgactgatccggctttatgccatctgcggctgaatattgcgctggaagatgatggcaagtcattttgggtattgcgcatgaaattgcgtgagcgcattgttgctgatggtattgaagatgaaacctttaatccatcaaacacaggcgaatacttaaaagcggaacaggttaaccaaatgctggatgatcctgataccttattcgttgatatgcgtaaccactatgaatatgaagtggggcattttgaaaacgctattgaaatcccttcagatacatttcgtgagcaattgccaatggcagtagaaatgctgaaggataataaagacaaaaatatcgttatgtattgtactggtggaattcgttgtgaaaaagccagtgcttacatgctgcataacggttttgacaaagtctaccacgtagaaggtggcgttattgagtatgcccgtaaagcgaaagaacaggggttacctgtccgttttatgggtaaaaactttgtttttgatgagcgtatgggtgagcgcatttctgaagatatcattgcgcattgtcatcagtgcggtacagcctgtgatagccatatcaattgtaaaaatgatggttgtcacctgctgttcattcagtgtctctcctgtgcagagcagtttgaagggtgttgcagtgatatttgtcgggaagagatgaaactgcctgaagaagaacagcgttttcgtcgggcgggaagagaaaatgggacaaaaatttttaataagtctcgctatcgtttaaatgatggcctgaatattacatcactacaatccattaagtaataaatattatttaatggatagttcgcggtaatcagaatgttggcgtaaatagtatctcattatttatgccagcattgttattttagaagatttaacagatatatttaaaaatattgtaaataaaaagtaactctattttgttagaaataccgattttttctataatatgtcttttgtgtgaatagaccgtactattgctaatttttagcattttagcaattttatgtgtatcggtctcttgcatccaataatggatgattcggttttcctgaagactgaaaatagaactttgtgtattaaaattggcaaaataacgttgaatatcatgtgctgtcatttcttgtatcctaaccaataatgtgctcagattcttttttggtaaaataaaatccttatttgtcaattgaatgctcgtatcgcacaaggggtatggtttatcgatataggtataaatacgggcatcattaactaacgaaataaacaatttcagttgttcacaatattccttatggtggccataactcgtcaaattcactaagatgatatctggaggaaatataggcaaaatatttatggcgtcatgaattgatacagccccgattgagaggatatctatattttctttcagggattcaataatccccaaacgcgtataatggcacttatcaatgactaacagtttcattaactgaacatccttgttcttctatggttattatttaaataaaaaatggcttaataattaagaattaggcggatgagaatgactatatgatacagtattatgaaaaataataaactatgcgaataattcagttgactaatatttgttcaaacggttaaattggacactcaacatactgagtgtccaaatgtttttctaatgctcaaggtgattattaatgcttaatatgatcaagctgactgtattctgatgcttctatcttttcaatcccagcctgcagaattaggatgagttgtttggctactcctgttgtcaaccacaatgttttgtcaatattgacattgccagaggcttgatcttgggaggataagtaatgaagacgtatcatcatagcgtcataggcatcaacagtactgatgtcccaacctacaacaggatgagtttgaataatttcatttttttgttccatataacctcctaatcagacgacagcattcttattgatataattgactaagagcagaaaatctcatcaaggatgagcaatagcagtataaccctttttagcaatctaagaaggggaaagagcgagattttttgtattatcactaattgggattattgtaagtgatgccagcgacttattaggtaagcgtaaacgtgcggaaataaaaatattttccgcacgggtagtaatgaaaaaattagtcacatacctttacttcccacttggcatcctctccggccagaaatgggattaatttctcatcaccgcattcgatatactctgtcactggcgtaggtttacgtgtgagttcaacgaagccttcattaacgggcagaccataaaacttagggccatttaaagagcagaatgcttcaaagtgagctattgcatcgatttcgtcaaaaacggtggcataggctgcaagagcagtaggcgcattgaagacgcccgcacaaccacaggaagattctttgcgatgctgtaaatgaggggctgagtctgttcctagaaagaatcgattacagccactggctaccgcggaacgcaatgcttcctgatggatattgcgctttaataccggtaaacagtagaggtgaggacgaataccgccaaccaacatgtgattacgattaaacattaagtgttgcggtgtcagtgttgccgctaatttatcattgcctgcaagaatgtattcggcggcttccttggttgtaatatgctcaaaaacaactttcaattcaggaaactgcttacgcaatggttccatcacctgctctataaaccgagcttcccgatcaaaaatatcaatatgggatgcagtgacttcaccatgaatcagcaaaggtactcccaatttttccatggtttccaataagggatagatctttttggtatcagaaacaccgtggctggagttggttgttgcattggccggataaagtttgcaggcagtaaagaccccttcttcataaccaatttcaatttgtgaactgtctgttgagtcagtcaagtaacaggtcatgagggggtggaaatgatggcctgacggaatggcagcgattatccgatccctataggctttggcactggcaacatctgttactggaggggctaagttgggcatgacaatagctcggccaaagaaacggctggtatgaggaacaatgatttttagcatatcatcatcgcggaaatggacatgccagtcgtcagggcggcggattttaattgtgtatgattcagtggtcatgaaaccggctccagaatataagaggaaaaatgatggatgctgattcagcactccttaagccggaggaggatgataaaacgaaaatagctaaatagctattattgaatgataaaactctatgaatttcgaaaagttagtcttttaaatattatatgcagggtattcagaggaaatttatcgtatcaaaaaacggaaaaaatagaagtaataacacgagggtgaattgaatttgcttctcaactggactcgaacagtgacatacggattacaattcggcgttctacaactgaactatggaggaatccctcagaacggatgcatttaacggtagcttcacttttgtaaaagaaaaaatacaatactatttgttcgcagataatctgtacttcggtagcttttattgaacttgtttgtgtccgtaggggaggcaccagaagaactgcgagcataatatgtataagcagaggcactaatagtaggggatgatagcaagaatcttgcaatgtccagaaatacatagtgaaaaactaactttaaaaggaaaaatggctggaagggaaaatgttagaaagcccgactagcagagctaaatcgggctttcttaaacttggctcctccaactggactcgaaccagtgacatacggattaacagtccgccgttctaccgactgaactatggaggaatcgcttcattcctgagaacgaaacgaatactaacgatattgttttcgtttgtcaaagcagaaaatagcaataactgtttgtttgctgagaatatagacttgttgtggtatttttagtctgaatttgtatttggatggaaaaaaatacatctggagcagataagtttgcagaaaatagataacaaaaagcccggttagtggaactaaaccgggctttctcgaatttggctcctccaactggactcgaaccagtgacatacggattaacagtccgccgttctaccgactgaactatggaggaattactttgttcctgagaacggagcgaatattaggggaatgattcaggcttgtaaagcggaaaaatggaaaataaatttaagtgtctaactgatgtgcaaggtgatgatattttgttattttttacagcaaaatatgaccatattgtaattttccataccttactcaatctcttattacttctttgttaccaccttgataaaaattcagcaaatcgatgtaaagagtaaggaacaaatttaccaacgtgagaaaagagcactttgatatcgatctgaccgacaaaaaacttgaatacagtcggttaaaagtacatctgagtaaggagggtagctgattgataaaatcaaaagcaaaaatcccgattagcagaactaaatcgggatttctttaatttggctcctccaactggactcgaaccagtgacatacggattaacagtccgccgttctaccgactgaactatggaggaattgcttcgttcctgagaacgaggcgaatactagcgatgaacgctgggagtgtcaacgcaaaaattctatttccctatcgtttgcttatcctgtgaacgtattgtgtcatgattgaactgccttactgaaattaagcacttttattcaccatttcggaaggatgaaaatagggtgattgttctgaaaaggcaactataaatacatcataaaaacaaattccgtcttttttcctcatgattcttttgatctcatctttcatttcactgggtactttaggatgagtaagtattttattgatggctttatgggatactttttcgttgacgaaccattctccgttataacagacacgtaaatccagtacatcaatgtcttcaaaatgatacaccggctttatatcgaaaagtaaaacggctgccatggcgacaaaaagcactgtaaataaaatcagtgaccaagtaccaaaatagggagaataccccatgagcatgacaaggaaagcataagcaataaccattgccaagcataggtatggatgatgatgaataaaggtactattgaaatgtactttaccatcacggtgttcttcgagattaatccgcttaagatcctgaatcaatatctgtttgatgatattcataatactaacccgattattgtaaaaacgcgttatcgaattgaaggttatgccatttttaaggctagcatgctcggaggacatatctgtatatcaattgccttattttatttataaaattgttattgtctggaaacaatatcgatatttttgctaagataaaagttgaataaatcaaataaaattataattgtacctattcatcatgtcattttgttctaatattgagcacatgcgacttttttaaatcgataatacataaaaaggttgctattcctgtgcggtcatgagttaatgcgtttggcctgataaacagacctactttatgtacgacatcttgagttaatgagttatgtgtaagtgctatctccggtagcctttgttgaccgtttccttcttagtgcctccataagtaatagctgatactggccaacacatgcccgaggtggcgagttttttttgatatataggaaagtcaaatgtctgacaaaatgaaaggtcaagtgaagtggttcaacgagtctaaaggctttggtttcatcactccagctgatggtagcaaagacgtattcgttcacttctctgccattcaaggtaacggtttcaaaactctggctgaaggccagaacgtagaattcaccattgaaaatggtgccaaaggcccagcagcagcaaacgtaactgctatctaatcagcctttatgcctttatttaagctcgccacacttaaatgtcgtggcgggctttttgtttttttatcttagttacttttatgccaatttatttggatgagaaaaataacaggatgaagaatgcgtttgtcacctatcccccagactcagataaaaatgagtcacacgctatttaagacctatgattttttaatgaaaaaggcgatatctagtcgaattaagtattcggcattatattccatgtgcaagataaataggttatctctttaggttatctatgtggtgttcagcgggtattggcgtgttatgcagactgggtcaatattggtctgcgagtattgccacaagcattattctgtgtgcgaacattctcttgagagaggcccacaacggattaatgcccaaccttattaacaagctttaggtttagaacaacgctataagatctatattgtttgtgatattcatgatgaaatcctagtaaggacactgatcctacaagcaattagtgggttaggtgtcagattgctacagaattgctcacttagaataatttcatattactaattccattattttatatctatcagtggataagaacgggtgatattccacctatctcttgaactcaataaggtgttatctaaagccagccaaccttacacatgaaaaagcaccttatgcgtttcttcagctaatccatcactttccataattcgtttaattatgtcctgatgcttttggcgatgatcatttttttactgattactttttgttgccacgtcatgaaaatggaataaatataaccgatattattattatattgatgataatttcattgagtggcttattcttgttctgacagggaagatacctcagtacctcattgagcatggctaaataagtggcactatagatttgattgatcaagcggttgccaggtatgggaacgaaaaatctggtatttgtttcctcagcagctccagaaaaattgatgagttatcttttgattttgttagacctagcttgccaatttctgtttaagaacagtagaaaaagtactaatcgacgggcaatgggacgactgagtaaattccatcagtatgctctcatatgaggttaaaggagaaaataatttttctcactgaagaaaatcgtaacaatgtgatggatctggttaacctctataaagagtaaggtttcagagggttaatcttagtgacaggggagttaagtcttgatgaagtgaaacatctattttctgttgctgatgaaaaggagatagtactgcaagttttattaacatttttagatttgccaaaagtgagtgcggcgatggcaattactgcattaagggaaaatgacgtttcagctaaggcgcttaacggagatagccctgtcattaccgcagaaatttagatcctagtaatatttttattagttttgatattgaatttgcgagtgatgaagacctttcaaaagaagtggaattaagaacagcattttgtaagttaaccctacggaaaagtcacgcattttaaaataattgacacacagttagttttttctgtaatggaataaatgatatgtctacattgcggtatgctgatatcgatatttctattgacacgagaaccgatactgcaaaagggtcagaggatatcattttgtttgataaaaatctgatggtattaggggaacgagtaataaagagtagggaaacgtttgggaataagtatttaaatatgacagccagtcggatttcatgaatgtatttttgatactgattaccagagtatttattccatttttactgatgttagccatctatttgcttgtacaaaacctaatgtacgatatttcacaactgtcttttgcgtaagacaaaatggataaaaacttattgagaatttttcgcaaatagatataaagaatataggacattttatgattgggttaggggcgatattttctatcttagatattacaatattcgctatgattctatgtgtatttatagtgagctgtgtggaacatcagctttattccaatagactaatttatggaaggtcagttgtctcaggcactggctgtacatatgttgcgtacataaaaagttctgtttgtccaaagtatcgtcgcattatctgtgttattaacggaatcaataactatgacactaggtatatacctgccatttttaccatttgatgtactaattggattacagtcattgccttaaaaatattttttttggtgaataagaacactaatatgcgatttcgttatcatccaaatgatgaagcaattttacattcatcacgttggtggatagttgtaaataattctcattaattaacatcttattttgtgtggattaaggtggccgcccacatagcggttgccattagcaatttcatcatgactcatttttacagatatttcgaataggtattgatgttattcttcgaatatgatcttactatcacaataaatataaatttaatgaggtaataaggtcatatttacccgttattctttttatttgaatcgttacttttatatgttctattgttacttatattttaaattaagtaagataatttcctttttcatgtttatttattctgtttacatttcctgttttttatttaaagtgttttttcttcttttaattgtattttatgttataagaatttattgttaaatttgtatttgggagttattttgtttctattttttatgttatttaaggaaattaattttctgttaatgggggatttttcttttgcgtacacggtcagtcactccgttctgtataaatggcataaacattgattattcttaacattggtaaaaaagagagcgcttttaatgataaatttatcttattaataatgagtgtaaggtagtcaaagaggagaaataaccaccagtgagaatttagttaaatttataccataaactgtctatctatgagtttattttgttaaattaaatttatatattatggcggtctggtgcggtttctgtggttttgaatagtagtggcttttgttgcgttctcgaagccttgtccgctgtatttactctaaggtagggatgtagatgtttttttatttcaacatcatactgtattttatcttatttttgtgatctgtgtgatatttatgcgtaaagtggcttgaatgccaccttttcctctgtgtgaaaagaatacgatcgtaaaccaaaaatgatcagagtagtagctttttaataactagtattcacatataattaataaatttggcataactatgatctaagtcaacttatagtggaagatgagtacctacctacattatcaagaagcaaattttactaacatattgaaaatttaactaaagtatatattttttatcgccattttaaatttagaagtttaatagatcgtataaaacaaaaaacagtccttaatatttttatttagataatttaacttattaattgtagactatttctcgttttctgttgcttgaatagttaatgagctagaatcataataaaaagtgtcagttttgtgatgcatgtcacatagtatttaaaatggcatatattctccgttgtataagttgatgattcaggagtaaagttaattagcattaagaatattcttaatcaattgtggcaagtgcattaatcagatgacgcaataatactttcacaacccattaccgaaatattttagaaattgggcgatcccaagagtaatacaaaggacagttactgctctggctaaagatgtatatttcagttatgtcggagattattgaatctcatgctactggtaattttgtcgtgagtgattctttgatcacttaattaatttttcatataatcggacgggatatatagaaatgagtacggttgaattgctcaaacatatttatgacataaatttatcgtatttgcttttagcgcaacggctaattaaccatgagaaagcatctgcgatgttccgtttaggtattagtgaatcgatggctgatacgttggccgagctgacattgcctcagttagtaaaattagctgaaactaaccaactgatttgccattttcggttagaagaccacgaaacggtgctgcagttaacgaaggaatcgcgggtggacgatctacaacaaattcacacaggtattttgctgtctactcatctttttcagcagttatctgcgctggatgacatttcaatcaaaaaaagagcgtgaagatggttgaaaaaagtattgttcaggaagcgaaagatattcatcttgcaatggaactcatcactttaggtgcacggttgcaaatgcttgaaagtgaaacacaattaagcagagggcggttgatcaggctgtataaagagttgcggggaagccctccgcctaaagggatgcttcctttttcgacggattggtttatgacttgggaacagaatattcactcttctatgttctacaatgcttatcgtttcttgatgaaaagcgggcattgtgacggtgttgaagctgttgtaaaagcttatcgactgtaccttgaacaatgtcctccaagcagcgaaggtgggtctgttctggcattgaccagagcctggacacttgtccgtttcgttgacagcgggatgctacagccaacagagtgtcgctgctgtggtggcactttcatcacgcatgcccaccaaccggtgaacagctttgtttgtagtctttgccagccaccttcacgagcggtaaaaaaacgtaaactttccgttctgcctgccgatactaattcacaactgctggatggatttgctcagcaagctatgtgaatttaaatgggaaacttaaaagcaggttacaggttttttatgtgcagacctgtaacttgctctgtcataccgttcttcgtttactaattcgccctgttcaaatcccatctgctcaccaacttagctaaaggatatcgcgtgttagtacttttaggatatatagtggtttttggtgcggtaattggtggctatctgcttgtcggtggccacatgggcgcactttatcagccagcggaatttctgattattgcaggtgcaggtattggcgcctttatcgtcggcaataatggcaaggcgataaaggcaacactgcgtgttttaccaaaaatattgcgcagatcaaaatacaacaaagcgatgtacatggatctcatggcgctgctgttccgcctgttatccaaatcacgccaaaatgggcttctggctttggaacgggatatcgaaaatccacaccagagcgacatcttcacacagtatccccgtttgttaaaagatccctatttgatggatttcaccactgattatatgcgtctgatcatcagtggtaacatgaatccccatgaaattgaggccttgatggatgaagaaatcgagacttatgaacaggagagtgaagtccctgcgaccagtctggctatggttggagattcattgcctgcatttggcatcgttgccgccgtcatgggagtggttcatgcactcggatcagcggatcgtccggcaggggaactgggtgcgttaatcgcccatgcaatggtgggaacattcttagggattttattggcttacgggtttgtttctcctctggcaaccttgctgcgtcaacgtagcagcgaacaggtaaaaatgatgcagtgcatcaagattacactgctttccagcctgaatggttatgctccacagattgcggttgaattcggccgtaaaacattattcctcacagatcgcccttcatttacggaacttgaagaacatgttcgtcgggttaaatcgcctgtacaacaagaagttgaagaataattatgagagcgaataatgttactgtcatcagagtaaaaaaacgcaaaaaacacggtgagaagcactgtggtggatcatggaagattgcatatgccgatttcatgactgcgatgatggcgttttttctggtcatgtggctgctatcgatcgccagcccacaggagttaaccagcattgcagactattttcgcactcccttgcaggtagcgataaaccaagggccgcaaagcagcgatagcacaaatccgattcctggaggaggggatgaagtttttcagcaggatggagaggtttttcgcgaatctaaacttgttgaatccaataaagaaaaacgtcgtctgaatcgcctgcaccaacaacttgatcaacttattatcaccgatcctcgcctaaaagaactacgtcctcatttgttgatcgacatgatggatgaagggttgcgcattcagatcatcgatagggaaaaccgcccgatgtttatgatcggcagcgcaaaggttgagagctacatgagagatattttgcaggcaattgcaccgattttgaatgaaattccgaacaaagtcagcctttctggtcataccgataatttacagtatgccaatggccaaaggggttatagcaactgggaactctctgcggatcgtgcaaatgcttcaagacgagaattactgaacggtggcttggatgaagtcaaaatcctgcgggttgttggtatggcatccactgtgagtatgcagaaaggcattgatcctaatgcaccggttaaccgccgtatcagcattgttgtcttgaataaagatgcagaaaaacggattgagcaggaaaacagtggtggtgacgccatgaccgctaacaatagtatggatatgcaagaagtcatcagaacggattcgaataagggagcgccttctcagcaatccaccgaacaatccaatgaaatcacaatatcggtgcagactcagattgaaccgtccagtgatactaataaggtgacagagtaagtaacgatggatattaccgcgttttatcagaccttctttgatgaagcagatgaattattggacgatatggagcagcatttattgctgctcgatgccgatgaacctgatcatgaacaactaaatgcaatttttcgcagcgcccactccatcaagggaggcgctgcaacttttggttttgccaagctgcaacaaaccacgcatgttttggagaatctgctagacagtgccagacgtgacgaaatacgcctgactactgacattatcaacctgtttttagaagcgaaagatattatgcagcaacaattggatgcctataaaagttctcaggagccggatgaagatacattcaattatatctgcgagacattgcgtcagcttgccttagagctacaggacgataagcaggataagagtgctgacgctgccgccccggcaattcagtctgaacctgcattgaaagagactgtactggaagctgaagaagaacagacaatcgtgatcaatcagccagaagaaaaaaatcttccggcaggcaaagctgatcaagggagaatccgcgttcatctatccgggctaaaagaacgcgaagtctccttgatgaaggatgaattggggcatcttggtgatgtttatgatgttgaacagaccgcagacagccttgaagcttcattgatcacatctgcaacagaggatgacatcaccgctgtaatgtgttttgtgattgaacctgaacagataacatttctgcctgttgcggactcgcatccggcagaagaaactgaagcagacactcagtctgaaaaaaaaccagcggcagaaggtgtggcaatcgaaagtcgagtagctgcaagtacaataagtaccgataagccacagcctgctgatgtgccacaaaaatcagaaggacatggagtagggcgtccggcctcgcgtccggtagctggttcaccacgtcaacgtgctgaatcttccagtattcgtgttgctgttgagaaggtggatcaactcatcaatctggtgggagaactggtcattacccaatctatgctggcacagcattgtgatggattggagcagacaaaacatagcgagctgctgagttgtatggctcaattgcagcgaaactcccgtgatttgcaagaatccgtcatgtcgatccgtatgatgccgatggagtacgttttcagccgatatccacgtttggtgcgggatttggcaggtaaactgaacaaaaaagtggaactgacgctgatcggcagctcaacggaactcgataaaagcttgatcgagcggattattgatcctctcacgcatctagtacgcaacagcctcgatcacggtattgaaaacccggaaaaacggattgcagccggaaaatcagaaacgggtaacttgacactctcggctgaacatcagggcggcaacatctgcattgaagttatcgatgatggagcaggcctgaatcgcgagaagatcttggcaaaagcgcggtctcaaggcctgaatatcagtgaaaacatgagtaatgaagaagttgctatgttgatttttgcgcctggattctctaccgcagaagtggtaacggatgtttctggtcgcggcgtcggaatggatgttgttaagcgcaatattcaggatatgggtggccagattcagattagtttccaagaagggaaagggacgatcattcgcattttactgccgttaacattagcaatactggatggcatgtccgtcaaagtcaatagcgaagtcttcattctgccattgagtgctgtggtcagttcattacagccacaggaagaagatatctatcctctggcgggtgatgaaaaactgctgcaagtccgtggagaatatttaccgctactggaattgtaccggatatttgatatttcgagcggagaaacctcgccaaccaaaggtattgccgtcattgtccagagcgcggggcgccgctatgctttgctggtggataaactggtcggacagcatcaggtggtcgttaaaaatatcgagagcaattaccgtaaagtacctggcatttcggctgccaccattatgggagacggtagtgttgccctgatcattgatattcctgctttgcagaaactcaatcatgaacagttggctacgcgtaaggcggagctggtgaataaaaaaataacacagtgaaaggtaacatcatgtcagccatagaagaattcagtaaattatcgggggaaacaaccggaaaggaatatctggttttcaccttgggtgacgaagagtatggaattgaaatactgaaagtgcaggaaatacgcggttacgaccaagttacccggattgcaaatacaccttcttttatcaaagggataaccaatctgcgtggggtgatagttcccattattgacttgaggatcaaattctcgcaggaaaacgtcacttataacgacaacaccgtcgtgattgtcctgaacctgcttaatcgtgtggtgggaattgtggtcgatggtgtgtccgatgtgctgtctctgaaggacgatcaaatttgtccagcgccggagtttgcggttaccttgtcaactgaatatctgacagggttaggttccattgatgaacgaatgctgattctggtagatatcgaaaaactcctgaacagtgaagaaatggcattggtggattctgtcgctaagagctgatatttcagggctgccgtgattgttgccactcattatagccagtcgagcaaaacggcagccttacttgttttagatcaaaaaaatagtgcaaaaactcaattttttggattacacataaagttccctttaagggtgccgataacactggcatagcaatttattacaaaagggaagtcatgtttaaccgaatgaaaatagtgacggggctaatctcagtcatcatattatttggtgctctgcaatttatctccgggggactgttctttaatggtttaaagaacgatacagaagcctttgatttattggataaaatgcggcagcagcaaaaattattggatgaaagctggatcaacctgctgcaagcccgtaataacctgaaccgcgttggcatcatctatataatgaaagaacgcgatcttgatggtacttaccaaattgatgatgttttggctgaatctaaagtcagtctcgctcgtggggaacgccgcttcgagcaatttgaacagctcaaaaaattgcccatacatgatccagaccatctccaacgtttaaaacaaactcatcatgaatatcttaacgcgctcaaagaattggatggatttctggcaaaaaaacagtataaagaattttttgctcagaaaaccaccgactatcagaacgcttttaatgtggaatatgactactatctgaaccagaatcaaaaactgtatgatgaagtggcgcgcgaagcagatatcgcttatcgcaatatcatcattagcttaatctccgtgtttgtgctgctgatttcggttatgacagtaagctggattggcttgcgtaaggcattgatcaatccattgaataagctactggaaaatattaaagccttctcgaaaggtgacttgactcaaaccatcaatgtgtccggtactaatgaaatgggcatgctggcggttggtttgaggcatatgcaggatgagctgatccataccgtcagaagtgttcatcagagtacggaaaccatctataccggcaccagtgaaattgccgcaggtaacaacgatctctcttctcgtacagaacagcaggtggcctcgctggaggaaaccgctgccagcatggaacagttgacggcaacggtcaaacagaatgctgacaatgcccgtcaggccagtaatttggctgacaacgcctccgatatcgcccgtcagggaggtaaagtggtggcgaatgtggtgcaaaccatgcatgacattgctgatagttcccgcaaaatttctgatatcactggtgtgattgatgccattgccttccagactaatattcttgcccttaacgctgcggtagaagctgcccgtgcaggtgagcatggccgcggttttgcagtggttgccggcgaagttcgcaatttggcacaacgcagtgcggaagcggccaaagaaatcaaatccctgattgaagactctgtggatcgtactgacaccggctctgtgctggtggaaagtgccggcgaaacgatgaataaaattgttgattctgtgacccgcgtgactgacatcatgggggaaattgcatcggcatctgatgaacaaagtagaggaattactcaagttggtgtcgctatttctgaaatggatagagttacacaacagaatgcgtcactggttgaacagtctgcggccgcagcagcggcactggaagagcaggccatgatcttgaccaaagcagttgcgttgttccagctaccggagcaggccgaaaggaagcagtctgaaaaaagaaaacatgaagttttatcgacgataaaatcgccgactcctccagctaataaaacgaatcctcctgtgctgaagaaaggcagcaatgtggaagacccctctaattgggaaacattctaaaaaataatagcgataaccacggctgcacaatgcagccgttaaacgaggtgattacatgttaggcaggcttcgcatatcaaccagtttatatctattactcatgatgttttgtgttatgcaaattatttcgagcggtttgtctctgggaataattcatacagaccagtcatatattgaaagaattgatttgggaactaaacgaagagatacccttggattgagctgggcagcaatgctgcaaacgcgtaacactctcaacaaaattgctattggccaaaaagtgggtcagtcgcaggatcagatcgacgcgatggaagcgttgctcaaaagctcattgaatgaagctgaaaggaatttcgcacagttcagtgccttacctcagatagaaaagaatgaccaaagtgtcgccttattggctgcggttgaacgttcttaccaagaatatattaatgcgttgaaagagctgaaaatatacctttatgaagggaatttccaggcatttcttgatcagccaacagaaaattaccagcgtcagctagaagtcgcatacaacaattacatgcagtatctcggccataacatcagcacagcggtttccgatggtgccttttactataaagtttccatcgccatgtttttcggttctatcctgatggtatttgttgtttcggcatcagcgcactggtggatgcgacgtaatctgctccggccgtttgataatatgcgagcctgttttcaggatgtagcagaaggccgcctgaataaagaaattgctgtcacgactagtgatgagattggcgatatattcagaaaactgcgcgatatgcagcaatctctgattaagtcgattgcctctgtacgggacaataccaaccagatgtatgccggtattcaggaaattacacaaggcaataccgacctgtcatcacgcactgaagaacaggctgcatcgctggaagaaaccgctgccagcatggaagagctcactgttactgtcaaacagaacgctgagaacgcacgtcaggccagtgagctggcagtatctgcttcccagacggcttcgaaaggcggtgaattgaccgtcagcgtggtggctactatggatgaaattgccaacagttcgaagaaaatcagcgctattatcagtgtcattgatggcattgccttccaaaccaatatcctggcattaaatgcggcggttgaagcagcgcgtgccggtgagcagggacgtgggttctctgtcgtggcgggcgaagtgcgtgacttggcgcaacgcagtgctgaggcggcgaaagaaatcaaaaccctgatcgatgaatctgtccatcgagttaaccaaggttctgagctagttaatcacgccggaaacaccatggatgaattagtcaaatcagtaaaccaagtcactgaactgatggctgaaattgccgctgcttctgatgaacaaagccgtggtattcatcaggttgcccaagctgtcagccagatggatcaagtcacacagcaaaatgcggctttggtggaacaatctgcggcagcggctgctgcgcttgaagataaggccgacacattagtgaaaaccgttgctttatttgaactgtctgaaagcttagataatgagtatgaccatcagacatcctctgcttcaaaaatgaccgatgagtatatcgcaagtcaagtacgctgaggtcagatgaaatccaatttagcagcctcagatactgatgctatttcaccgctgaactttatgtttcagcggcatattttgtcggatgcacaatttgaacgcatctgccagttcatctatcaacgggctggtattgtactggccaaaaataaacgtgaaatggtttacaaccgcctggtcaggcgcttgcgtgtactgggaatcaatgattttggtcaatacctgtcgattctggaacagaatattcatagcaaagaatgggaattattcatcaatgcattgactaccaatctcacggcatttttcagggaagctcatcattttcccattttggcagcgcatgccagcagaaaaaatgcaggcacatatcgagtttggagcgcagccgcttcgacgggagaggaaccgtattctatcgccatgaccctgtgtgatgcattagggcatcggacaaatcggataaaaatcattggcagcgatattgatactcatgtgctggaaaaagcccgtcagggagtatatcgactggaagaattacagcacatgagtaatagccaaaagaaaaagtattttttcaaaggcattggttcctttgaaggatatgccagagtgcgtcccacactggctgaactggttagctttcagcacttgaatctattggattctgactgggcgctcgagggtaagtttgatgcgatattctgtcgcaatgtcatgatttattttgacaaaaagacgcaggaaagaattttgcgtcgttttgccaattacttaaaaccggatggtttgctctttgcggggcattccgaaaacgtcactcaaatcagccgagagttctacttgcaaggacaaaccgtttacggtgtaggtcgtcgggcaggaaggggtcatgaataaaataactgtactgtgtgtggatgattcggcgctgatgcgccaaatcatgcgggaaataatcaatagccacccggatatggaggtggtggactgcgcgccagatccgtttgttgcccgtgatttaataaaaaaacacaatcctcaggtattaacactggatgtagagatgccacgcatggatggcattgattttcttgaaaaattaatgcgtttgcgtcccatgccggttgtgatggtttcgtctctgacggcgaaaggatcagaaattacattgaaagcactggagctgggtgcggtcgattttgtgaccaagccgcaactgggccttcgcgaaggaatgctggcctatagtgagctgattgccgaaaaaatccgcgctgcggcgcaggcaaaaatcagtaccatgccatccagtcctgtgattgctaccccattgaatttcaagccactattatccagcgaaaaactgatcgcagtcggcgcttcgacagggggaacagaggcaataaaaaacctgttgcaacctttgcctgtcaccagcccggcgttactgatcactcagcatatgccgccgggttttacacgttcatttgcagaaaggctcaataaattaagccaaatcaccgttaaagaggcggagaatggtgagcgggttctgccggggcatgcttacatcgcaccgggggatcaccatatggaactgtgtcgtagcggagctaattatcaaatcatgactacccgcgctccgccggtcaatcgtcatcgtccttccgttgatgtgctgttccgctccgttgccaaacatgcgggacgcaatgccgttggtgtcatcttgaccggaatgggtagtgatggagctgccggcctgctggaaatgaaacaggcaggtgcttatacgctggcacagagtgaagcaagctgcgtagtctttggtatgccacgagcggcgatccagctgggagctattgatgacattatggatattcaaaaaatcagtaaagcgatgctggccaaaatcagcgcagggcaatcgattcgtatttagttgttgttatttgatgttaacttttgcggcactgtgctgccggatgaatgaaattccaaggagtgtttatggcaagtaaggatctgagatttctggtcgtcgatgattttgcaactatgcgtcgcattgtacgcaatttattgaaggaactgggcttcaacaacgttgatgaagctcaggatggagctgaagcactcgctaagcttcgtgctgctgaatttgattttgttatttctgactggaatatgcccaatattgatggtcttgaactgctgaaaatcattcgcggtgaagaaaagctggctgccttacctgtcttgatggtaacggcagaggcgaagaaagaaaacattattgcagcagcacaggccggagccagtggttacgtcgttaaaccgtttactgcggcgatcctggaagagaaactcaataaaatatttgaaaaattagggctctaaggagacaaaatgagtgaaaatccagtcatgccgagagatgaggcagttactaccagtgaaataatcagtcgtattgggcagttaacgagaatgctgcgcgatagtctgcgtgaactggggttagatcaaaccattgctcaggcggctgaggcgatccctgatgcgagggagcgattgaattacgttgtccagatgacggcacaggcggctgaaagggtgctgaattgcgttgaagaggcacagccccaccagaatgaattggaatcttcggcgaaatccttaacccagcgctgggatgagtggtttgcaaacccgaacaatctggaattgacagaggctcgctcactggtgacagataccagagattatctcaatcttgtacctgaacatgtctcatttaccaatactcaattgcttgagatcatgatggcgcaagactttcaggatctgacagggcaggtcatcaaacggatgatggaagttattcaggagctggaaaaacaactggttatggtgttaatggaaaatatgccttctgaccagatggccaaagcgaaaaaagaaaacgacagccttcttaatggccctcaggttaatcagaatggagcaggtgttattgccaaccaagcacaggttgatgatttattggatagtttaggtttttgataacgaatgacgggactttataacgaatagtacagaaggcgaaatagggggtttctaccacttgcagttgtggtttgatcaattcattgagttttttcacatggcacatcggcacaccttggtggaaatgatgtgctgtgtggatgtgattaccgttcacgtaccatgcgatgagccggttagtgctctttgtttgaaaaatagccctctttttcgggtgatttttgggattttgctcttagctactatacctttagtattcattgaaggttatttgccaacatttttcaaagtgaagcagggaaagtcagccatgtcggtggtagtagaggttttattaagtagtttgttgaagtattttcagtttctggagggatgtattgaataaataaaatgtagcgatattgggaatagttacctaatgtgtgaagttcatcaaaatagcatacataaaaaatgaataatgattatgccgcgtaaatcgaaagtttaacagaatgtataaatacggttaaatatttttaaaaatataacttacttattttattaatgtattgcaattcattcattgcagctaatgaaatgaataaatgattttttattaatgtaaaatcatgttgattcaataaaatatattgtaaatattaatggaatacttcattaaatatctcttgggtaataaaaaatataacatgaaaatagtgtaatttcgaggtgattatttgtaattaaagatctatttaaatagtattgttactgtttttgaagagtgtattaaagattattgaaatgtatagcataaaactctatataatttatttaattaataattattttgtgcgttttcttaggattataattcatggcggtgtttttagacgtcttatataaaatgattgataaataagccatattaatgctcttttattgggaatcatcatgatatgaaaatacttttttaattattttacaaagagtatagaggtatccttatgtacaatacagaaaatatattgtttaggcttaataggaacaatccccaaaaaccgatgacattgattcatattatgtcaatgtcattctcagcattcaggaaagaagccaaagatacactgaattggggagagaatcatcacctgtatctaaccgccaagaaagccgaaaaagaaaacaggatttttgacgcacgtttattatcccgcaccaattcgcagttacctgccatttgaagggattaatattccgaaagataaagatacaagtgcactggtgctgagtttccccaatgtgaacgttaaacagaaaacaatgtttctcagtttgaacggcatcgttttctgtttaacgtttgctacaccatttgcaaataattgcttacttactgcaaacaggctccctacggaggagactgaaggagcacgatgatatgacacaagattcacaggacatgacagtaacacaactgtctctacccaaagggggcggtgcgatcagtggtatgggtgacgccatcagtaatgcagggccggatgggatggcttcgctttctgtgcctttgcctatctctgccggtcgggggagcgcaccgaatttatccctgaactacagtagtggggcaggaaacgggccatttggtattggctggcaatccagtaccatggctatcagccgtcgtactcaacatggcgtaccgcaatatcacggtgaagatacttttttatgtccgatgggagaagtgatggcagttgccgtcaatccgagcgggcaacccgatgtacgtcagaccgataaactattaggcgggcaactgcctgttacttatactgttacgcgtcatcagcccagaaatattcagcatttcagcaaacttgaatactggcaatcgctaacggatgtggaaaccacgcctttttggttaatgtattcacctgatgggcaaattcacattttcggaaaaactgagcaggctcagatcgctaatccggcagagacgtcacagattgcccaatggctattggaagagaccgtaacaccaacgggagaacacatttattaccagtatcgggcagaagacgatatcggttgtgatgacagcgaaaaaaatgcccaccctaatgccagtgctcagcgttatctggctcaggtgaactacggtaatatcacacctgaatccagcctgcttgtgttgaagaatacgccacctgctgatcacgaatggctattccatttggtatttgattatggtgaacgaacgcaggaaataaacacggttcctcctttcaaagcaccttcaaacaactggagaatacgcccagaccgtttctcccgctttgaatatggttttgaagtacgaacccgccgcctgtgccaacaaattctgatgttccatcgcctgaaatctcttacaggagaacagattgacggagaagaaactcctgccttggttgcccgtctgcttctcagttatgacctgaacgacagcgtggcaaccctgactgccattcggcaaatggcgtatgaaacggacgcaaccttaattgctttaccgccactggagtttgactatcagcgctttgaggcaaaagtcacgcaaaaatggcaggaaatgcctcaattggctggattgaatgcccaacagccttaccaactcgtcgatctctatggtgaaggtatttccggcatcctgtatcaggatcggcctggggcatggtggtatcaggcccccatccgtcagaaaagtgttgaagatattaacgcggtaacctatagcccagtaaaacccttacctaagatccccagtcagcaggacagggcaacgttgatggatatcgacggtgatggacatctggattgggttatcactggcgcaggcattcagggacggcacagtatgcagccgaatggcgaatggacacactttattcccatttctgcactgccaacagaatattttcatccacaggcacaactggcggatctggtgggagccgggttatctgatttagcgctgattggtcccagaagtgtgcgtttgtatgccaacgaccggggaaactggaaagcgggtattaatgttatgccacctgatggtgtgaatttgccgacattcggcggtgatgccagcagtctggtcgcattttctgatatgttagggtcgggacagcagcatttggtagaaattgccgctcagagcgttaaatgctggccgaatctaggacatggccgttttggtgaagctattctgctgccggggtttagccaaccgagtggaatattcaatgctaaccaagtttttctggcagatctcgatggctccggcaccgccgatatcatctatgcacacagcaagtatctggaaatttatctgaacgaaagcggcaaccgttttagtgcacccgttcgacttgatttgccgaaaggggtgatgtttgataatacctgccagttacaggtgtcggatattcaaggattgggcgctgccagcattgtactgaccgtacctcatatggcaccgcgccattggcgttatgattttacttacaataaaccttggctgctcaatgtcatcaacaataattctggtgcagaaaccactttgttttatcgtagttccgcccaattctggctggatgaaaaaagtcagatcgaagaatcggggaaatttgcagcgagttatcttccttttcccatacatttgttgtggcgcaatgaggttcttgatgaaattaccggtaatcggctgactaagggcatgagttatgcccacggtgcatgggatggcagagaaagagaattctgcggatttggccgtgtaacgcaaattgataccgacgaatttgccaagggaaccacagagaaaacgccggatgaaaatatctatccttcccgtagcataagctggttttccacgggtctgcccgaagtggattctcaacttccggcagaatactggcgtggtgacgatcaggcatttgccggctttacaccgcgcttcactcgctatgaaaaagcggatgcagggcaagcggggcaggatatcccgattaaagaaccgaccgaaacagaagcgtattggcttaaccgcgccatgaaaggccaattactgcgcagtgaagtctatggtgatgacaaaacagaaaacgctaaaattccgtacaccgtcacagaagcccgttgtcaggtcagattaattcccagcaatgacgaagccgcgccgtcgtcttgggcatcgatcatcgaaaaccgcagttatcactatgagcgtatcgtcgtcgatccgagttgcaaacaacaggtcgtgctcaatgcggatgaatatggctttccgcaggcaaaagtggatatcgcctacccacggcgtaacaaaccgacacagaacccctatccggattcgttaccggatactctgttcgccgatagctatgacgaccagcaaaaacagttatatctgacaaaacagcagcagagctactaccacctgactcatcaggatgattgggtgctgggtctgacggatacccgatacagcgaagtttatcattatgcacaaactgacgctcaaagtgatattcccaaggcagggctgacattggaagacctgctgaaagttgacggcctgataggtaaagacaagacgtttagctatttagggcagcagcgagtagcttacgtgggtggagatgcagaaaaaccgacacgtcaggtgcgggtggcttatacagaaaccgcagcttttgatgacaacgcgctgcatgcctttgatggcgtgatgacttctgctgaactgacgcaacagttgctggcgggtgggtacctgtacgtaccgcaggtttctgatgcggcaggtagtagtggaaaggtatgggtagctcgacagggatataccgagtatggtgatgcttctcagttctaccggccactcacccagcgcaagagcttgctgaccggaaaatatacactcagttgggatactcactattgtgtggtggtaaaaaccgaagatggtgcgggaatgaccacgcaagcgaagtacgattaccgcttcctgcttccggcacaattgacagatatcaatgataatcagcatattgtgacattcaatgcattgggacaggtgacttccagccgtttctggggtacagaaaatggcaaaatgagtggttactctacgccggaaaataaaccgttcacagtgccagataccgtcgaaaaagcctttgctttgcaaccggcgatcccggtttcacagtgcaacatttatgtgccggatagctggatgcggcttctgccccaacagtctctgactggccggctaaaagagggggaaaccttgtggaacgtattatacagggcgggtgtagtgacggaagatggtttgctctgtgaactggcctgccgtcgttggctcaaccgtcagacaacgtcttcaatggcagccgtgacattacagcaaatcttggctcagactccacgacaacctccccatgccatgacgatcacgacagatcgttatgacagtgattctcagcagcaacttcggcagtcaatagcattgagtgatggttttggtcgtgtactgcaaagcgcgcagcgtcatgaagcaggaaaggcatggcagcgtgcagaagatggctctttggttgttgatagtaccggtaaacccgttgttgctgataccacaacgcgctgggcagtatctggtcgcacagaatacgatggtaaagggcagacgatcagagcttacctgccttattatctcaatgattggcgctatgtcagtgatgacagcgcacgggatgatctgtacgccgatacccatttttacgatcctctggggcgtgaatatcaggtaaaaaccgcgaaaggcttttggcgtgaaaacaggtttatgccgtggtttgtagtcaatgaagatgaaaatgacacggcagcacgtttaacatcttagcaactcgctcaaccttccctgttatatatgcggggaaggttcagacttcttttaacgtcaatgatgcgagtgccagtggtcggtaaatcgccagtatcggtcagcaaggtggctaactgcagtttcgttttggttaattcccgataagccttcataatcccacaggcaaatatttataaattgttgacagagaaacatgataaataagggaaagttgttttctggtatgccccttatccagcaatctggcggcctgctgccgatcttcttcggtaaatatcaccggccgcccaccaatgcgcccttgttcccgcgctgcggctaaccctgcattggttctttcaacaatcaactctcgctccatttccgccaatgcgctcatcacatgaaagaaaaaacgtcccatcgcggtactggtatcaatgctgtcggtcaggctctgaaaatgaattccgcggtcatgcagctctgaaatcaacgtcaccagattttttacactgcgtcccagacgatccaatttccagaccaccagcgtatcaccggattgcagatactttaaagcgcgtttcagccccggacgattggcggtttttccactgattttgtcttcaaaaatgcgctcgcagtcaatattgaccagcgcatttttttgcaaatcactattttggtcatttgttgacactctgatataaccgactcttgccactgataatccttcaatacccccaaaaccatttattatgcaaataatacctatttttttatataaaaaactattaattttcttgattgcgagataaaagttggttgatccaggtttggcatttgagttagtgatggataggtaattgtatccggaagatcaatacatcgttaccagagcgagtgacttaactcacaggatcaattttttcttaccaatgataaccaattgtcctcgcttattttcccaaaatgctctttatttaattgaaacaattttgttgccaatttgttatgcaagattatgggagtgtatatggaactgattacacaatggttaaatgcgataaacgggatagtatggggaatacctatgctggttggtattctgggcattggcatttttatgcaaatccgcctgtccttcttaccgatccgaaaattgggaacggggtttaagttactttttcagaaaaatgaacagcgtggtgaaggtcagatctctcctttcaatgccttgatgactgcattgtctgcaacaataggaacaggaaatattgccggtgtggcgacggctgtcgtaatgggcgggccgggagcattgttttggatgtggatgacggcattattgggtatggcaactaaatattctgaagccgtgttggcggtacgctttcgtgaaacagataaaaatggcaactacgttggcggccccatgtattacatcaaaaatggcttggggaaaaaatggatttggttgggaacactgttcgctttctttggcagcatagccggttttggcattggtaataccgtacaggccaactccgtggctgatgtactgcaaagcaactttggtattgaaaaaactgcgactgcgggcattctggtgattttggtcggagcggtactgattggtggtatcaaacgcatttctgatgtggccggcaagttggttcccgtcatgactgtcggctattttggtgccggcatcatcgtactggcactcaatatcaccgccatcccagaagcctttgtcttgatcattaaatctgcattcactcccgttgcagcacaaggtgggtttgccggtgcagcagtctgggcggcgatccgttttggtgttgcccgtggtgtattctccaatgaagctggtttgggtagtgctccgatagcccatgctgcggcaaaaacccaaaatcccatccgtcagggtttgattgctatgctggggacatttattgacaccatcatcgtctgttccgtcaccgggctgaccatcgttatcactggcggttggttgacaggggaaacaggggcaacgctgacagcctcctcattctctacggtgattccgggaggtaattacattgttgctgttgctctggctattttcgcctttactaccatcttgggatggagcttctacggtgaaaaatgtatccaatacttactggggccaaaagccattgtgcctttccgtattgcctggatcatagcactgccgattggtgccactcagtcgctgaactttgtctggttgctggcggatacactcaatgccatgatggcgatccccaacctgatagctcttgcgctgctaagccctatcgtgtatcgcttgaccagagaccatatccgtgacgttaacgccgatagcatcgaagttaaaacagcagccaaaacagattaatatcacctatattatcagtgataagtaacaccaatcacacgatgccggagcctcccaagctccggcatcgtgtgatcccccaaatacctctgcaaactttgcagtattcccgccattgaatttcttggtttttgtcatgcttaacacaattttatttgctctttcccaaaagcaatttttctgcatgcaataacgaacgctcaccaaggaaagtcgtggctgaagatagcgatctcgaaaaaaccgaagaacccacgccccataaacgggaaaaagcccgcaaagacgggcagattgcgcgttcaaaggaactgacttctatcctgatgctggtgggaggggtaagcctgctctggatgagcggaaattcgatcactcatgaactttcactgatggtttttgaagggtttaactttgaccataatatggtcagcaacgataagcagatgattcagcaggtcggtcgcttattgaaacaggcagtatgggcattgctgccagtattcgttggtctggttctggttgccctcagtgcaccgacattgatgggggggctgatattcagttcaaaatctatcaaatttgatttggctaagctgagcccgatctctggattgaagaagatcttctccatgaacgcactggcagaattgttcaaggccatattgaaagcctcgctggtcggtggtggaactgccctgtttatctggctgaattggccggctatgttgaacttgactgcccagcccccgctgatggcgttgagtgatgccatgatgatgctgatctttgctggctacattgtcttatttatgttgataccgatggtggcgtttgatgtgctctatcaaatccgcagccacttgaaaaagctgagaatgacccgtcaggagatcaaggatgaattcaaggagcaagaaggtgacccacatgtaaaggctcgcattcgtcaacaacaacgggcggctgcgcgtaagcgtatgatgagcgatgtgccgaaggctgatgttattgtgaccaacccgacccattatgctgttgccttgcagtatgacagcaaaaaaatgggtgccccaaaagtattggcaaaaggggcggggcttattgccttacgcatcaaagagattggtgcagaaaaccgaattccgttattggaagcgccaccactggcaagggcgttatttcgtcatgccgaagtggggggctttattcctgcgacgctttatgctgccgtcgctgaagtgcttgcctgggtttaccaattgaaacgttggaaacgagaaggtggcctgaaaccgaaaacacctgaaaatctgccggtgccatctgcactggattttgctggagaaaataatcgtcatggctaatctggcctcattacttcgtttaccggggaatataaaaggctcccagtggcaaatgcttgcggggcctgtactgatcctcatgattttgtcaatgatggtgctgccgttaccaccattcctgcttgatctgctattcacttttaatattgcactttccatcatggtcttgctggtagcgatgtttacccgtcggacactggattttgccgcatttccgactattctgctgttctcaacattactgcgcctgtcactgaacgttgcatctacacgtatcattctgatggaaggccatacgggttcagcggcagcgggacaagtggtggaagctttcggacactttttggttggtggtaatttcgcgattggtatcgtggttttcgttatcctgatcctgattaactttatggtcattaccaaaggtgcggggcgtattgcggaagtcggtgcgcgttttgtgctggatggcatgcccggtaaacagatggcgattgacgctgatttaaacgctggcttgattggtgaagatgacgccaaaaaacgccgcgccgaagtgacacaggaagcagacttttacggctcaatggatggtgcgagtaaattcgtgcgcggagatgccattgccggattgatgattctggtgattaacattatcggtggactgattgtcggtgttgcccagcataatatgaatctgggagatgcagcggaagcttataccctgctgactatcggtgacgggttggtagctcagttgcccgctctgattatttccacggcggcgggtgtgattgtgacccgagtggcgaccgatgaagatgtcggtcagcaaatggtgactcagcttttcaataacccacgggtgttgatgttgagtgcaggagtactgggcttgcttggtctggtgccgggaatgcctaatttagtttttctattattcacggcggcattggcgggtttaggatacttcctgctgcgcaaagataaaaatccgcttgcggcacagcacgaagagatgaaagccgtagaggaacagcaacaaaccgcagaagcctcatggtctgacgtacaactggaagatccactgggcatggaagtgggctatcgtttgatcccaatggtagatttccgccagaatggtgaactacttgggcgtatcagtggcatccgcaaaaaatttgcgcaagaagtgggctatttgccaccggtggtgcatatttgcgataacctggagttggcgcctgccagctaccgtattttgatgaaaggggtcgaaattggccgtggtgaagctcacccaggacgctggctggcaattaaccctggtggcgcagttggcgagttacagggagatttgacgcaagatcctgcttttggtctgtctgcggtctggattgatgattccctgcgagaacaggcgcaggtacagggttataccgttgttgcggccagtaccgttgttgcgactcacctgaaccacctgctatctcaacattccagcgaactgtttggaagacaggaagcacagcaactgtttgagcgtgtcagccaggaaatgccgaaactgacggaagatttcatacctgacgtggtgagtttgaccaccttgcacaaagtattgcagaacttgttggcagagcaggtgccgatcagggatatgcgtaccattatcgaaacactggctgagcatgcgccaacacaagctgatccttatgaattaaccgccacgattcgaattgcgcttggcagagccattgcccagcaatggttccccggggcggatgaaatcaaagttattgggttggatgcaggccttgaacgcctgttacttcaggcattgcaaagcggcggagggctggagcctggtttggccgaaagcctcgaacggcaggcggcagaagcgctggagcgtcaggaaatgttgggtgcaccgcctgtactgttggtcaatcatgcactgcgtccgctgctgtctcgtttcctgcgccgcatattgccgagattggttgtgttgtctaaccttgaaatcaccgataaccgtcagatcagaatgacggcaacgattggtggagcaagataaacattaatagcatgatgacaaacctcacacaaacggtgaggtatgtcaggatttttccgataccattactgacagtgtcattaaatatggcaatttagtttcttttctttttagtcaggtgcttaagcccgatgtaatctgatgagattgacgctatgtgggacgtccatcttatcagatcagggctgagctaatatatgagactctgtttttcggcctaaaaagcggttccagatatcgaatttttactattcgtagagtacaaagtcttttttttataccgcttagcatatattttcatcttgttgcaactctcggttatggaggggttttttctaaattagattcacttacacagtgtatttagctaagtctttaggggttattttctttgacacatggtctttattaatagataaaactatttttccatgtaatccatccaaaggattatcacctattttttttaccgtcaaaattgcagctctatttttaactccggaaaaaatagagtcatcttcatttttaagcctattaatatctcttggagaatacatatcattaatcatgacttctttagaaatattctcagggaaatagagttggcctacaaagtagaatttatcttcctgtcttttttgtacattcgcactccttgctgataaatggatatgtatagctcttccagcataaaatccagggaaaattgtggtgaatctgactatgccttctttatctgttctttgtgccccacgaagaaatatgctttcatccgttcttgaaatcgtcccgatatcactagatggagcctcgaggtctggattaatatatttccaacctgaatatttccccattgaattacaatgccatatatcaataaggatatcatctaaaggtttacaggttacagaatcaatgattttcattgtcaataacaaaggtattccttgttcatcctctgtgatattccttctcagcagtttgttatttataaaatatgggcctgacatttcctctggagtcaactcgcaaacaccgatgccaataccatctcctttttctggttgactaggtgaagaggcgaaggctcctgctggaagcagaggtaataatgaaaatattgcaccagtaacactagcctgtttcagaaaatgtcttctttcatttttcataaagtggttccttatattccatttaataatattatttgttgtataattttagctttattttaacagatgaaaatggcgtaagttcacgatgaatcgtattgtgtaaagtaagaagatttaatcttattttatgttaaagttaaataaaataaattctctatttaattttttattatttttaataagatggatttattattatcagaaatatttatcagtgtctagtatttatttttaaatggtttttattttcgagataagtcacaaaaaaccgttatttataattttatgttgtttttttattataatatttatatcaattattattagtgttcctaaattgaagttattaattactatgaaatcttctaatttacgatttttgatatggggatcatttttctgatgataaatattgatagaagtgctcaaacgattgatgcagataaggggcttgaaaaaagaatttatatgctaaaacggataatgagagcgcatgtctgcggatgaagtttttgaacaaaatagctggattaaagggacggagaatttattgactggcaagagcatgggaactttccgcgtttttatctgaagccgcatttgcagtaaaaaaactgacgaaaaaacttaaccgagagaaaacatcagacacttcgaaaatacaggtaaataaatggaatggtgtgatactttaatatctgggtggcaatgcttttattccgtttctgcgtagataaaagaaaataataaactaaaacagatgatgtttttaattgccttttttatactccccctaaaatagattcattaacgaactcagcgatatcttttaacagatttactttcaaattttcacaatgaatttttttaatgttaatttatcttatcctgtctgcttttatatggttaatgagtgatgatttaaaaaattatatttatatgctatccattttatggcaccgcacttcatagctgccacgaacgaagttatttgtatgtaattccaacggatagaatttgtacgtaaacaataagttttgctgaaaatagcctcattttatacaaataattaatttattaaccaagaatccgaagattagctccagcgatcaattaattaatatcaataggaaattcctatcaattataattaattgatcgttaataacaattttaataacaaaatgagttggtgtatctttctccagccactaaagtggaattttttaattaaggcgtgttaaaactaatgccgttaatcaaatatgcgagatgttataggtatggaaacccgacatggatagttgtttaaggttgattattttttataaaacatatggatagagttattttaaccacctcaccaattgacacatcatttatacgtaataggcataagtcatcaggtcaagctcaggattcctgaccagatgtttagaggattacaaaaattgtttgtgcgtataaaagcagctctcattagtttttaaggtaagttgccttgaatcttgggaatatatatttgcaacgtgtaaaacagtataaccaagctgggcatctatacggttatctgaaaggttgctgatatatttctacctattttgagtagtccaatattacgcttttcggcatcatgtgcactattgaagagcctcttgtgtattaatagactctagtaaggaatatcattctttattagcaggaacatacccttagttttgttcttaaaaacacaattatcatttattaaaatttattgaattttcttaaccgaaaataggtatttttatttcgctcgagggaatttttatgtttgtaattaaaggaataaaaatgaaattattaaaattatttatcgcagcagttatttctggatctatggctgcaccggcattcgctgctgatggcacaattaactttaacggtaggattactaaggcgacatgtactgtcagtgccttaacggataatagtgtcaatttacctgaagtaggcgcgactgcccttgcaggaaaaggtacaaccgggggagaaactctctttagaattggtctggagaactgcgggatagtgggtggttcggctaatgtgcaggtgaagtttggcggtgttaaagatagtatcgatggcaatctgctgagaattaactctgagagtggtggagcgaagggtgttggcattggtatttatgagaaagatggtagtacgccaattaatatgggggcgcttagcaaagggattccggtagtttcacccgcaactacacttgaatttaaggctaaatatgtggctacagaagcaactgtcacgcccggtacagtgaaagcttctacggactttacactagactacgagtaattccttacattccccatttactgtttttttattgcttttgtgatatctccaccgtattcggtggggatgtctctcatttttagtttgtgtagggatattgttatgttaaaacgttttttgttcgggttgctattgtccctgccggttgtctttgccgcacccgtccatgccggaatagcgctcagtagtacccgggtgatctatgaagcatctcaacgtgaagcgactatttccgtaatcaacgacagtaaggagcatgtttaccttattcagtcttgggtagatacctttacaacaacgaccgaactatctgatcgcaaagcgccatttttagtgacaccacccttattccgtctggatggcgagcaagaaaaccgtctgcgaattatcctgacagatgactctttgcctcgggatcgtgaatctgtcttctggttgaacgttaaagcgattcctgcggtggaaaaaaacgatgcaaaccgcctgctgatatcggtgaaaaaccggataaagctcttttatcggccagccggactgacagaacaactggcggataatgcctatcaaaaattgactttttcccgccagaatgggcaattagtggtgcagaatccaaccccttttcatatctctttccacaacattacggtcgggaataatccagtaccggaagccggtatggtcgccccgttcagccgccgtcaatggcctttacccgcaggttccggtaataccgtgacttggtgggctatcaatgattttggcggcaccactgagccacagcatcaaacattatcatcctcgtaataaccgataattcagaagatattttatgttatgagtttgattactccttctatccgtgcgcagttaatattgctgctgttggccgggttcctgcctgtcgctgggtatgccagtgactattttgatctcgatgctctggaaattcatgacccgtctgcgccgccgcctgatttgagctattttgcagagaaagggggtagtgcaccggggacataccatgttgatatccgtgttaatggccagaataaaggtgcacaggatatccagtttgtgctgggcgccgggagaaaacttcaacccgacttatcggttcaacaactggccgactggggagtcaatgttgcggctttcccggtcttgaactcaaaaatgcaggtcactgacctggctgacattatcccttatgccagcacctcattacagcttggtcaacaaacgctaattatcagtattcctcaggcggcgatgacggctgaagcgcgcggtgcgattgattcatcactttggcaacagggtgaatcggcgctatggatgaattacgattttaacggtgctgaaactcgcagtaagagcggctctaaaaccaacagtatctatatgaatctgcgtagtggattaaactgggacgcctggcgcttacggaattattctacttaccaccgagtcagtagcggtgagtcacgttgggaaaaccttaacacgtatcttcaacgtgatgttcatctgctaaaaagccagttggtgataggtgaaaccaatacacgtggagagctgtttagcggatttgctttccgcggtattaccctgatgtctgatgataatatgttaccggacagtcagcggggattcgccccgatagtgcggggaatagcggaaagcaatgcacaggttaccattcgtcagaacggattcatgatttatcaggcttatgttccgcccggggctttcgtgattgatgacctttatcctgcctcctcaggaggagacctgaatgtgactattcaggaagcggacggccgtgaacggcactttgttcagcccttttcgtcggttcctattatgttacgggaaggtgggttcaaatacagtctgacggcgggagaataccgcacttcgcacgaacagattcggcagccgctctttatgcagagtgaagtttattatggcctgccacatgccacaactgtgtatggcggtacgttattgtctccgaactatcaggcctatgtcgttggtgtcggatacagtcttggccgttggggttctttgtcttttgatatcacgcggtcacaggctgatattatcaatgaaggtcaacaacacggccgggtttaccggtcgcagtataccaaagacttcgagcagacggggactcgcttgtcgctgaccagttaccattactcttcaccacacttttatgattttcaggacgttaataaccgggctgcacatgatgagctgtcatatcaacgtaaacataaatttcagcttaatctgagtcaaaacttgtcggattatggcagcatctatgtttccggctatttgcaggatgattggggaagccgtagtacgacccggagtttaaatgtcgggtacagtgtgaattatgccgatatcaattataccctgaactacacccaaaatatgagttcaggtaactcaacagccgataaccaactggcattcaatatacaggttccgctcgaccgctggctgccgaacagttgggctacctatagtctcaatcataatcgccaaggagatatgaaccaatcagctggactgagtggtacggctctggatggcaatgttctgggttactctctacagcagcgttacggtaataacggtcagaattccagtgggaatattaatctcaactataaagcccgttatggggagctgtccggtggatataactataacaatagctcgcagcagattaactacggactcagggggggattggtcgctcatcgtcatggcataactttgtctcaatcattgggtgagacgattgtcttggtcaaaactcccggagcagcaggggttaaggttaacggctataacggggttgaaacggatggacgaggccatgcagtattgccctatgtcagtccttatcaccataaccgtattgctttgtcaccggattcttttggcgatggcgtggaaattgagtccaatatccagactgtcattccgacacagggagcgatggtcgtggctgatttccgaacacggatcggccaccgagtgctgtttactctgacccatctggataaaccgattccttttggcgcaatagctaccctgaatgaagaaaatacaatcagctttcttactgaaaatcagagcattgttggcaatggaggagaaatttatttcggtggtgtgccggagcgggggcagttatctgttcaatggggtaatggtcagtttgaacagtgtaaagcgcgttttattttgccaaaaagtgaagcggcggtgatttcgatgaaggcagattgtcagttatgacgggaagtcatcctatttctgctttaagcatgacggcaccacaataatttatagactcgatataaggaatgattgatgaaggtattcgtttatccgtggttattgttagcctcggtgtttttttcctccggtaaggtttatgccgattgttccgggggcagtggaatcatatcgactgttgcggtgtccattccgcaacatatatcgagggatgaaatataccgtagcttaaattcccagtctcgggcaagtatggcgataacttgcacaaatatgccgataagagccactcacataacagtcggcataaaagcctatggggacgattcggggatgacttccatctcccgtaaaattttcaaactgggtgacagtggtattggatatgtcgtcattggcgtggatgatacgcacgatgagaaaccggtaacaacaaccgcggatcgtttttggggcgggaatgccagagagctatataccactgagataaggtctgatagcactatcaacctgaatgccgcactcagactcgaattttacaaaattggcccgataaagccgggtcgttattcccagtcagtagccgcagctattgtagcaccgcgcggatccagaatacccagtgtgactcaagaattccgattcaccacgggtatgataacgattaacgctccaacctgttccgtcgataacagcacaattcctgtaacattaggccggataacgacaatgcaattaccttatgtgggttcaacggcagcggaaacactatttaatatacctttgacctgtgaacccaaagccaacgtttttatgaccttagaggcaggtcgtcaaggggcttataatctgatgcaaggtattatcgagcttaaacgtgggcttaatgagagagccagggatggtgttggtgtgcagattttagatggtaaaacgaatagacccattcacctcggtgaaaaaaaatactatacaaccacaggaatgggcgggcctgtaaacatacctttaaaagcacgttactatcggtatggtgacgttagagcaggggttgccaatgcaacagcgacattcacaatgagttatgagtgatgaagagtgaaagtctggaatcgataggtgattatctgaacagagaaaaatgatggctggggacgttagcagctaaaacagaccctttatttcactgataaataaagaggtctgtacatatgacgacttaaagtcgcaccactcaaaatcaaacactgatcttgtgaccagacagtgctgtgttgtgatgggcttgcccatcagcaccataaagagaagggctgtggtgacttttcaagaaagcaatcgcctggctgttcaactcaatatgctgatccagtaaaaacccattatgtacattgagatcacggatacgttcaacagtttggctgatttgatcccataatatcgccagtatttcatgactagaatagggtgcgctcactttcagcgtttcatttaattgctggcgtcttcgttcagcatgatcgagtgccgagagaaagaatgtcttttgttcggtgactcgatgtaaatgattcgcttcaataaagccttcgctcaatatgcgttgttcttctgccatagtgttcgaaagcgaatttaagtgtacgttttgctgctcaagcaagagttgaatttcttccatttatggctctttatgattttgatggtttatttatcatattccatgttttcaagggcttctctgaacaaagcatcagcgattttaccgctgtccatggtcagcgttcctttcgcaatggcttctttcaattgttgtactttctggatattaatatcttggctacttggctgaacgagctttttctgcgcctcgctcagcttaacttgcgtatcggcgcttttttctgcgacagccacagttctgcgagtgctctgggcaccttcattggcattgcgctgctgcacagcagcaatagccagtagaggttgagtgcattcaatactcataattgtaatcctttaatcaggcattaatttgtcttaggtagcaggcgatataccgctggcatgcctgtaaatcatggtctgttggttatatcggcttgaaagaataaaactttagccatttataacatcatttttacactgccattttcctgagtttctccggtaatcacctgtccagaagccaggcggacacggatattatcaaaacttgcggcgttgttaattgctttcccttcgtagcgtacctgaaaatgatgcccatctacgatgacgacgacattttgtccggcgcgaatcgcccacgggcgtcggatcatgttacgagtgatgaattgtccggcagggatgttgcgaatggcaataccattttgtatgacctttctgttacggattatgtcatttggcaacttatccaaagcccctgtttttacctgaaaatctttttctgtcagcacagtattacgctgaattgcgcggttagacatcagataggaacctgtaacaccgacgtatacctgaataaaacggcgctgttggccacaggtgacgggaatggacagactaccccagtttctgttgctcagtgacggctgtatttcaggaaattcacataccggccattgctgctcaggcgttttaattttcacggtgactttttgatccgcgttgtggtgaagctgagtgaaataattattgattgattgcggtaaattgcccgctaatgccaaagtactatgcaaaaaactgctaaggaaaaaggtaataaacccgataaattttaatgcaggcattttcaccaccctgaccctgtttgagaaccatgatttcaaaaaatattcagtacctgttggatgttaatagtgtaacgcggttgattattcgttaatgggataaatagcaattcaatttgtgtctattcatcgaatcagctttttcttctgagtttattctgttagctgcttagagcttaatacatgggctttaatgagttacaaggcttgccctgcataacagaccagagggagaaatatgctcgataaattagatgctgcctttcattttcgacaagaagcgctggcactccgcaaccagcggcaggaaattctgtctgcaaatatcgctaatgcggatacccccggctatcaggcgcgtgatatcgattttgctgctcaactgaaacaagtaatggcagagggtcgtgtgacgggaaatggaatgaagctgcgtctggcttccgatcggcatatccccgctcagtctcagaatcgtttggaaatggatctgctctatcgggtgccttaccagacggcaatggatgggaataccgttgacatggatgtagaacgcagccatttcgcagataacagcctgaaatatcaggctgaacttacgatgacgaattcgcagcttaaaagcatgatgtcagttctacagtcacaaggataataaaaatgtctttactcagtatttttgatattgctagctccgcactttctgctcagtcccagcgactgaacgtcagcgccagcaatatggcgaatgccgatagcgttgtagggcctgatggcgagccttaccgtgctaaacaagtcgtcttccgcgttgcggctccggcagggcaggagatcggtggcgtgcgtgtcagtgaagttgtggatgatcccactcctttccgccttgaataccggccgggcaatccactggcggatgaaaaaggttatgtccgtatgccaaatgtggatgtcgtcggggaaatggtcaataccatctctgcttcccgcagttatcaggcaaacattgaagtgcttaacaccaccaaatccatcatgttgaaaacgttgactctgggtcagtaacaggaattccattatggcggttacctcttcaatcaatgactcattagataattcaacggtaggcgaactcgccaccctgaacaaacaacaaccacaaaaaagtggtgatatcaaagataacttcttgaatttattggttgctcaacttaagaaccaagatcccaccaacccaatgcaaaacaatgaattgacgacacagcttgcgcagatcagcaccgttcagggtgttgaaaagctcaataaaacgctgggcgctgtggttgggcagatggaaggcaatcaggcgatgcaaacaacaatgctgattggccgaacggttatgatccctggcgataagattttagtcggttccggtgaagaaaacggtattagcacatcgccattcggtttcgaactgacccgacccgctgataacatcaaaattaccattagagataaagagggtgttgtcgttagggaagtggaggctgaaaaagtgaatgtcggtgtacataaagttcagtgggatggtaaagacgcagacggtaaggaagtgataaacggtgcctataatttcactgtttccgcaagctatcaagatcaggcgttggtgacacttccgctgacctctgctgaggttaacggcgtcacacggggtgaggatggcactaaattagatttagggctggcgggtacggtaaccatggaccaagtacgtcagattctttagttaaacggaggacatatggctttttcacaagcggtcagtggcttgaatgccgcagcaagtaacttagacgttatcggtaataatatcgcgaactcggcgacatttggctttaaatccagttcagccgcctttgcggatgtattcagcggttcagatgtggggctgggggtgaaagtttctggcatggttaagaactttaaggatggttcaaccaccactacaagccgtcagctggacatggcgatcactcagggcggttttttccgcatgctggattccaacggcagtactttctattcccgtaatggtcagttcaacatggactcagaccgtaacctgatcaacatgcaaggcatgaagttgaccggttatccggcggtacaaggggcaaatgggcctgaaattcaaaagggtgcggcaccggggccgatttcgattccaagggatatgctggatgccaaggcgacgacgaacgtcacgatgacggctaacctgaattcgatgaataagaaagtcgatattaacccatttaatccatcaaacaaagacagctttaactatagctctggtctctcggtatacgatagcctgggtaatgagcacaatatcaatgtgttctttgttaaaacgaacgacaatgagtgggatatttatgctcaagatacctctgtgccaggttcagatcaccaaaagctgaatgataagaaagtagtcgaaaaagaaggtgaaagtaaaagcgttctatttagtggtaatggcaagattataggtaataacaacgcatttgctttcgatatgcctgggttaaatggttccattggtgctccaatcaccatagatttcaacaacagcaaacagcagagcatttcacaggattctatctccaaccagcagcagaatggctatgccgcagggagttttactaactaccgcgtggatagtgatggcaaaattcatggtctctattctaaccagcaaacacaggtgttaggtcaggtcgtactggcaaacttctctaacccggaaggtttggctgcacagggtgataacgtttgggtagaaacaggtgcatccggtagcccaatagtaggaactgcgggatcaggtaactttggtaagctgatcagtggtgcactggaagcgtcaaacgtggacatgagccaggagctggtcaatatgatcgtcgcccagcgtaactatcaatccaacgctcagaccatcaagacacaggatcagatcctacaaacactggttagcatgcgttaataagctcaggcggatagttttatggatcacgtcatttataccgcgatgggtgctgcgcgccaaacgctggaacatcaggccgtcacagccaacaatctggccaatgcttcgacaccgggtttcaaagcccagcttgccgcactgcgttctgtgcccattgaaggcgaaactctgccgacccgcacattgaccgttgcttccacccccggcatggatagccgtcaggggcccatgaattatacttcccgcccgttggacgtggctgtcggacaaggtggctttctggctgtccaactcgacgatgggacagaagcttatacccgcaacggtggtatccagatgtcaccagaagggcaattgatggtgcaggggcgtatgttgatgggcgaaaacgggccgatcgatgttccgccacaggctgaacttactattgcggcagatggtgccatttctgccttgattgccagcgatcctccgacactgctggggcagattggtaagctgaaaatcgttaaaccggaagcgggccaagtggtgcggggcgatgatggcctgtttcatttaacgccacaggcgcgggaacagcagggcaatgaactggcagccagcacggaagtaaaaatcatgccgggtgtactggagggcagtaatgtcaatccggtggaaagcatggtgaacatgattgccaatgcgcgtcgttttgaaatgcagatgaaagtcatacacagttccgatgagaatgcccaacgggctaaccaaattctcgccatgagctgaatcgggaacaggggataaattcatgatccgatctttatggattgccaaaactgggctggatgctcagcaaacaaatatggatgttattgccaacaacttggcaaacgtcagtaccaatggttttaaacgccagcgcgcggtttttgaagatttactctatcagaccgaacgccagcccggcgcgatgtcgtctgaacaaaccaatctgccatctggcttacagattggtacaggagttcgtccggtggcgacagagcggctgcacagtcagggtaacttggcacagaccaacaacagcaatgatgtggcaatcaaaggacagggatttttccagatccagatgcctgatggcacaaccggttatacccgtgatggttcatttcagaaggatcaaaacgggcaattggttactgcgggtggttttcaggttgtgcctgccatcatcattccagacaatgccaccaaaatgagcattgcccgtgatgggattgtgagtatcaacgtgcaggggcaaaacgcacctcagcaggttggtcaactgacgctgaccacttttattaacgaaagtggcctggaaagcatcggtgagaacttgtatctggaaaccaacagttccggtgtccctgtagaaaatgcaccgggaatcaatggggctggtctgctctatcagggctatgttgaaacgtccaatgtcaacgtggcggaagaactggtcaatatgattcaggttcagcgagcctacgaaatcaacagtaaagccgtatcgacttctgaccagatgctgcaaaaactgacccagttataacctatacccaatagatttcccgttgcagccagcaaagcagcaacgggaaaatgaaaggtataattattaatcaggatagtcggggaggaaattctccggctatttccgcgataaatttaagagcatctaagatggatacaatgcccgttgccgagaacaacgtagcttatgactctcccggtttacggaaaaaccggggatataagtggcgcatcagcatggctctggcggtactgtcactggcgggctgtgcctatatgccgcacaaaccgctggtgaaaggagcgacaaccgcaaaccccgccgaagcccctgctccaacaccaaatggttctatttttcaggtttcccagccggtttattacggttatcagccgttgtttgaagaccgccgtccccgcaatatcggtgatacgctgaccattattctgcaagaaaatgtcagtgccagcaaaaactcctcagccaacgccagtcgcagtggaaaaaccggtttcacggctgctctgaccccccgtttcttaaagggattgatgggcggcgacaaaacggatttgagtatggaaggcgatagtgaatttgggggcaaagggggagccaatgccaacaataccttcaggggcacgattaccgtgactgttgataggttgctggccaatggcaacttacatgctgtgggggaaaaacagatcgccatcaatcagggaacggaattcattcgcttctctggcgttgtgaacccgcgcaccattaccggcaccaatacggtgagctccaatcaagtagcagacgcccgcattgagtatgttggtgatggttatatcaacgaggcacagacaatgggttggttgcaacgtttctttatgaatatctcaccgttttaaaagaggatggtcaggatggaaaaattagtcgccagcctttttacacttttactggcattatccagcatattcgtgtctggcaccgcttcggcagagcgcattcgtgatttggtcaccattgagggcgttagggataacgcattgattggctatggtttagtggtcgggctggatgggacgggcgatcagaccatgcaaactccttttaccacccaaagtctgagcaatatgttatcgcagttggggatcactgtgccgcccggtacgaatatgcagcttaaaaacgtggctgctgtgatggtgacagccaaactgcctccttttgcgcgttcagggcaaaatatcgatgttgtggtttcctcattgggtaatgccaagagtctgcggggaggaacattgctgatgacgcccctgaaagggattgataatcaagtgtatgcgctggcacagggtaatattctggtcggtggggcaggtgtcagtgccggtggtaacagtatcaaaattaatcagcttgcgggtgggcgtatttccaatggtgcggtgattgagcgggagttgccgacccagtttggtcagaaaggaacgctgaacctgcaactgaataatgatgattttagtctggccgagcaaatcagtgatgcagtcaatcgcctgcaaggaaaaggaacggcaacgccgctggattcccgcacggtacaattgcgtttaccgagagaaaacagtgaacaggtaaggttcctgtctcaaattcagaacctgaatattcgcgtggatgcgggtgatgccaaagtgattttcaattcccgcacgggatcggttgtgatgaaccgcaatgttacgctggatagctgcgccattgcacatggcagcctgtctgtcactgttgaacgtcagacggcggttaatcagcctaataccccattagcggggggcaacaccgtagtgacccgtaatacgggggtcggaattcaggaacagggcggtgcattgcaacaagttaatgccagtgccaatctcacacaggttgtccgtgcattgaatgtcctgggcgcgacaccgacagatttaatgtccattttgcaggcgatggaaacagcgggttgtttgcgggcgaaactggagatcatctgatgagtgattttttgacaacgcctactgcggcttacgacgtcaattcgctgcattcactgaaagctaaattgtcacaggaaccacaacaagggctacgtcaggtagcccaggaacttgaaggcgttttcgttcagatgatgctgaaaagtatgcgttcctcgttgccacaagatggcatattgagcagtgatcagacccgtttttatacgtcgatgtacgatcagcagattgcccaggatctttcccaaaaggggctgggttttgccgacatgatcgtcaagcaattttccaacgcgaacaacgttgccagcgaacaggccggaacggtaccgatgccgctggataaagaattcctgcaaacattgccgaagcaggcactggaacagtttatgcgccgtaccatgacggcgccgttttcttcggcggcttccaagggttccgtgcaatcgaagtcattgccagttagcagtactgactttgtttccatgctctccctgcctgcgcagatagcgagccagcaaagcggtatccctcatttgttgatcattgcacaggcggcgctggaatccggctggggacagcgggaaattctgacagaggaaggcaaaccgagccataacctgtttggcatcaaggccggcaagcattggaaaggggcggtcaccaacatcatgacaacggagtacattgagggtgaaccgaagaagatgcacgacagtttccgggtttatggctcttaccgggaagcaataacggattacgtcaaactgctgacggaaaatccgcgttacgctaaggtcgcgcaatcaacgacggcagagcagggcgcatattctttacagagtgcgggatatgccaccgacccgggctacgccaaaaaactggtgtcactgatccagcagttaaagagtaccggaaatcaaatggtaaaagcctataccgatgatttcgacaacctgttttaatcgaacagattaacgccgtttttgttcaaggatcagagaatattgccgataactgtagcagtgaattacctcccatgacggaggcataacgaaaacgtaaaaggatctacacatgtctaatagtcttatgaatactgccatgagtggtattaatgctgcgcaggtggcgatgggtgtagtgggtaataacattgccaactccaagaatgtgggctataaccgacagacaaccgtgctgacacagaataacggaaccctgtcaccggcgggttttattggcaatggtgtggctgtcagttcgattaaccgcgaatatagcgagttcatcaaccagcaacatagctctgcacaaaccaaacatgctgctctgaccgcttacaaccagcaaatcaccaaaattaatgatctgttggccgataaggacaccagcctttctaattccatcgaagagtttttcaaaagtctgggtgcggctgaaagtaatgcggaagacagtgcggcaagaacgacggttctgggtaaagccgaaggattggtgagtcgattcaaagaagcggatgaatttctgcgtcagatagataacagcatcaattctcaaattgagcagaatgccagagaaatcaataaatacgccgaagaagttgccacgctgaacaatgaaattacgcgtatgcgcggtacgggtacgggcgaaccactggctttactggataaacgtgacgaagcggtcaacaaattaaaccagcttgttgacgtgaatgtaactcagcaggatgggggcgtttataacgtctcattcggtggtggcatgtcactggtatcgggcagtaaatcctatcggctggaagcgatctcatccagcactgacagcagtcgtatcacgctgggctataacaacggcaccgtgggaacgaaagaaattgacgagcgctttatctcacaaggcacattgggtggtgcattgcaggtacgcagggaagttgtagattcaagtcgcaatcaattgaaccaattggctctggtaatggctgatcagtttaatcaggtgcaaaacggcggttttgatctgaaaggcaagccgggtgtcgatttctttaacttcaccaagccggatgttatttccaacagcaataacaaaggaacggctgatattaaggtggaatatgcagataccaccaaagtgaaaaatagtgactataccctcaaatatgaaggcggagattggaaagtacagcgcgtttctgacaaggcagcggttcctgttaccaagaatggcaatgcgctggaatttgatggactgaaagttgaaatcgatgctgctcattctcaggatcacgatacctacacgctaaaaaccgtcagtaacgtagtggcaacactggaagtgaatctccaagattcttctcaactggcgactgcgggtgataaagatgccggcccaagtgataaccgcaacgcgaagaaatttcttgccttgcaggatcagcgtctgattgatggcaagtcttcttttgcgggggcttatgcgtcactggttagtcaagtggggagtaaggccaatgaagctcaggtcagtgtcgaaacacaggggcatatcgttgacaaactctatgcgacccgcgaatcgatttctggcgtcaatatggacgaagaatatggcgccatgcaacgcttgcagcagtactatctggcaaacgcccgtgtgatccagacagcggcgaccttgttcgatgctattttgggcattcgctaattaccgcccggttgataataaaaaggacgtgatattgtgcgtgtaagtacgaatctattatacagtcaaaaaatggatgggattttgggcgcccaatccaaatggatgcgctatggtgagcaactgtccacggggaaacgggttattaacccgtcagatgatcccttagcggcttcacagagcatcatggtttctcagtctgaatcgaaaaaccagcagtttatgacagcgcgtatttttgccagaaattccatgtcagctcagttaagcatcacctcaaatatcgtttcggttgcgaccaatgtttttgagactttggtggcggcagcggatgagcagagtgatcaggatcgtgaatcctatgcgcagcagttggagggttttaaacaacaattgctgaacctcggtaataaaacggatggtaatggccgttatatctttgggggttacaaaaccgacgttccaccgttcaaagcggatgagtctgggaaaattcactataaaggcggacatgaagaaattacccagcaagttgatgataaccgctcgatgatcattgctcatacggggaagcaggtttttttatcgacaacaaccaatccgattaaagaacccggtggtggcactggagaggcagatgtttttgctaccctcgatctggcaatcaaggcgttgagaacgccatacagtacagccagtgagtcggaaaaaaatgatgctatggagctgatcaataaagccaaccgtggtatccgcaatagtctggacaacttttcttcggtagaagccgttctcggtcttcagcttcaggaactggaacaactggattcgctgggcagtgagcgcagcatatccaataaagtccgtacaggggaattggtggacgtggattgggcatcgtccatttccagctattatcagcagcaggctgccctgcaagcttcttataaagctttcactgacttaaaaggtttgtctctatttgagatgtatcgctaagtcagcttggtataaattttttcttttcagtcccttacctgtttctctgcaacatggggaaatgggtattggatgctctttggtcggtttattgcttgtccattggtgacgtattaatgcacttaatcttcctttggtacttcttctctcgcattcaacccgtaatcacgaatcatatacaggatcttaagcaataacgcgttattttaggtagaaaaaaggcttcatttatgatctgataatcgtcgccaaactcatatcaaaaccacggatgaagcctgtgacgattatcgctataaaacaccagttaatgcaattcttcagtgacatttctttgcaacatattgctttccaatgtgcgtttatgaaacgcatcagaaatatcgagccccacgtgttgatcctcagccttatcgctgcactgagcacgggtaaaatcacgtctattgcccagttacaccaaaaatttaatggcctgtgcccggataaaaagcaaccagtcagttaccgccccttttataaccagctccgtaaagcggcttttgtcgaatttgtcaaaatattggtcagatttgccatggcgcaatgggtggagaaacaggtctcctcaccccaaaagctcatgaaatttaaacaggttattctccaagatgggagttcgttcaaagtccattctgccctggccgatgtttttccctatcgtttcaggacaacgggggccgcggtggaatgtcacatgacaatgtccttgctgactcagtcaccggtaaaaatgaccgtgaccgcagataccgcccctgagcgggcttacctgcctgtaccggcgatgttacgtgaccaattattattggccgatgccggttatgtcgactttgcgtattttgagcaagtgtcactttccggtggttcgtttattgtcaggggaagcaagtcccttaatcctcagatagtggtggcccgcaatggtcaggggaaattattgcccaagctgctcaataagccgctgaaatccatcactcgccgaaccaaccgttccgaagggcagtgtcgcgttaacggcggcaagttagcaaaagtggtgttgccggttatttaggccgccagcaaatagaattgttccgcgggtgataatccatcactttgtggatgttgatattgccctttgcgtatcatgtgaatcagttcgatgccggccaggagcgtctgtgcccggcgaaacgatttgaaccccagcatctgtcgtatccgacgtttgatattgcggtgatcttgctcaaccagattattcaggtatttattttgccggatttcaatcccctgctgaggcgatccttccgcattgaggagagtgagcgcggcagtattggccccacttttatcgatagtcacgacggcgggtctgccgtgctggcgtatcgctttacggaaaaaacgctgggcagccattgcatcgcggcgagcggtcagcaggaagtcaaccgtctgaccgtcggtatcgaccgcccggtaaaggtatttccactgacctttcactttgatatacgtttcatccattcgccaccgggagccaccgggagccaacgggctttttgcgaggtcggaaagccttgccgagcaggggcaccagacgtaacacccaacgatgtattgtggcatggtcgacctcaatgccgcgctctgccatcatctcttcgagattgcgcagactcaaggcataagcgaggtaccaacggacacattgggccatgatatcgacaggataatggaggcgtttaaacgcgtttcggatcagggacatcactctggactcgctcaaaaacaggggagcttacctgatgaccgcttaatgcgacagaaccgccagacgagtatgtagtgagagcagttcctgttcccagatgttggtcggtgagtgcattgaacacctcccgtattttcagtaaaaaatgtcagggactatcatgccacaatggggcgtacggctgtagtactagggaggtttccacctctactgacaagtactgactcatttatccttccgaccaaatccgtgaggttttacctatccgaaccaaaccgtagaccttgggttgttcgcgtaatccaatttctgccatagcccagtaacaaagtgctcaatctgcgggctggacaacatggtcatgtgattaccgggtacatgcatcgtgctgagttgagcggcgtgtgtactccacagagcttcgcgggtttttgtttcctccacatctccctcttctgcgctgatcagatgaacaagaccctcatagcgggcacgaggtgtatagcaagtgttcagattggcctgcatgacgcggacgacaccttgcagcagtgatattggtgttttggccagaaagagacctgcgtttaccagagcactaagcaggtattgaaactgttcattcggagtcagatcgtcaaaatccggcttcgtcagcggcaggggccgatccaatatcatattgtagatctcaatcagcttcattatcgtttcggtacggttgactgacttgggaatactgccttgcggatcaggttcatcggtatcgacgagaataaggtcggagacttgttccccttctgcttgcagttgcaaggccatctcaaacgcgatccagccaccgaaagaatgacccagcaggtgatagggaccgtgaggttgcgtttgacggatgatctggatataggcatgagcagcaccttcgacactgacatagggaaaattgtgtttgtcagtcagtcccagaccgcgtgtctgcaaggcgtagactggaagttgctgtgggagcgacagcgccagcccgagaagactagaggcgctggcaccggcaccgggcatgcaaaatagcggcggaaccgaccgagacccgctttggatgataacgcgcgggtcatagggaggagcgggcagtaagtgctcggtgagtgaatccactatctggttgagcgaagggggacgcatgatggagaaatgcgttccaccgatagcgtggagtgtcgaatcagtgccgacgatattacgccaaccgtgccaaatttccccgttgagtgcctcatccgcggtatacaggtggatgggcaggggggattttggcgcgatatagtcttgacccagttgtgtaatgatctcggcggtgtataggcgaaggaggatatcctcgcgtgtgatactggccggcagccattggtgttcaatacagcggtcaagaatttggttcacatcgctgagatcgtgcagttcttctaatacctgctcgtcactcgtgccgatttgagcacgcagtgagtcaatgattatctcaattcgttttgcttccttgtctatcggctggtcggtggagatttgtagcccatttatggaattataggaatcgatcataccgagaaatcctaccgtttcgccgcagctcatgaattgttgcgccatctcataggcgatcaaaccaccaattgaccatccggcaaggtgataggggccttgcggctgaacgcgacgaatagcctgaatatggcaggccgcgagcgcttcaagcgacgcaggaggatgctccagcgtgtggataccaagagcctgtaatgcatagacaggaagctcagatggcagtaaggctgccagtggcgaatagaccagtggatcgccggaagtctcgtgtatcaggaacaagggtggcaggccgcctgttgggtttagcggcacgggattcgcatcgaacggagacgttgattgggcaaaacgctcgccaatagctattgccagatcactcaatgtcggatgcacgaacaagacggtcagaggaaccgccatgtcttgctcccgcatccggttcagcaactgcacagcgagcagtgagtgaccgccaagctcaaagaaatgatcgtgacggccgacccgctccagtcccaataagtcttgccagatctgcgccaaggtggtttccgccgcgccgactggcgcttgatagccacgcgccaccacggcggacgaatcaggggcagggagcgcctgacggtcaagtttgccgttgggggtgagcgggaaagcgtcaagtgtcataaaggcgctgggcagcatatattcggcaaggtgtcgggcgagttgctgacgcagctcggcgggaaccagttcaacgctggcctgaggccgtacataggcgaccagacgtttctggctcggctcatcttcgcgcgccaataccaccgcttcgcgcacgccgtggcattgcatcagttgcgcctcgatctcaccgagttcaatacggaagccgcgcagtttgacctgaaaatcattgcggccgaggtattcaatattgccgtcagaaagccagcggccgaggtcgccggtcttgtacatacgggcatctggtgccgaggagaacggatcgatgaggaagcgttcggtggtcagttcgggtcggttcagataaccgcgagccacaccggcaccggcgatatggatttcgccggcgacaccaagaggcacgggctgaccatgtgggttgaggatatagatctgtgtgttagctatcgggcggccgatatgactgacaaagccctccgtccggttcatccgtatccaggttgaataagttgttgtctcagagggaccatacagattgcacacattctgtacggatgagtgggcaaataaatgctcaacgacctgtggtttcaatgcttcaccggccaaattgaccgtccgggcagtgaggggaatcgcattggcttcgatcaaatgtgcgatggccgacggcacagtgttgatcaggctgaccggttgttcggtagtgaccagtgacaacgcatcagggacgagatgaaccgtgccgccagagacgaggggcgcaaagcattcgtataccgccaaatcaaaattaagcgaagtagcgaaaagggtattcgccaattcctctgggctgaaagtccgctgcgcccagatgaggaaattcaccgtattacagtgggcgatcgtcacccctttgggtaggccggtagaaccggaagtgtagatcacatacgccagatggcgtgacgtcagccccaacgtctgcggttccggattatggatgggttgtgctgccataaccggttcttgggcgtcgagcaccaccgtaggcacggggctgaccagcatgttaacccatgccgtctgggtcagtaaggccacgggtgccgcgtcattgagcatatacgccagtcgttcagtcggatacgccggatcgagcggcacataggcaccgcccgccttgagaatagcgagcaggccgaccaccatctcagggctacgtgtcagacaaattgccacccgatcgtccggacgtacccccagcgcgatcagatgatgagccagacgattggcgcggtggttcagttcgccatagctgagtgcttgctccccgcataccacggcggtggcatcggggttatacgccgcctgaacctcgaacagttggtggatcagggcatcctgcgggaagtccgcctgagtcgcgttgaagttcaccagcagttgctggcgttcgtcttcgggcaacacgtccaaatccagtgcaggcgtgtctggcgcttcaaccaatattgatatcaattgctctatcgctcttgtgagataggtatttattctattgggatcaatgttattgacggtttgagctgataacacaaaatattcaccatcatcgtcaatggacatttcaaatgggtaattggtacgttcgcagctatctaaacttgccagaccaaacagatccagactaggtgtacgggtatttttgtcattaccatgccggaaattgagcagggcactgaacagggatatgccaccgagtccactgcaacgctgtgcaagcgacaatggggtctgttcgtagagcagcaggctggcacaggcgtcattcgtcattttgacgagttcatccacgctgcttccttttagcttcagtctcaagggcagggtattgatgaacatgcctaaagcgcgagcactcccatcaactcccgacatgcggcctgacaatacggtgccaaatacaatgtcatcgcgtccactcgtgcgtgcgatgacgagcgcccaagctgcgtggaacaaaattgcggggttagtgccgaagcggcgcgctgttttacggattgcttgtgagagttcaacatcaagaacctttcgtgccgccgcgttatgttcgccattcccctgaacatccgccaggccaaaaggtgcggtggcctcgtcgatatctgccaggaatgtccggaagaaggcttccgcttcctgagttttaccttcctgacgtgcgtaggcgacaaagttacgataaggaacggatggctgcaaatccgcgccaagtcccatcaggaaagcggtcgtttctgcgagcaaacaccggagtgagaggttatcgtcgatgatgtgatgcaactggaacaagacgtacaacttggctgaatgtggttcggtggcgacttgcaaacgtatcagaggagcatgggacaaatccatgtgctgatgtgacagtgccatgcgcgcttgcatgctggcaaccacgtcactatcgtcatcgaatgtcaggacattgaccggcaatggtgcgtgtcgatgtaccacttgaacaggttgggataacccgagccagtggatagatgtacgcaggatatcatgccgatcgatgacggcttgtaatgccgcaatgaatgcgtcgagttttgtctggttttcgacgctcaacaacgacgatataacgtatggatctctgttcggctgaagcaggtgatggaacaggataccttcctgtagcggcgcgagcggatagatatcctgcacatgggtcactccgccggggatcgcgtcagcgatggcatcaatttcagcctgagacagcgagaccagaggcagcatatcgggcgtgagggcggtgcagtcttcggggatgcgattgggcggtaccacgaaggtgtcggcaccactctgggacttcaggatagcttgcgccatatcggtgagtacaggcacggagaacacgctgcgaacgtcgagctgccaaccaaggccacgcagccgctcaatcagactgacaatcatcagcgaatggccacccagttcaaagaaatggtcgtgacggccgatccgttccagtcccaacagattttgccagatttgcgccagtgcggtttccacctcaccgaccggggcttcatagccgcgcgtcaccacggcggacgcatcgggcgcggggagcgcctgacggtcgagtttgccgttgggggtgagcgggaaagcatcgagcgtcataaaagcgctgggcagcatgtactcggcaagatgttgggtaagctgttgatgtagttcggcgggaaccagttcaacgccgtcctgaggccgcagataggcgaccagacgtttctgtcccggctcgtcttcgcgtgccagcactacggcttcccgtacgccggggcactgcaccaattgggtttcgatctcaccgggttcgatacggaagccgcgcagtttgacctgaaagtcattgcggccgagatactcgagatggccgtcggggagccagcggccgaggtcgccggtcttatacatacgggcgtccggatcggaggagaacggatcggcaaggaaacgttccgcagtcagttcaggacggttcaggtagccacgcgcgacaccggcaccggtaatatagatttcgccggtcacaccgagaggaacgggttggccgtgggtgccgaggatatatgcccgcagatcaggtagcggctggccgatcaaactgccacgtcccagagtgatgtcggattccgtgagttcacgataagtggcatgcacggtgatctcggtgatgccgtacatattgaccagacgggtctgtcgggtggggttacgggcgacccacggggcaagcgtatgcaattccagcgcttcccccccgaagataatacagcgcagggaatgcggcgtggcattctgggcagaaatcaacgggcgaaaagcactgggcgtttgattcagtacggtgactcgctcacggcatagcagtgcatagaaagcctgcggtgaacggagacagtcagtcggtacaacgatcagccggccaccatgagacaaggcaccccagagttcccacaccgagaaatcgaaagcaaaggaatgaaacagggtccacacatcattgccaccaaaccggaaacgttcttgggtggcggctaacaggcgggtgacatgggcatgttcaaccatcacccccttgggtaatccggtggagccggaggtgtagatgacatacgccagatggcgtgatgtcagccccagtgcctgtgtatccggattgtgatccggttgcgccatcagggacgcatcctgagcatcgaatacgattgtgggcaggagagcagggaagtagctggtcagcatgtcgacctgtgttgtctgggtcagcaaagctactggtgtcgcatcatgcagcatgtaagccagccgctcggccggataagccggatcgagcggtacataggcgccgcctgccttaagaatagcgagcaaaccgaccaccagctccggaccgcgttcgacgcaaattgccacccgatcgtccggacgcacccccagcgtaatcaagcgatgagcgagacgattggcgcggcggttcagttcaccatagctgagtgtctggttctcaaacaccacggcggtggcatcgggagaatgtgccgcctgagtctcgaaccgctgatggatcaaggcgctctgcgggaagtctacttggatggcattgaagccggtcagcaactgttgccgctctgatgccggcaagatgggcacttgcaggataggctgttgcggatcgctggccagcgccttgaccaaaccgctgagggcggtggccagataagtggtcacgcgagccggatcgatactcgtcacagtctgggcagtcaggcggaaaccgaccccctgatcatccaccgagagggtaaccggatagttggttcgcccttcggttgccacgatgcgcatgcctgcccaaatcgtatcaagcgcgccggcttcgtcagcttgactatgacggtaattgagcaaggcactgaacagtggcatcggttgagccacaccactacagcgctgcgccagcgccaacggagcctgttcgtgctctagcaacattgtgaggctgcggtaggtggcctgaaccgcttcctgtacgctgcaatcggccagagagatccgcatcggcagcgtattgataaacatccccagaactcggtcggcacccgcgcctccttgcaggcgacccagcagcacggagccaaagatcacatcgtcgcggctgctggtttgtgccagcacttgcccccaggcgagatggaacagcacacttggactgactcccagacggcgagcctgagcgcggatagcctcagctaaattgggggggagcaagagacgggcttcggtgacaggctcaccgtcgccctgcactttgagcacaccgaatggtgctgtcggttcgtcgacatcagcgagttgggagaggaagtaagcctcatgcactgtgtccggcacgctcaggatctgggcgataaagtctcggtagggcagcgcggcgggtagtttttgggcatgtccctgcaacagcagggcaatttcggcaaaaatcagcgccagcgtcatttggtcgctgaccagatgatggaaacgcagcgccagcaaccactcatcctgtgccggatcgtgggcaatgtcggcggcaaacagtggcgcgcggttcaggtcgagacggtgctggtgtggatcagtatgagcccgtaactgagccgggacgtcgtctgctgtggttggggtaaagtgattgacccacagcggtgcctgacgccagaccacctgaaccggctctgtcagtccttgccaacaggcggcggtacgcaggatatcgtggcggtcgatgacttgttgcagcgcggccagaaaagcatcgagatgctggcgggtctcgaaggcaagcagggtctgtaacagataggcatcgccttgtgtctgtagcaggtgatggaacagaataccttcctgcaacggcgccaacggatagatatcctgcacattgctcgctccgccggggatcatgctgacgataacatcaatctcagcctgagacagcgaaaccagagccagcatatcgggcgtgagggcagtgcagcctgcggggatacggttaggcggcaccacgaaggcgtcggcagcgtcctgatgtatcaggatggtttgcgccagttcggcaaggacgggggcggcaaatacgctgcggacgtcgagccgccagccgaagccacgcagccgcccgatcaaactgacgatcatcagcgaatgtccaccgagttcaaagaaatgatcgtgacggccgacccgttccagccccagcaggttttgccagatctgggcgagagcattttctacctctcctactggcgcttcataattacgtgtcaccacggcggacgggtcaggtgcgggaagcgcctgacggtcaagtttgccgttctgggtgagtgggaaagccttaagcgtcataaaggcactcggcagcatatattcggcgagctgccgggagagttgcagacgcaactcggccggaaccaactcaacaccggtctggggcagcagataagcgaccagacgcttgtgacccggctcgtcttcgcgcgccagcaccaccgcttcgcatacgccgtggcattgtactaatttggcttcgatctcgccgagttcgatacggaaaccccgcagtttgacctgaaaatcgttgcggccgagatattcgatatggccgtcgggaagccaacggccaaggtcgccggtcttgtacatacgagcgtccggatcggaggagaacggatcggcaaggaaacgttcggcagtcagttcagggcggttcaggtagccgcgggcaacgccggcaccggcgatatggatttcgccagtgacgcccagaggaacaggttggccgtggggatcgaggatatagctttgggtattggcgatgggtctgccgatgactgaaacatccggcacgccgaccgtagcagaatattcataccaggtcgcatcaccattgatttcggacgaaccgtagaaattcagcagatgaatacaagggtaatccgttacgacctgccgcgcgagttcaggcgcaagtcgttctccgctgcaaatcaacgtcctaatcgatttcagagaatcgccactcccctctatcaggagtttcagcagtgaaggcaccaccaccatgtagttaacctcggcgcggcgtaaaccttcgccgaagcgcgtaagatctttcacttcatggttatcgaaaaccaccagtttgccaccggccagtaatacaccaagtgtctcggtcactgaatcgacgaagctgatgctggttttcagcgccgccaccagtggcggtgtcacaatgtcgcgcacgaaccacaacagccggttacacagggcgtgatggctgctcatcacccccttgggctggccggtcgagcctgaggtatagatcacatacgccagatggtgtgatgtcagacccagcgtctgcgcttctggattgtgggtcggctgtgattccataaacggttcttgagtatcgagtaccactgtaggtatggcgctgttcagtgtgtcgacccacgccatctgggtaagcaataccacaggtgccgcgtcatcaagcatatacgtcagccgttcggtcgggtaggccggatcgagcggcacataggctccgcctgccttaaggatagcgagcaaaccgaccaccatctccagactgcgttcgacacagatggctacccgatcatccgggcgtacacccagattgatcagatgatgagccaactgattggcgcggcgattcaattcgtcatagctgagcgcctgatccccgtacaccacggcggtatcggtgggatgcagtgctgcctgagtttcgaacagtgggtggatcagggtgtcctgcggcaagtctgtctgggtggcgttgaagttcaccagtagctgttgccgctccgcaggcggtaacatcggcagactggcaatggtttgtgtcgtgtcggctgccattgccaccagcacatgagtcaaatagccgaccatgcgctcaacggttgcggggtcgaacaggtcggcggcatattccagatcaccgaccagacctgcctcagtttcggtcaacgacaacatcaggtcaaagtgagcaccatagcgcacctgttcaacgggagtgagctgtaggccgggtaacgacaagtcttggctcggggtattatttaaagccagcatgacttggaagaccgggctgtagctcaggctgcggtcgggctgcaaggcttctaccacttgctcgaagggcagatcctgatgagcgtaggcggcgagtgctcgctcacgaacctgtgcgagcagatcggacacacgaggcgtatcacccggtgtgacacgcagggccagagtattgacaaagaagccgatcaaaccctcgaattctctgtgctggcggttagcgaccggagtgccgacaacgatatcatcctgaccactgagccgggcaagaacgatgccccaggcggtcaatacggtcataaacaaggtagtgttatggcgctgtccgagtcccttaagcgatgccagcaacgtagcatcaaggtggagaggcacccggccaccggcatagctctgtacgggtgggcgtggccgatcggtgggaagtgtcagcaaagccggggcgccttggagctggctgctccagaagtcgtgctgttcggtgaggatggctccctgcaacccgttacgctgccagacggcatagtcggcgtactgaatgggcagtggcggtagcggatcgctgtggccgtcaagggcggcacggtagagggcgacaagttcatgcaccagcacaccgatggaccagccgtcagcgatgatgtgatgctgggtgagcagcaatacatgctcctcgtccgtcaattgcagcaattgaccacggatcagcggcccccggataaagtcgaagggtgtctgtgcttcaagggcagcgagctcggtgacacggttgttacgcaccgctgagtctaacgggcgcagatcctgacaggatagcgcaaagccgctatcggcgggatcgatgtgctggcagggttggccttcgaccagaataaagcgggtgcgcagactctcttgccgggcaaccagatgatcgagtgcggtggtcagcgcgtgacggttgagtgagccagtaagacgcagagctgccggaatatggtaggcctgactggcagcgggatcgagctgcccaaggaaccatagccgttgctgggcgaaggatagcggaagcaactggctgcgatcggccacggggatgatgacctgagttgtcacggaagcgccggtgagtgcgtgggccagatccgtcaggatgggctgggcaaagagttgttgtagcggcaattcccgcgccagatcttgccgtacacgcgcggcgagttggacggcaagcagagaatggccgccgagttcaaagaagtggtcatgacggccgacctgctccagccccagtaagtcttgccagatctgggccagagcggtttctattcttccctgtggcggctcatagccgcgtatcaccacggcagacgagtcggggacggggagtgactgacggtcgagtttgccgttgggggtgagcgggaagacgtcgagcgtcataaaagcgctgggcagcatatattcggcgaggtgttgagaaagttgctgacgcagttcggccggaaccagttcaacaccggtctggggcagcagataggcgaccagacgcttgtagccaggttcgtcttcacgtgccagaaccaccgcttcgcgtaccccgtgacattgcacaagacgagcctctacctcaccgggctcaatacggaagccacgcagtttaacctgataatcattgcggccgagatagtcgatgttgccatcgaaaagccagcggccgaggtcgccggttttatacatacgctcatctggatcggcggagaacgtatcaggaacgaagcgctcggcggtcagttcggggcggttcaggtagccacgggcgacaccggcaccggcaatatagatttcgccggccacaccgagggggacgggctggttgtggcaatcaaggatatagatccgggtattggcgatcggacggccgatgggaatagagtgagcaacatcgacgggggatgcaatacgataggtggtggcaaacgtcgtggtttctgtcggaccatagccgttgatgagatgtgctggctgagactcagccaattgtgcacgttgaatctttctgggatcgagtacatcgccaccgatgagcaggtagcgtagtcgcccaagcagggggttgagatcgctgagatactcattgaacaagccggctgttagccaaagggcagtgacttgccctttgatcagcgaatcgcagaaacgtaccggatcaagcagcactgagggtggaaccacatacagacgcccgccattcagcagagcagaccagatttcccacgttgatgcgtcaaaggcaatattggcacaatgggcaatacagtcatcggagccaatatcggcaaaaccattattgatgatgagacgaaggacattccggtgttcaaccatgacgcctttggacaacccggtggagcctgaagtatagatcacatatgccagatggcgtgacgtcagccccagtgtctgcggctccgggttgtgggtcggttgtgctgccacagccggttcctgagcatcgagtactattataggtacggacgtagtcacggggctgaccagcgtgtcaacccatgccgtctgagtgagtaagactacgggtgccgcgtcatcaagcatataagccaaccgttcggccggataggccggatcgagcgggacataagcgccgcctgccttaagaatcgcaagtaagccgactaccagctccaagctgcgttccagacaaatcgccacccgatcgtccggtcgtacacccagcgcgatcagatgatgagccagttggttggcgcggcagttcagttcaccatagctgagagtctgatcctcaaacaccactgcggtggcatcgggtttgtatgccacctgagactcgaacagttggtggatcagggcgttttgtgggaagtgcgtctgggtggcgttgaagttcaccagcagttgttgccgctctgccggtggcaggatcggcacatctcgaatcaactgttgcggattgtgggtcaaagcatcgatcagaccactgatcgccgtagccagataagcggtgacgcgggtcggatcgatacccgtcacagtctgagcagtcagatggaaaccagttcccagatcatcgactgacagggtgaccggatagttggttcgctcctctgttgttaaaatacgcatacctgcccaagtcgtctcagccgtatctgccttgccggcctgattatgacggtaattgagcagggtactgaacaacggtatcgactgcgccatgccgctacagcgttgagccagcgccaatggtgcctgctcgtgctccaatagcatggtcagactgcggtaggtcgcctgtactacggcctgtacgctgtgatcggccagagagacccgcactggcagagtattgatgaacattcccagtattcggtcagcacctgcgcccccttgcagacgacccagcagcacggagccaaagaccacatcatcgcggccgctggtctgcgccagtacctgagcccaggcgacatggaacagtacgcccggactgacccccagacgacgagcctgaacgcggatagcctctgctaaagcaggtacaagcggaagacgggcttcggtaacgggttcgccgtcagcctgcaccttgagtacaccgaacggcaccgttggttcgtcgacgtcggcgagttgatcgcggaagtaagcctcatgaactgcggtcggtatgctcagggtctgagcaataaaattgcggtagggcagtgccgtggtcagcttttcggcatgcccctgtaacagcagggcaatctcagcaaaaataagctccagcgtcatatggtcgctgaccagatggtggaaacgcagagcgagcagccattcatcctgtgccggatcatgggcgatatcggcggcgaacagcggcgcacggctcaggtcgaggcggtgtaagcgtgggtcagtgtgagcccgtagctgagccggaacatcgtccgccgtgtctggggtaaagtgattgacccacagcggtgcctgacgccagaccacctgaaccggctgcactaatccctgccaacaggcggcggtacgcaggatatcgtggcggtcgatgacctgttgcagggcggcaaggaaagtatcaagacgctcacagctgtcaaaggcgagcaggctctgtagcagatagtcatcaccttgtgtctgtagcaggtgatggaacaggataccctcctgtaacggcgccagcggatagatatcctgcacattggttgcccctccggggatcacgtcggtgatggcatcaatctcagcctgagacagtgtgaccagaggcagcatgtcgggcgtaagggcggtacagccttcggggatacggttagtcggcaccacgaaagcgtcggtgtcactccggatggtctgtgccatttcggcgaggacgggggcggcgaacacgctgcgaacctcaagccgccagccgaggccgcgcagttcttcgatcagactgacgatcatcagcgagtggccgccgagttcaaagaaatggtcgtggcggccgacctgttccagccccaataagttttgccagatttgcgccagagcagtttccatctcaccgagcggggcttcatagccgcgcaccactacggcggacgcgtcggggacaggaagcgcctgacggtcgagtttgccgttgggggtaagcgggaaagcgtcaagcgtcacaaaggcactgggcaacatatattcggcaaggtgctgggcgagttgctgacgcagttcagccggcatcagttcggcgtcggtctggggcagcaggtaagcgaccagacgcttgttgcccggttcgtcttcgcgcgccagcaccaccgcttcacgcacaccgtgacattgcactagccgggactcaatctcaccgagctcaatacggaagccgcgcagtttgacctgaaagtcattgcggccgagatactcgagatggccgtcagggagccagcggccgaggtcgccggtcttatacatacggacgtccggatcggaggagaacggatcggcaaggaagcgttccgcagtcagttcaggacggttcaggtaaccacgggcgacaccagcaccggtgatatggatttcgccggtcacaccgagaggaacgggctgaccatgagggttgaggatatatacccgcaaatcgggtagcggctggccgatcaaactgccacgtcccagagtgatgtcggattccgtgagttcacgataagtggcatgtacggtgatctcggtaatgccgtacatattgaccagacgggtctgtcgggtggggttacgggtaacccacggggcaagcgtatgcaactccagcgcctcccccccaaagataatgcagcgcagggaatgcggtgtggcattctgggcagaaatcaacggacgaaaagcactgggtgtttgattcagtacggtgacttgctcacggcacagtagcgcatagaaagcctgcggtgaacgggtacagtcagtcggtacgacgatcagccggccaccatgagacaaggcgccccagagttcccacaccgagaaatcgaaagcaaaggaatggaacagggtccacacgtcattgctatcaaaccggaaacgttcttgggttgcagctaacaggcgggtgacatgggcatgttcaaccatcactcccttgggtaatccggtggaaccggaagtgtagatgacatacgccagatggcgtgatgtcagccccagcgcctgtgtatccggattgtgatccggttgcgccatcagggacgcatcctgagcatcgaatacgattgtgggcaggagagcaggggagtagctggtcagcatgtcgacctgtgttgtctgggtcagcaaagctactggtgtcgcatcatgcagcatataagccagccgctcggccggataagccggatcgagcggcacataggcgccacctgccttaagaatagcgagcaaaccgaccaccagctccagaccgcgttcgacgcaaattgccacccgatcgtccggacgcacccccagcgtaatcaagcgatgagcgagacgattggcgcggcggttcagttcaccatagctgagtgtctggtcctcaaacaccacggcggtggcatcgggagaatgtgccgcctgaatctcgaaccgctgatggatcaaggtgctctgcgggaagtctacttggatggcattgaagccggtcagtaactgttgccgctccgaggctgacagcatcggcagatccgcaatagtttgtgtcgcatcgaccaccatctccgtcagcacattctttaaatagccgactatgcgctcaacggtcgcggggtcgaacaggtcggtggcatattccagctcaccgaccagacccgcctccgtttcggtcagcgataacgtcaggtcgaagtgggcgctatggcgcacctgctcaagtggcgtgagctgtaagccgggcaatgacagatcttgaggcggggtattgtttaaggtcagcatcacctgaaaaaccgggctgtagctcaggctgcgatcgggctgtaaggcttctaccacctgctcgaagggcagatcctgatgggcataggcggcgagcgcccgctcacgaacctgtgcgagcagatcggccacacggaggccatcatccggtgtgacgcgcagagccagagtattgacaaagaagccgatcaggttctcaagttcacggtgcggacggttggcgaccggagtgccgataacaatatcatcctgaccactgagtcgggcgaggacgatgctccaggcggtcagcacggtcataaacaaggtagtgttatgacgctgtcctagccccttaagcgatgtcagtaaggtcgcatcaagccggaaaggaacccgatcgccggcataggtctgtaccgacgggcgtggccgatcggtggggagttccaaaaaggtcggagcgtcccggagctgggcgcaccagaagtcgcgctgctcagcgagaacggttccttgcagccagtcgcgttgccagacggcataatcggcgtactgaatgggcagcggcggcaacagatcgctgtgaccgtcgagaacagctcggtagagggcacccagttcgtgcaccagcacactgatagaccagccgtcagccatgatgtgatgttgagtgagcagcaacacatgctcctcgtccgccagttgcagcaattgaccgcggatcagcgggccttgggtaaagtcgaaaggcgtctgcgcttcaaggttggcgagttcggcaacacgatgggtttgcgccgcagactccagaggacgcagatcctgacaggacagggtaaagccgatatcggcgggatcaatgtgcaaacagggttgcccgtcgatcaggataaagcgggtgcgcaggctctcttgccggacaaccagacgattgagtgcggtgatcagggcatggcggtcaagctggccggtgagacgcagcgctagcgggatatggtaggccagactggcggcgggatcgagctgaccaaggaaccacaaccgttgctgggcgaaagataatggtagcggtcggctgtgatcggcggcggggatagcgacctgagtggttgccgacgtaccggtcagcgtttgggctagctctgccagcagggggtgagcgaaaatctgttgtagtggcaattcccgtgccagatcctgacgcacacgtgccacaagctgaacggcaagcaacgaatggccgccgagctcaaagaagtggtcgtgacggccgacctgttctagtctcagcaggtcttgccagatctgtgacagtgtgatttctactttaccgaccggagtttcatagcctcgtgtcactatcgcagacggatcaggggcggggagcgcctgacggtcgagtttgccgttggggctgagcgggaaagcatcaagcgtcacaaaagcactgggcagcatgtactcggcaaggtgttgagaaagctgctgacgcagttcggccggcaccagcttaacatcagactggggcagcagataggcgatcaggcgcttgtggtccggctcatcttcgcgggtcagcaccacggcttcacgtacaccggagcattgcaccaattgagcttcaatttcgccgggctcgatacggaagccgcgcagtttgacctgaaagtcattgcggccgagatagtcgatgttgccgtcgggtcgccagcgacctaggtcaccggtcttgtacatgcgggcatccggatcggcggagaacggatcggcaaggaagcgttcggcggtcagttcggggcggttcaggtagccacgggcaataccggcacccgcgatatggatttcgccggccacaccgagcggaacgggctgaccgtaggagtcgagaatatagatccgggtattagcaatcggctggccgataggcggagcgccttcttcttggttatcgcacagataaatagccgcacagaccgtactttccgtcggtccataggcattgaccatacgccgaccttcagcccagcgtttgaccagtgcgggtgagcaggcctcaccgcctacgatcagagtttgcagtgttacgggtacggaatccagtgccgccaatgctgttggcgacagcagcacatgggtaatggcatgagtctccagagtattcaacagggcagctccgggcaggaggtgagttcgctgggcaagatggaggctggcacccgccagaagtgccatgccgcattcccagataccggcatcgaagctgttagaggcaaattgcaggatacggctgtcaggtttgatcgccagagtgtcctgctgagtggcgatcagattgctcaggccgcgatgctcgaccatcacccccttgggtaatccggtggagccggaagtgtagatgatatacgccagatggcgtgacgtcagccccagcgcctgagcgtccggattgtgagctgattgcgtcatcaggaacggttcttggccgtcgagtattatcgtgggaacgggactggtcagcgtgtcgatcagcgtcgtttgagtgagtaaaactaccggtgctgcgtcgtcgagcatatacgtcagccgctcggccggataggccggatcgagtggtacataggcaccgcctgccttgaggatagcgaacaggccgaccaccagctccgggctgcgttcgacacaaatcgccacccgatcgtccggacacacacccagcgcaatcaaatgatgggcgaggcgattggcacggcggttcagctcgccatagctgagtatctggtcttcatacaccacagcggtagcgtcggggttgcgtgctgcctgagcctcgaacagttgatggattagcgcatcctgtgggaagtccgtctgggtggcgttgaactccaccagcagttgttgccgctctgaaggtggcaggatcggtacatcctgaatcaatcgttgtggctcgcgaatcagggcatcgaccagaccgctgatggcagtaaccagataggcggtgacgcgagccggatcgattccggccacggcctgagccgtcaggtggaaaccgatccccagatcatccaccgacaaagtgagcggatagttgctctgttcttcaactgcgactacgtgcatacctgcccagctcgtgttaaccgcgtctgccgtgctggtttggctatgacggtaattaagcagggtactgaacagcggcatcgactgcgttacgccactacagcgttgtgccagcgccaaaggtgcctgctcgtgctccagtagtgtcatcagatcgcggtaggtggcctgcaccacctcctgcacactgcggccggccagagagactcgtaccggcagggtattgataaacatccccagtatgcgatcagcgccagcgacccctaacaggcgacccagcaatacagagccgaagaccacatcatcatggccgctggtttgtgccagcacctgagcccaggcgacatggaacagcacacccgggctgacccccagacggcgggattgggtacggatggcctccgccagagcgggagtgagcgaaagacggttttcggtgacaggctcgttatcgcccggcattgtgagcaccccgaacggtgctgtcggtgtgtcgacgtcggcaagctgggcgcggaaataggcctcatgcactgcggccggtacactcagggtctgggcgacaaagttgcggtagggcagcgctgtggggagtgtcccggcctgtccctgtaacacctgagcaacctcagcgaaaatcagctccagcgtcatatggtcgctgaccagatggtggaagcgcagcgccagcagccattcatcctgtgccggattatgggcgatatcaccagcgaacagcggcgcacggctcaggtcgagacggtgccggcgtggatcggtgtgagacaataactgagccggaacatcgtccgctgtagtcggggtaaagcgattgacacacagcggtgcctgacgccagaccacctgaaccggctgcgctaatccctgccagcagacggcagtacgcaggatatcgtggcggtcgataatttgttgcagcgcggtcagaaaagtatcaagacgctctcggctgtcaaaggcgagcaggctctgtaacagataagcatcaccttgtgtctgtagcagatagtggaacaggataccttcctgtagcggcgccagcggatagatatcctgcacattacttgccccaccggggatggcgtcgacgatagcatcaatttcagcctgagacagcgagaccagagacagcatgtcgggggtgagggcggtacagtcttcgggaatacggttaggcggcaccacgaaggcgttagtgtcaccctgaatagcctgtgccatttcagtgagaatgggagtggcgaacacgctgcggacgtcgagccgccaaccaaggccatgtagccgttcgatcagattgacaatcatcagcgagtggccgccgagttcaaagaagtggtcgtgacggccgacctgctccagctgcaacagatcttgccagatttgcgccagagcagtttccatctcaccgagcggggcttcatagccgcgagcgaccacagcagacaggtcggggacagggagcgcctgacggtcgagtttgccgttgggggtgagcgggaaagcatcgagcgtcataaaggcactgggcagcatatactcggcaaggtgccgggcaagctgctgacgcagttcagcgggcaccagttcaacgctgttctgaggccgcagataggcgaccagacgcttgtgacccggttgatcttcgcgcgccagcaccacggcttcgcgtacgccggagcattgcatcagttgcgcctcaatttcgccgagttcaatgcggaagccgcgcagtttgacctgaaagtcattgcggccgagatagtcgatattgccgtcgggtcgccagcggccgaggtcaccggtcttgtacatacgggcatccggatcggcggagaacggatcggcaagaaagcgctcagcagtcagttcggggcggttcaggtagccacgggcaacgccggcaccggcgatatggatttcgccggtcacaccgagcggaacgggctgactgtaggcatcaagaatatagatccgggtattggcgatcgggcggccgatatgactggcaaagccctccgtccggttcatccgtatccaggttgaataggtcgtcgtctcagaggggccatacagattgcacacatcctgtacggatgtatcggcaaacaaatgctcaatgacgtggggttttaatgcttcaccggccagattgaccgtccgggcggtcatgggcaccgccttggcttcaatcaagtgtgcgatggctgacggtacggtattgatcaggctgaccggctgtgcggtggttatcagtgacagcgcatctgggacgaggtgaaccgtaccgccagcgatcaaaggcacgaagcattcgtacaccgctaaatcaaaattaagcgaggtggcaaaaagggtatgtgccaattcctccggactgaaagttcgttgcgcccaggtgaggaaattcaccgtattgcggtgggtgatcgccactcctttgggctggccggtcgagcctgaggtatagatcacatacgccagatggcgtgacgtcagccccagcacttgtggctccggattgtaggccgatcgtgtcgtcatagacgattccggggcatcgagcaccacggtgggaatagcgctggacagcatgtcgatccatgtcgtctgggtgagcaaagctaccggtgccgcgtcattgagcatataggccagccgctcggccggataagtcggatcgagcggcacataggcaccgcctgccttaaggatagcgagcaggctcactatcatatccgggctgcgttccagacaaatcgctacccgatcgtccggacgtacccccagcgcgatcagatagtgagcaagacgattggcgcggtggttcagttcgtcatagctgagtgtgtgttccccgcataccacggctgttacatcgggattgtgtaccgcctgagcttcgaacagttgatggatcagggcgttctgcgggaagtctgcccgggtggcgttgaagtccaccagaagttgttgtcgctcggagaacggcagcatcggcaggttcgcaaggacttgtgttgcatcggcggccatcgccgccagcacattttccagatagctgaccatgcgctcaacggtcgcgggatcgaacagatccgcggcatattccagatcaccgatcagacccatttcagtttcggtcagtgataacgtcaagtcgaagtgggcaccatagcgtacctgttcgacgggcgtgagctgtaaacccggtaatgcccaattttgagccggggtattgtttaaggtcagcatgacttgaaagaccggactgtagctcaggctacggtcgggctgcaacgcttccaccacctgctcgaagggcagatcctgatgggcataggcggcaagtgcacgttcacgaacctgcgcgagcaggtcggtcacacgggaggtatcacccggggtgacgcgcagagccagagtattaacgaagaagccgatctggttctcaagttcatggcgcggacggttagcgaccggagtgccgatgacaatatcatcctgaccactcagccgggtgagaacgatactccaggcggtcagtacggtcataaacagggtggtgttatggcgttgtccgagttccttaagcgacgccagcaaggtcgcatcgagctggaagggaatttggccgccggcatagcgttgcaccggcggacgtggccggtcggaagggagtgccagcaaggccggagcgccctgaagctggctacaccagaagtcacgctgttcagtgaggatatccccctgtagccagttgcgctgccagacggcgtagtcggcgtactgaatgggcagcggcggtagcggatcgtcgtggccgtcgagggcggcgcggtagagggtgcccagttcgtgcaccagcacaccgatagaccagccgtcagcgatgatgtgatgctgggtgagcagcagcacgtgcgtttcctccgtcagttgcagcagttgaccgcggatcagcgggccttgggtaaaatcgaaggggatctgtgcctcaaggctggcaagttcggcgatacggttgttgtgcattgccggctccagcggacgcaggtcctgacaggacagggtaaagccgatatcagcgggatcgatgtgttggcagggctgaccttcgactaatacgaagcgggtacgcaggctttcgtgccgggcgatcaggtgatcgagtgcggtagtcagggaggggcggtcaagttggccggtgagacgcagcgctaccggaatatggtaggccagactggcggcgggatcgagttgagcaaggaaccacagtcgctgctgggcgaaagacaatggcagaggaagattccgatcaacctgcttgatggagggtcgctgctgttgctgagtttgcaattgttgtttgattttcttttttagcacagcacgtttcagattatcgaggttcatgtcattccttatcattgattactgtctccgcctaaaattgccatcagttcttctgttgacattaaatccagtgagttttgtattgattcaatatcgttttcccctattgcatccatttgcgctgacaaaatgatgttggcctgttccgccaatttgggggaaagaaacaacgaggcgatggggatatcgaccagaaattcggtttgtatgcgcgttgtcaattgcacggccatcagcgagtgaccgccgagttcaaagaaatggtcgtgacgaccgacccgttccagccctaacaggtcttgccagatctgagccagagtgatttcctcctcgccgagcggggcttcatagccgcgtactaccacggcggatgcgtccggggcggggagcgcctgacggttaagtttgccgttgggagtgagcgggaaagcatcaagcaccataaaagcgctgggcagcatatactcggcaaggtgttgggcgagctgctgacgcagttcggccggcaccagttcaacaccgtccagcggccgcagataagcgaccagacgcttgttatccggttcgtcctcgcgtaccagaaccacggcttcgcgcacaccgtgacattgcaccagtcgggcttcgatctcgccgagttcaatgcggaagccgcgcagtttgacctgaaagtcattgcggccgaagtattcaatgttgccatcgggaagccagcggccgaggtcgccggttttgtacatgcgggtgcccggatcggcggcaaagggatcggtgaggaaacattcggcagtcagttcgggacggttcaggtagccacgggcaaccccggcaccggcgatatggatttcgccggtgacaccaagaggaacgggctggccttgggtatccagaatataaatccgggtattggcaatcgggtgaccgatggggatttttccatattcgcctttcgtgaatgggatttcataagctgtagcgaaggtggtagtttctgttggcccgtacacatgcagcagatgttgtggagggtaatcggctctaagattgatcacaggacggatatcagcctgttcaccaccaaaaaggacataacgtaaacccgacaatgacggcgcgatcaaactcgcgtattgattgaacaatgcagttgtcaggaagagtgcactgacgctttccgatgctaattgctgcccaaaagagtcgggttgaaggagggtcttttccgggatcagcaggatacgtgcgccgtgcactaaacccgtccacacttcccaggtagccgcatcgaatgaaacattggcgcaatgggcaatacagtcatcggggccaatatcggcaaaaccattattgataatcaggcgcaggacattgcggtgctcgaccatcacccctttgggtaatccggtggagccggaggtgtagatcacatacgccagatggcgtgacgtcagccccagagcctgagcgtccgggttgtagtctggctgcgccgccagagatgactcttgggtgtcgagtactaccgccggcacggggctgtccagccggtcaatccatgccgcctgagtgagtaaagccaccggcgctgcgtcattgagcatataaactaaccggtcggccggataggtcggatcgagcggcacataggcgccgcccgccttgaggatagcgagcaggccgaccaccagctccggacagcgttccagacaaattgccacccgatcatccggccgtacgcccagagcgatcagatgatgagccagtcgattggcgcggcggttcagttcgtcatagctcatcgtccggtcttcgtacactacggctgttgcggctggccggatcgctgcctgagcctcgaatagctggtggatcagggcgtcctgcgggaagtccgtctcggtggcgttgaagtccaccagcagttgttgccgctctgccggtggcaggagcggcacatccagaatcaattgttgtggatcgtgagccagagcatcaaccagtccgcggatagcattaaccagataggcgattacgcgagccggatcgatcccggccacggcctgagcggtcagatagaaatcggctcccagatcatccaccgacagggtgagcggatagttggttcgttcctttgtcgcgatgatgcgcatgcctgcccaagttgtgtcaaccgcctctgcttcgccaatttggctgtgacggtaattaagcagggcactgaacagcggcatcggctgagccacgccactacagcgctgtgccagtgttaacggagcctgttcatgttccagcagcgtcattaaattgtgataggtggcctgtaccactgcctgcacgttgcgactggccagagggattcgtaccggcagggtattgataaacatgcccagtactcggtcggcgcccgcgcttccttgcagacgacccagcagcacggagccaaagaccacatcatcgcggccgctggtttgtgccagtacctgagcccaagccacatggaacagcacactcggactgacccccagacggcgggcccgggtgcggacggcttccgccaggtcgggggggagcgggagacgggcttcggcgatggattcgctatcgtccgttatcgtgagcataccgaacggcgctgtgggggcgtcgacgtcggcgagttgggcgctaaaataggcttcgtgtactgcggccggtacattcagggtctgggcgataaagtcgcggtaaggcagcgctgtggggagtgtctcagtctgtccctgcaatatttgggcaatttcggcaaagataagctccagcgtcatatggtcgctgaccagatggtggaaacggagaaccaacagccattcattctgtgccggatcgtgggcgatatcagcggcgaacagcggtgcacggttcaggtcgagacgatgccggcgcggatcggtgtgagccaataactgagccggaacgtcatccgccatagttggggtgaagcgattgatacacagcggtgcctgacgccagaccacctgaaccggctgcgataatccctgccagcaggcggcggtacgcaggatatcgtgacggtcgatgacctgttgcagggcggtcaggaaagtatcgagacgctcgcgggtgccgaaggcaatcaggctctgcaacagataagtatcaccttgtgcctgcatcaggtgatggaacaggatgccttcctgcaacggtgccagtggatagatatcctgcacattactggctccaccggggatggagctgatgaggctatcaatctcggcctgagacagtgagatgagggacagcatatcgggggtgagggaagtacaaccttcgggaatgtggttaggtggtaccacgaaagtgtcggtgtcgtcctgatgtgccagtatggtttttgccatctcggccagcacgggggcggcgaacacgctgcggacgtcaagccgccagccgaggccgcgtagccgctcgatcagactgacgatcatcagcgaatggccgccgagttcaaagaaatgatcgtgacggccgacctgcgtcagtcccaacaaatcttgccagatctgggttaaagcggcttctacctcaccgaccggagctttatagccacgcgccactacggcggacgaatcgggggcagggagcgcctgacggtcaagtttgccattgggggtgagcgggaaggcatcgagcgtcataaaggcgctgggcagcatatactcggcaaggtgccgggcgagttgctgacgcagttcggccggcaccagttcaacaccgcccagaggccgcagataagcgaccagacgcttgtggctcagttcgtcttcgcggacgagaaccacggcttcgcgtacgccgtgacattgcaccaatcgggcttcgatctcgcccagctcaatacggaagccacgcagtttgacctgaaagtcattgcggctgagatactcgatattgccgtcagaaagccagcggccgaggtcgccggtcttgtacatacgggcatccggatcggcggagaatggatcggtgaggaaacattcggcagtcagttcggggcggttcagatagccacgggcaacaccggcaccggcaatatagatttcgcctgcgacaccgagaggaacgggctgcccttgggtatccagaatatagatccgggtgttggcaatcggctgaccgatgggaatttttccatattcactttcagtcagtgggatttcataggccgtggcaaaggtggtggtttccgttggcccgtacacatgtagcaggtgctgtggcgggtaatcggttctaaggcggatcgcaggacggatatcagcctgttcaccgccgaaaaggacataacgtaaacccgacaatgatggcgcgattaaactcgcgtattgattgaacaacgcggttgtcaggaaaagcgcactgacaccttccgatgataaacactgaccaaaataatcaggttgtaataaggttttttccgggatcaacaggatacgtgcgccatgcactaaacccgtccacacctcccaggtggctgcatcaaatgagacgtttgcgcaatgggcaatacaatcatcgggaccaatatcggcaaaaccattattgatgatcagacgcaggacgttgcggtgctcgaccatcacccccttgggtaatccggtggagccggaggtgtagatcacatatgccagatggcgtgatgtcagccccagcgcctgagcgtccggattgtggctcggttgtgccgtcagggatagtttctgggcatcgagcaccacggtggggacggggctggccagtttaccaacctgtgctgtcaggctcagtaaggccaccggtgccgcgtcatcgagcatataggccagccgttcggccggatagtccggatcgagtggcacataggcgccgccggccttgagaatagcgagtaaccccaccaccagctccgggctgcgttcgatacaaattgccacccgatcgtccgggcgtacacctaaggcgatcagatgatgggccagccgattggcgcggcggttcagttcgccatagctgagtgtctgatcctcaaacaccacggcagtggcatcaggggagtgtgctgcttgggcttcgaataattggtggatcaaggcgtcttgcgggaagtccgcttgggtggcattgaaatcgttcagcaactgttgccgctccgaagccggcaggattggcaggcgtgcgatagtttgtgtcgcatcggcggccatcgccgtcagcacctgcttaaagtactctatcatacgttcggcagtcgttggatcgaacagatccgaggcatattcaagatcaccagtcaggccggtttcggtttcggtcagtgataacgtcagatcgaaatgggcgctataacgcgcctgttcaaccagagagagctgtagacccggtagtgccagatcttgagccggggtgttgtttaaggtcaacatcacctgaaatatcgggctgtagctcaggctgcgttcgggttgtagcgcttctactacctgttcgaagggcagatcctgatgggcataggccgcaagtgcccgctcacggatctgtgcgagcagatcggacacacgaaacgcatcacccggcgtgacgcgcagggccagagtattgacgaagaaaccgatcagtccctctaattcttggtgtgggcggttagcgaccggagtgccgatgacaatgtcatcctgaccactgagccgggtgaggacgatgctccacgcggtcagtacggtcataaacaaggtggtatggtggcgctgtccgagttccttaagcgatgccagtaaggtggaatcgagctggaaagagacctgatcgccgacataagtttgcaccgacggacgtggccgatcggtggggagtgtcagcaaggtcggggcaccctgaagttgagtacaccagaagccacgttgttcagtaaggacggtttcctgtaacccgttacgctgccagacggcgtagtcggcgtactgaatgggcagcggcggtaaaggatcgctgtggccgttgagggcggcgcggtagagagcgcccagttcatgtaccagtacaccgacggaccatgcgtcggcgatgatgtggtgctgggtaagcagcaacatatgtgattcgtctgtcagttgcagcagttgaccgcggatcagtgggccgcggacaaagtcaaagggggtctgtgcttcgagggcagagagctcggcgatacggcgggtgtgcattgccgggttcagcgggcgcagatcctgacaggacaaggcaaaattgacgtcggtgggatcgatgtgctggcagggctggccttcgaccagcacgaagcgggtacgcaggctctcatgccggacgaccagatgattgagtgcggtggtcagggcatcgcggttaagttgacccgtgagacgcagtaccaccgacatgtgataggccagactggcggcaggatcgagctggctgagaaaccacaaccgctgctgggcgaaggacaacggcagaggctgatgtcgatttacctgttcaatcaatggccgttgctgctgacctccgcgggctttcaattgttcttcaattttcttctctagaacagcccgtttcaggtcatcgagattcatgttaatccttgtcattggttattgtctccgcggttattgtccccgtttaacattgccagtaattcttctgttgacattaaatccagcgagttttgtagcgactcaatatcgttttcccctaccgcactcatttgcgctgaaaagatgatgttggcctgttccgctaattttggggaaaggaacaatgaagtgaggggaatatcgaccaggaatttggcttttatacgtgttatcaattgcacgaccatcagtgagtggccgccgagttcaaagaagtggtcgtgacggccgatgcgtaccagctccagcaggtcttgccagatctgcgccagagcggtttctattcttccctgtggggattcatagccgtgcgtcaccacggcggacgcgtcgggggcagggagcgcctgacggtcgagtttgccgttgggagtcagcgggaaggcgtcgagcgtcataaaagcgctgggcagcatatactcggcgagatgctgggcgagccgttggcgtagttcagccggaaccagctcaacaccatccagaggccgcagataggcgaccagacgcttatgacccggttcgtcttcacgcgtcagaacgattgcttcgcgcacgccgtgacattgcatcaattgagattctatttctcccagttcaatgcggaagccacgtaatttaacctgaaagtcattacggccgagatagtcgatgttgccgtcggggcgccagcggccgaggtcgccggtcttgtacatgcgggcatccggatcggcggagaacggatcggcgaggaaacgttcggcagtcagttcaggccggttaaggtagccgcgggcaacacccgcaccggcgatatggatttcaccggccacaccaagaggaacaggctgactgtgggagttgagaatatagatccgggtattagcgatcgggcggccgatatgactgataaagccctccgtccggttcatccgtatccaggttgaataagtcgttgtctcagagggaccatacagattgcatacgtcctgtacggatgagcgggcaaacaaatgctcaacgacctgcggtttcaatgcttcgccggccagattgaccgtccgggcggtgatgggaaccgcgttaacttcgatcaagtgtgtgatagctgacggcaccgtattgatcaggctgaccggttgttcggtggtgatcagtgacagcacatccggaacgagatgaactgtgccgccggagagcagcggtgcaaagcattcgaacaccgctaaatcaaaattaagcgaggtggcaaaaagggtatgcgccaattcctccgggctgaaagtccgctgcgtccaggtgaggaaattcaccgtattgcggtgagtgatcgccacccctttgggcagtccggtagagccggaagtgtagatcacatacgccagatggtgtgacgtcagccccagcttctgtggctccggattgtgggctggctgtgctgctatagccgatttctggccgtcgagcaccactgtgagtacggggctgatcagcctgtcaacccacaccgtctgggtcagcaaggccacaggggcggcgtcatccatcatatacgccagtcgttcggtcggataagccgggtcgagtgggacataggcaccgcccgccttgaggatagcgagcagtccgaccactatttccgggctgcgttccagacaaattgccacccgatcgtccggccgtagtcccagagcgatcaggtgatgagccagacgattggcgcggcggttcagttcgtcataactgagcgtctggttcccgcataccacagcggtagccgcggggctgtgcgccgcctgaatttcgaacagctggtggatcagcgcgtcctgcgggaaatctgcctgagtggcgttaaaatcaaccacaatttgttgccgctcagaggctggcaggatggaaacttgcaggattggctgttgcgggtcgcgaatcagggcatcgaccagaccgttgagggcggtggccagataagtagttacgcgagccggatcgattccggccacggtctgggcggtcagatggaaacctagccccagatcatccaccgacagagtgagcggatagttggttcgctcttcgattgcgacgatgcgcatgcccgcccaagtcgtgtcaattgcttcggattcgttggtttggctatgacgataattaagcagagcactgaacagcggcatcggttgggctacgccactgctgcgttgtgccagtgctaatggtgcctgctcatgctccagcagcgtcgtcagactgagataggtggcctgaaccacttcctgcacgctgcggtcggccagagaaacccgcatgggcagggtattgataaacatccccagtattcggtcagcacccgcgaccccttgtagccggcccagcagcacggagccaaagaccacgtcatcacggccgctggtctgcgctagcacctgagcccaggcgacatggaacagtacgctcggactgacccccagacgccgggcctggacgcggatggcctccgccagatcgggagcgagcgagagacgggcttcggcaacgggctggctatcgcccggcatcgcgagtacgccgaacggtgctgtcggcgcctcaacgtcagcgagctgggtacggaaataagcctcatgtgctgtcgtcggcacgttcagagtctgggcgataaaattgcggtagggcagtgccgtaggcaacgtctcggtgtgcccctgctgaatttgggcaatctcagcaaaaatcagttccagcgtcatatggtcgctgaccagatggtggaagcgcagagccagcagccattcattctgtgccggatcgtggacgatatcggcggcgaacagcggcgcgcggctcagatcaagacggtgcagatgtggatcagtgtgggcacgtaactgagccggaatgtcgtccgccgtagccggggtgaaacgattgatacacagcggcgcctgacgccagaccacctgaaccggttgtgtgagatcttgccagcaggcagcggtacgcaggatatcgtggcggtcgatgacctgttgcaacgcggccaggaagatatcgaggcgttcgcgcgtgtcgaaagcgatcagactctgcaacagataggtatcgccttgtgcctgtagcaggtgatgaaacaggataccctcctgcaacggcgccagcggatagatatcctgcacgttgcttgctccaccgggaattgtcccgacgatggactcaatttcggcctgagacagggagatcaggggcagcatgtcgggggtgagggcagtgcagccctcaggaatacggttaggcggtacgacaaaggcgtcagcgtcgctctgaacagcctgtgccatttcggcaaggacgggggcagcgaacacattgcggacatcgagtcgccaaccaaggtcacgtagtcgttcgatcaggctgacgatcatcagcgaatggccgccgagttcaaagaaatgatcgtgacggccgacccgcgccaatcccaacaggtcttgccaaatctgcgtcagagcagtttctatttcaccggtcggagctgcataaccgcgtgtgaccacggcggacgcgtcaggggcggggagcgcctgacggtcaagtttgccattgagggtgagcgggaaagcctcaagcaccataaaagtactgggcagcatgtactcggcaaggtgttgggcgagttgctgacgcagttcggcgggaaccagttcaataccggtctgtggcagcagataggcgaccagacgcttgtggcctgtctcgtcttcgtgtgccaacaccaccgcttcgcgcaccccgtgacattgcgtgagtcgggactcaatttcgccgagttcgatacggaagccgcgcagtttaacctgaaaatcattgcggccgagatagtcgatgttgccgtcggggcgccagcggccgaggtcgccggttctgtacatgcgggcatccggatcggaagagaacggatcggcaagaaagcgttcggcagtcagttcagggcggttcaggtagccgcgggcaacgccggcaccggcaatatggatctcgccggctacgccgaagggaacgggttgccccagcgaatcgagaatatagatccgggtgttagcgatcggacggccgataggaatggaacgggtcacatcgacgggagaagcaatggtgtaggttaccgcaaatgtggtggtttccgttggaccatagccgttgatcaggtgtgccggctgaaactcagacaactgtgtacgccggatcttctgcgggtcaagtacatcgccgccgatgagcaggtagcgtagttgcccgaacaggggctggatatcgctgagatactcgttgaacaaaccgaccgtcaaccagagggcggtaacttgtcccttgatcagcgaatcgcggaatcgtaccggatcgaacagcactgagggtgaaaccacatgcaaacgtcccccgttcagcagggcagaccagatttcccatgttgatgcgtcaaacgcaatattggcgcaatgggcaatacagtcatcggagccaatatcagcaaaaccattattgataatcaggcgaaggacattccggtgctcgaccatcacccctttgggtaatccggtggagccggaggtgtagatcacataggccagatgacgtgacgtcagccccagtgcctgcgtgtccggattatgagtcggttgcgccatcagggacgcatcttggccatcgagtacgactgtaggcacggtgctggctagtgtgccgacctgtgccgcctgagtgagtaaggctaccggcgcagcatcattgagcatatacgccagtcgctcggtcgggtaggccggatcgagcggcacataggcgccgcctgccttgaggatagcgagtaatcccaccaccaattccaaactgcgttccagacaaattgccacccgatcgtccggacgtacacccaaggtaatcaggtggtgcgccagacgattggcgcggcggttcagttcgtcataactgagcacctgatcctcaaacaccacggcggtggcgtcgggacgctgcgccgcctgagcctcgaacagttgatggatcagtgcgtcctgcgggaagtccgtctgggtggtattgaagtccaccagcaactgttgccgttctggggtcgacagcatcggcagaccggcaatggtctgggtcgcatcgcttgccattgccgtcagtacattctccagatagccgaccatgcgctcaacggtcgcagagtcgaataaatcggcggcatattccagatcacccgccagacccgactcggtttcagtcagcgataacgtcaggtcaaagtgtgcgctatggtgtgtctgttcaattgatgcaagctggagaccgggcaatatcaggttttgagccggggtgttgtttaaggccagcatgacttggaagaccgggctgtagctcaggttacgttcgggttgtaacgcttccaccacctgctcaaagggcagatcctgatgagcataagcgtcgagcgcgcactcacgaacctgcgcaagcaacccggctacacgggtagtgtcactgaatgtgacgcgtaaggctaaggtattgacgaagaaaccgatcaggttctcaagctcgcggtgcgggcggttagcgaccggagtgccgataacaatatcatcctgaccactgagccgggcgagaacgatgccccaggcggtcagcacggtcataaacagggtagtgttatggcgttgtcctaaccctttgagcgacgccagcaaggcagcatcgaactggaaagatacccgtccgccggcataggtctgtactgacgggcgtggccggtcggtgggaagtgtcaataaggccggggcgtcctgaagctgtgagtaccagaagtcgcgttgttcagtgagagcggctccttgcagccagtctcgctgccagaccgcatagtcggcgtactggagagacagcggcggcaggggatcatcgtggccgtcgagagcggcgcggtagagggcgttcagttcgtgtatcagtacgccgatggaccagccgtcagagataatatgatgcagggtaagcagcaacaaatgcgcttcatccgtcaattgcagcagttggccgcggataagtgagccctgagcaaaatcaaagagtgtctgtgcctcaaggctggcaagttcggcgatacggggggtgtgcatcgccggctccagcgggcgcagatcctgatagagcagggcaaagccgatgtcggcgggagcgatatgctggcagggttgaccctcgattaggacaaagccggtgcgcaggctttcatgccgggcaattaagcgttcgagtgcagtagtcagcgcgtggcggtcaagctggccggtgaggcgcagcgctaccgggatatggtaagccagactggcggccggatcgagctgacccagaaaccacagtcgctgctgggcgaaagacaacggcagcggccggttgcgatcggcggcgggaataacgacctgagtggttgtcgccgctccgctgagtgcctgagccaaatctgtcagaatgggcaggtcaaacagttgctgtagcggcaactcccgcgccagatcttggcgcacgcgtgccaccagctggacggcaagcagcgaatggccaccgagttcaaagaaatggtcgtgacgcccgacctgctccagccccagcaggtcttgccagatctgcgccagagcggtttccgtttcgccgatcgggttggcatagccgcgcatcacgatggcggactgatcaggcacggggaatgccggacggtcgattttgccgttgggagtgagcgggaaagcgtcgagcatcataaaggcactgggcagcatgtattctgcgatgtgccggctgagttgctgacgcagttcagccggcaccagttcaacgccggcctgtggtagcagataggcgaccagacgcttgtgacccggttcgtcttcacgcgccagcaccaccgcctcgcgtaccccgtgacattgcaccagccgggcttcgatttcacccagctcgatacggaagccacgcagtttaacctgaagatcattgcggccgaggtattcgatgttgccgtcgggtcgccagtagccgaggtcgccggtcttgtacatacgagcgtcaagatctgaagagaacggatcggtaaggaagcgctcggcggtaagttcggggcggttcaggtagccgcgggcaacacctgcgccggcgatatggatttcgccggcgacaccgagaggaacaggctgcccttgtgtatccagaatatagatccgggtgttggcaatcggctggccgatgggaattgtcttccattcgctttcagtgaatggaatttcataggcggtggcgaaggtggtggtctctgttggtccatacacatgcagcagatgctgtggcggataatcggctctaaggtggatcgcaggacggatatcgatctgttcaccgccgaaaaggacataacgtaaacccgacaatgatgaggctatcaaactcgcgtattgattgaacaacgcagttgtcaggaaaagcgcactgacgccttccgatgctaagcactgaccaaaatagtcgggttgtagtaaggttttttccgggatcaacaggatacgtgcaccatgcactaaacccgtccacacctcccaggtggctgcatcgaatgaaacattggcgcaatgggcaatacagtcatcggggccaatatcggcaaaaccattattgataatcaggcgcaggacattgcggtgctcgaccatcactcccttgggtaatccggtggagccggaagtgtagatgacatacgccagatgacgtgatgtcagacccagtgcctgcacgtccggattgtgggtcggttgtactgccattgccggttccgaaccatcaagcaccactgtgggcacggaatgaaccagcatatcggcctgtgtcgtttgggtcagtaaggctaccggtgctgcgtcatcgagcatataggccagccgttcggccggataggttggatcgagcggcacgtaggcaccacctgacttgagaataccgagtaggccgaccaccagttctaagctgcgttccagacaaatcgccacccgatcatccgggcgtacaccgagggcgatcagatgatgagccagacgattggcgcggcggttcagttcaccatagctcagtctctgatcctcaaacaccacggcgatagcatcaggataacgcgccgcctgaacttcgaacagttgatggatcagggcgtcctgcgggaagtctgtctgagtcgcgttgaaatccatcaacagttgttgccgctctgaaggtggcaggatcggtacatcctgaatccatcgttgcgggtcgagaatcagggcatcgaccagaccgctgatggcggtaaccagataggcggtgacgcgggtcggatcgattccggccacggcctgagccgtcagatggaaaccggctcccagatcatccaccgacaggatgagcggatagttggttcgctcctctgtggcgacaatacgcatacctgcccgactcgtctcaaccgcatcggactcgctggtctggctgtgacgataattgagcaaagtactgaacagcggtatcgactgcgccatgccactacagcgctgtgccagcgctaatggtgcctgctcgtgctccagcaaggttgtcagactgcgataggtggactgtaccactgcctgcacactgcggccggccagagaaattcgcaccggcagcgtattgataaacatccccagtattcggtcggcgcccgcgcctccttgaaggcgacccagcagcacagagccaaagaccacatcgtcacgaccactgatctgtgccagcacctgcgcccaggccacatggaacagcacgcccggactgacccccagacgacgggctgcggcacggatggcctctgccagagtggaagtgagcggaagacgggcttcggtgatggattcgcgatcgttccgtatcgtgagtacgccgaacggcgctgtcggtgcatcgacgtcagcaagctgggcgcggaaataggcctcatgcgctgcgaccggcacactcagggtctgggcgataaagttgcgatagggcagtgcggcgggcagcgattcagcctgcccctgctgaatttgggcaatttcagcgaaaatgtgttccagcgtcatatggtcgctgaccagatggtggaagcgcagcgccagcagccattcatcctgaaccggatcgtgggcgatatcagcggcgaacagcggcgcacggctcaggtcgagacggtgccggcgcggatcggtgtgggctgataactgagccgggatatcatcctccgtggctggcgtgaagcgattgacacaaagtggcgcctgacgccagaccacctgaaccggctgcgccagaccttgccagcaggcagcggtgcgcaggatatcgtggcggtcgatgacctgttgcagggcggccagaaaggtatcgagatgctcatggctgttaaaggcaagcaggctctgcaacagataagtatccccttgagtctgcaacaggtgatgaaacagaataccttcctgcaacggtgccagtggatagatatcctgcacattgcccgctccgccgggagttgcttcgacgatgaccttgatctcagcctgagacagcgagaccagagacagcatgtcgggagtgagggtagtgcaattttcgggaatacggttgggtggtatcacaaaggcgctggcgtcaccctgaacagcctgcgccatttcggcgaggatgggggcggcgaacacactacggacgccaagccaccagccgaagccgcgtagccgttcgatcagactgacgatcatcagcgaatggccgccgagttcaaagaaatggtcgtgacggccgatttgctccagccccagtaagtcttgccagatttgcgcaagaatagtttctgcctcaccgatcgggacttcatagccgcgtgccaccacagcagacaggtcgggagcagggagtgcctgacggtcgagtttgccattgggggtcagcgggaaggcctcaagcatcacaaaggcgctgggcagcatgtactcagcgaggtgtcgggcgagttgctgacgtagttcggcgggaagcagttcagcgccatccagaggccgcagataggcaatcaggcgcttctgtcccggttcgtcttcgcgtgccagtaccaccgcctcgcgcacgccgtaacattgcatcagttgcgcctcgatttcgcccagctcaatgcggaagccgcgcagtttgacctgaaagtcattgcggccgaggtagtcgagattgccatcagagcgccagcggccgaggtcgccggttttgtacatacgggcatccggatcggcggagaacggatcggtaagaaaatgttcggcagtcagttcggggcggttcaggtagccgcgggccacgccggcgccggcgatataaatctcgccggtcacaccgaggggaacgggctgaccgtagccatcgagaatatagatctgagtgttggcaatcgggcggccgatatgactgacaaagccctccgcccggctcatccgtacacaggtgaataggtcgtcgtctcagagggaccatacagattgcagacattctgtatggatttacgggcaaacaagtgctcaatgatgtgcggtttcaaggcctcgccggccagattaaccgtccgggtggtcatggggatcgcgtcagactcagtcaagtatgcgatggccgacggcaccgtgttgatcaggctgaccgactgttctgccgtaagcagtgacagtacattgggggtaaggtgaactgtgccgccagagagcagcggcgtaaagcattcgtacaccgctaaatcaaaattaagtgaggtggcaaaaagggtatgtgccaactcctccggactgaaagcccgttgcgcccaagtgaggaaattcacggtattgcggtgagtgatcgctacccctttgggcagtccggtggagcctgaggtatagatcacataggcaaggtggcgtgacgtcagccccagtgcctgtgtgtccggattatgatccggttgcgccattagggacgcatcctgagcgtcgagtacgaccgtaggcacggggctgcccagtgtggcgacctgtgccgcctgagtaagtaagaccaccggtgcggcgtcatccagcatatacgccagccgctcggccggataagccggatcgagcggcacataagcgccgcctgccttgaggatagcgagcagtcccaccaccatatccgggctgcgttccagacaaattgccacccgatcgtccgggcgcacaccgtggtcaagcagatgatgagccagacgattggcgcggcggttcagttcgtcatagctgagcgttttctctccacatatcacggccgttgcgccgggattgtgtgccgcccgaacctcaaataattggtgaatcaaagcgtcctgcgggaagtccgtctgggtggcgttgaagtccaccagcaactgttgtcgctcagatgccggcagtatcggcaggctcgtaatagcttgcgttgcatcagccgccatcgccgccagcacattctccagatagccgaccatgcgctcaacggtcgcggggtcgaacagctcggcggcatagaccagatcacccgccagacccgcctcagtttcagtcagcgacaacgtcagatcgaagtgggcgctatggtgtgcctgttcaacccaagagagttgcagatcgggcaacacgagattttcagccggcatgttgtttaaggccagcatcacctgaaagaccgggctgtagctcaggctgcgttcgggttgtagcgcttccaccacctgctcaaagggcaaatcctgatgggcataggcggcaagcgcccgttcacgaacttgtgcaagcagatcggccacacggggcgtatcacccagcgtaacacgcaaggccagagtattgacaaagaaaccgatcatatcctctaactcgcggtgaggacggttagcgacgggggtgccgatgacaatgtcatcctgaccactcaaccgggagagaacgatactccaggcagccagcacggtcataaacagggtggtgtgatgacgttgtcctagccccttgagtgatgccagcaaggtggtatcgagctggaaggatacccggccgccggtataggtctgcaccggtggacgtggccggtcggtggggagtaccagcaaggccgggatattctggagttgtgtacaccagaaattacgctgctcagtgagggccgttgcttgcagccagtcgcgctgccagaccgcatagtcggcgtactggagagacagcggcggcaggggatcatcgtggccgtcgagaacggcgcggtagagggtgcccagttcatgcaccagcaccccgatggaccaaccgtcagagatgatatgatgctgagtaagcagcaacacatgcgcttcgcctgtcaattgcagcagttgaccgcgaatcaatggtccctgaataaagtcaaaggatgcctgcgcttcgcgggcaatgagatcggctatacggttggtgtgtgccgcaggttccagtcggcgcagatcctgataggacagggtaaagccgatgtcagcgggatcgatatgctggcagggttgaccctcgatcaggacaaagcgggtacgcaggctttcatgtcgggcgaccagacgatcgagtgccgtggtcagcgcgtggcggtcaagttggccggtgaggcgcagggctaccggaatatggtaggccagactggcggccggatcgagctgaccaaggaaccagagccgctgctgggcgaaagataacggtagcggccgattgcgatcggccgcgggaatgacgacctgagcggttgttaaagttccgctgagtgcctgagccaaatccgccagaagaggcaggtcaaacagttgctgtagcagtaactcccgcgccagatcctgacgcacgcgtgccaccagttggacggcaagcagcgaatggccgccgagctcaaagaaatggtcgtgacgaccgacccgctccagacccagtaagtcttgccagatctgaaccagcgcgatttctattttaccgatcggggcttcatagccgcgtgccaccacggcggacgtgtcaggggcagggagcgcctgacggttaagtttgccgttgggggtgagcgggaaagcgtcgagcaccataaaggcgctgggcagcatatactcggcgaggtgctgagcaagctgttgacgcagttccgccggcaccagttcaacgccggtttgaggtaacaggtaagcgatcaggcgtgggtggctcagctcatcttcacgcgccagcactaccgcttcgcgcacgccgtggcattgcaccagccgggcttcgatttcacccagttcaatacggaaaccgcgcagtttgacctgaaaatcattgcggccaaggtattcgatgttaccgtcaggaagccagcggccgaggtcgccggtcttgtacatacgggcatccggatcgggagagaagggatcggcaagaaagcgttcggcggtcagttcagggcggttcagatagccacgggcaatgccggcaccggcgatatggatttcgccggcgacaccgaggggaacgggctggccgtcatcatcaaggagatagatttgggtgttggcgatcggacggccgatcggcggggctccttcttcccggctatcacacagataaatggctgcacagaccgtactttccgtcgggccgtaggcattgaccatacgccggccggtagcccagcgtttgaccagtgaaggtgagcaggcctccccccccacgatcagggtttgcagtgttacgggtacggaatccagtgccgccaatgctgttggcgacagcagcacatgggtaatggcatgagtctccagagtattcaacagggcagctccgggcaggaggtgagttcgctgggtaagatggaggctggctcctgccagaagtgccatgccgcattcccagatgccggcgtcgaagctgtttgaggcaaattgcaggatacggctgccggaattgatcgccagagtatcctgttgcgtagtgatcaggttgctcaggccgcgatgctcgaccatcacccccttgggtaatccggtggagccggaggtgtagatgacatacgccagatggcgtgacgtcagacccagtgactgagcgtccgggttgtgagtcggttgcgtcatcaggagcggttctgagccgtcgagtaagattgtgggtatggcgctaaccagtgtgtcggtcaatgctgtttgagtcagcaaggccacgggtgccgcgtcgtcaagcatatacgccagtcgctcggccggataagccggatcgagcggcacgtaagcaccacccgccttgagaataccgaacagacccacgaccagatccagactgcgttcgacacaaatcgctacccgatcatccggacgcacccccagtgcaatcagataatgagccagacggttagcgcggcggttcagttcgtgataactcagcgattgaccttcaaataccacggcgatggcgtcaggattgtgcgccgcctgagcctcgaataattggtggattagtgcatcctgtgggaaatccgtctgggtggcgttgaactctaccagcagttgttgtcgctctgtcggcggtaagatggatacatcccggatcaattgttgcggatctcgggtcagggcatcgaccagaccgctgatggcggtaaccagataagcggttatgcgagacggcacgattccggttacggcctgagcggtcagatggaaaccggttcccagatcatccactgacagggtgagcgggtagttagttcgctctcctgtagcgacaatacgcatacctgtccggagtatatcaactgcgtctgccccgcggctttggctgtgacggtaattaagtaaggtactgaacagtggcagtgattgcgctacgccactgcaacgctgtgccagcgccagcggtgcctgctcgtgctccagcaaggttgtcagattgcgataggtggtttgtaccacttcctgcacactacggccggccagagaaacccgcaccggcagggtattgataaacattcccaatatttggtcagcgcccgcgaccccctgtagacggcccagcagcacagagccaaaaaccacattgtcatggccgctggtctgtgccagcacctgagcccaggccacatggaacagtacgcccggactgacccgtagacggcgcgcctgagcgcggatggcctctgccagagcgggggggagcggaagacgggcttcggcgatggattcattatcgtccggcatcgtgagtacaccaaacggtgcagtcggtgcgtcaacgtcggcaagctgggtgcggaaataggcctcatgggttgcggccggcacgctcagggtctgggcgataaaattgcggtagggcagggcggcgggcagcgtttcggcctgcccctgctggatttgggcaatttcagcgaaaatcagctccagcgtcatatggtcgctgaccagatggtggaagcgcagcgccagcagccattcatcctgtgccggatcgtgggcgatatcggcagcgaataatggcgctcggctcaggtcgagacggtgccggcgcggatcggtgtgcgcggataactgagccgggacgtcgtctgccgtagccgggagcaagtgattgacacacagcggcgcctgacgccagaccacctgaaccggcttcgtcaatccctgccagcaggcagcggtgcgcagaatatcgtggcggtcgatgacttgttgcagggcggccagaaaggtatcgagatgcacgcggctgtcaaaggcgagcaggctctgcaacagataggtatcgccctgagtctgcaacaggtgatggtacaggatgccttcctgcaacggcgccagcgggtagatatcctgcacattgcccgctccgccgggaattgcttcgacgatagcttcaatctcagcctgagacagcgagaccagagacagcatatcgggggtgagggcggcgcaattttcgggaatacggttgggtggtaccacaaaggcgtcggcatcatcctgaatagcctgtgtcatctcggcaaggacaggggtggcgaacacactgcggacttcaagtcgccggccgaagccgcgtagccgctcgatcagactgacgatcatcagcgaatggccgccgagttcaaagaaatggtcgtgacggccgacctgttccagccccagtaagtcttgccagatttgtgcaaggatagtttccgcctcaccgaccggagcttcatagccgcgtgtgaccacggaggacgcatcgggagcggggagcgcctgacggtcaagtttaccgttgggggtgagcgggaaagcgtcgagcgtcataaaggcactgggcagcatgtattcggcaaggtgtcgggcaagttgctgacgcagttcggcgggaatcagttcagcaccggactgaggctgcacataagcgaccagacgcggatggttcggctcgtcttcgcgtgccagcactactgcctcacgtacaccctcacattgcatcagttgtgcctcgatctcgcccagctcaatgcggaagccgcgcagtttgacctgaaaatcattgcggccaagatattcgagattgccgtcggggcgccaacgaccgaggtcgccggttttgtacatgcgcgcattcggatcggaagaaaaaggatcggccggaaaacgttcggccgtcagttcgggtcggttcaggtagccccgggcagtgccggcaccggcgatatgaatttcgccggccacaccaagcgggacgggttgaccgtaggtatcgagaatatagatccgggtgttggcgatcggccggccgataggcggagcgccttcttcttggttatcgcacagataaatagccgcacagaccgtactttccgtcggtccataggcattgaccatacgccggctggtagcccagcgtttgaccagcgaaggggagcaggcctcaccgcccacgatcagggtctgcaatgtcacagggactgaatccagtgccgccaacgcggtcggcgacagcagtacatgggtaatggcatgagtctccagcgtctccagtagtgcagcaccgggcagaagatgagttcgctgggcaagatggaggctggcacccgccagaagtgccataccgcattcccagataccggcatcgaagctgtttgaggcaaattgcaggatacggctgccggaattgatcgccagagtgtcctgttgcgtagcgatcaggttgctcaggccgcgatgctcgaccatgacgcctttgggctgcccggtggagcctgaggtgtagatgacatacgccagatggcgtgacgttagccccagtatctgagtatccggattatgagtcggttgcactgccagagatgacgcgagtgcgtcgagcatgattataggcacggggctgatcagcgtgtcggcctgtgccttctgagtcagcagagccaccggtgcggcatcatcaagcatataggccagccgttcggccggataggttggatcgagcggcacataggcgccaccggccttgaggatagcgagcaggccaaccaccagctccgggctgcgttcgacacaaatcgccacccgatcatccggccgcacgcccagcgtgatcagatgatgagccagccgattggcacggtggttcagttcgctatagctgagtgtctgatcctcaaacaccacggcagtggcatcaggggcatgtgccgcttgggcttcgaataattggtggatcagggcgtcctgcgggaaatcggcttgggtagcattgaaatcggtcagcaacagttgccgctccgagtccggcagcatcgacagacctgcaacagtttgtgtcgcatcggcagccatcgccgccagaacattttccaagtaaccgactatgcgttcaatggtcgtagagtcgaacaggtcggtagaatattccagatcaccaaccagaccggcctcagtttcggtcagcgataatgtcagatcgaaatgagcactatgacgcacctgttcaaccggagcgagttgcagacccgataatgccagattttgggacggagtattgttcaaggccagcatcacttggaagaccggactgtagctcaggctgcggtcgggctgcaacgcttccaccacctgctcgaagggcagatcctgatgggcataggcggcaagcgcccgttcacgaacctgtgcgagcagatcagccacccgggacgcatcacccggcgtaacacgcagggccagagtattgacaaagaaaccgatcatatcctctaactcgcggtgagggcggttagcgacgggggtgccgatgacaatgtcatcctgaccactcaaccgggagagaacgatactccaggcggtcagcagggtcataaacagggtagtgtgatggcgctgtccgagctctttgagcgatgccagtaagtcggcattaagctggagggggatccggttaccggcgtagcgctgcactgacgggcgtggccggtcggtggggagtgtcagcagggacggggcgttctggagttggctgtaccagaaatcacgctgttcagtgagaacagcgccttgcagccagtcacgctgccagacggcataatcggcgtactggatagatagcggcggcaggggatcgtcgtggccgtcgagggcggcgcggtagaggacgcccagttcgtgcatcaggacaccgatggaccagccgtcagcggtgatgtgatgttgggtaagcaacaacacatgctccgcgtccgtcagttgcagcagttgcccacgaatgagcgacccccgcacaaagtcgaaggggatctgggtttcgagggcggtaagctcggcgacacgattcgcccgcgccgtcagatccaacgggcgcagatcttggcaagacagagtaaagccgatatcggcgggatcgatgtgctggcagggttggccttcgatcaatacgaagcgggtacgcaggctttcgtgccggataaccagatgattgagcgcggtggtcagagcgttgtggttgagcgagccggtgaggcgcagtgccatcggaatatggtaggccaggctggcggcgggatcgagctgaccgaggaaccacaaccgctgctgggcgaaagacagcgctagcggctggctgcgatcggcgacaggaataacgacttgagcgattgccgaagcgtcggtgagcgttttagccagatccgtcaggagaggctgggtaaaaagttgctgtaatgacaacttccgtgccaattgttggcgtacacgggcggcgagctggacggcaagcagtgagtgaccgccgagttcaaagaagtgatcatgacggccgacttgttccagtttcagcaggtcttgccagatctgagccagtgcgatttctatttcaccgatcggggcttcatagccgcgtgtcactatagcggacaggtcgggggcaggaagcgcctgccggtcgagtttgccgttgggagtcagcgggaaagtgtcgagcgtcataaaggcgctgggctgcatgtattcggcaaggtgtcgggcaagttgttgacgtagttcggccggcaccagttcaacgccggtctgaggtagcagataggcgaccagccgcttgtgacccggctcgtcttcacgagccaccaccacggcttcacgcacgccgtggcattgcaccagccgggcttcgatttcacccagctcaatacggaagccgcgcagtttaacctgaaaatcattgcggccaaggtattcgaggttgccgtcgggcagccagcgcccaaggtcgccggtcttgtacatacgggcgtccgggtctgacgagaagggatcggtcaggaagcgctcggcagtcagttcagggcggttcaggtagccgcgggcaacgccggcaccggcaatatgaatttcaccggcgacaccaaggggaacgggctgaccatacggatcgaggaggtagatttgggtattggcgattggacagccgatagggatgggacgattcacatcgacgggtgagcttatgcgataggttgcggcaaacgtcgtggtttccgttgggccatagccgttgatcaggtgtgccggctgacactcagccaactgtgtacgccggatcttccgtggatccagtacatcgccgccgacgagcaggtaacgcaattgtccgaacaggggttcaagatcaccgaggtattcgttaaacaagccggctgttaaccagagggcggtgacttgtcctttgaccagtgaatcgcggaaacgtaccggatcgagcagcgctgatgatgaaaccacatgcagacgcccgccgttcagcagggcagaccagatttcccatgttgatgcatcaaaagcaatattggcacaatgggcaacacagtcgtctgaactgatgtctgcataaggattgttgatgaccaaccgattgatactgcggtgctcaaccataacgcctttgggcagcccggtggagccggaggtgtagatcacatacgccagatggcgtgacgtcagccccagtgcctgcgcgtccgggttgtgggtcggttgtgctgccatagccgattcttgggcgtcgagtaccacggtggggacggggctgtccagtgtatcgacccatgccgcctgagtgagtaaggccacgggtgctgcgtcatcaagcatataggccagccgttcggccggataggttggatcgagcggcacataggcgccacccgccttgaggataccgagtaagccgatcaacagctccggactgcgttcgacacaaattgccacccgatcatccgggagtacacccagcgcgatcaaatgatgagccagacgattggcgcgatggttcagttcgtgataactcagcgattggccttcaaataccacggcgggggcatcgggatggtgcgccacctgagattcgaataattggtggatcagcgcgtcctgcgggaaatccgactgagtggcgttgaacgccaccagcaattgttgccgctctgtcggcggtaatattggcacattccggatcaactgctgtggatcacgagccagagcatcaaccagaccgttgatggccgtggcgagataggcggtgatgcgggtcggatcgattcccgccaccgtctgggcggtcagacggaaaccggttcccagatcatcgaccgacagggtgagcggatagttggttcgttcctctgtagcgacgatgcgcatacccgtctcaaccgcgttagttccgctggtctggctgtgacggtaattaagcagggtactgaacagcggcatcggttgggtcacattgctacagcgttgcgccagtgctaacggtgcctgttcgtgttccagcagcgtcgtcagactgcggtaggtggcctgcaccacctcttgtacgttgcgaccggccagagaaacccgcaccggcagggtattgataaacattcctaatattcgggcagcgcctgcgatcccttgtaaacgacccagcagtacggagccaaagaccacgtcgtcgcggccgctggtctgcgccagtacctgagcccaggccacatggaacagcacacccggactgacacccagacgacgagcctgagcatggatagcgtctgccagagcggggtcgagcggaagatgggcttcggcgatggattcgttatcgcccggcatcgtgagtacgccgaacggcgcagtcggtgcgtcaacgtcggcaagctgggtgcggaaataggcctcatgggttgcggccggtacactcagagtctgggcgacaaagttgcggtagggcagggcggcgggcagcgactcagcatgcccctgctgaatttgggcaatctctgcgaaaatcagctccagcgtcatatggtcgctgaccagatggtggaagcgcagcgccagcagccattcatcctgtgccggatcgtgggtgatgtcggcggtgaacagcggtgcacggctcaggtcgagacggtgccggcgcggatcggtgtgcgcggataactgagccggaatatcgtcagccgtggccgggataaagtgattgacacacagcggtgcctgacgccagaccacctgaaccggctgcgccagatcttgccagcaggcagccgtgcgcaggatatcgtggcggtcgatgacctgctgcaaggcggacaggaaagtatcaagatgttctcggttgttaaaggcgatcaggctctgcaataaataggtatcgccctgagtctgcaacaggtgatggaacaggataccttcctgcaacggtgccagcggatagatatcctgcacattgcttgcaccgccgggagttaccttgacgatggcgtcaatctcggcctgagatagcgaaaccagagacagcatgtcgggggtaagggcggtacagccttcagggatacggttaggcggtacgacaaaggcgtcagcgtcaccctgaacagcctgtgccatcccgctgagaatcggggtggcaaacacactgcggacatcgagtcgccaaccaaggtcgtatagctgttcgatcagaccgacgatcatcagggaatggccgccgagttcaaagaagtggtcgtgacggccgactcgctccagccccaacaggttttgccagatctgcgccagtgcagtttctgtctcaccgatcggagcttcatagccgcgcgccaccacagcagacaggtcgggagcagggagtgcctgacggtcgagtttgccattgggggtgagcggaaaggactcgagtgtcataaaggcgctgggcaacatgtactcggcaagatgctgagcaagctgctgacgtagttcggcgggaaccagttcaacgccgtccagaggccgcagataggcaatcaggcgtttctgtcccggctcatcttcgcgtgccagcactacggcttcgcgtacgccgcgacactgcatcagttgcgcctcgatctcaccgagttcaatacggaagccgcgcagtttgacctgaaaatcattgcggccgagatactcgatattgccgtcgggacgccagcggccgaggtcgccggtcttgtacatacgggcatccggatcggtggagaacggatcagtaaaaaagcgctcggctgtgagttcaggacggttcaggtagccgcgagccacgccggcaccggcgatatgaatttcgccggccacgccaagaggaacgggctgaccgtaggtatcgagaatatagatccgggtattggcgatcgggcggccgatatgactaacaaaaccctccgtccggttcattcgtatccaggttgaataggtcgtcgtctcagaggggccatacagattgcacacattctgtatggatgtacgggtaaacaaatgttcaacgacgtgcggtttcaacgcctcaccggccagattgactgtccgggcggttgcaggaactgcgttagcctcaatcaaatgcgcgatggctgacggcacggtattgatcaggctgacgggttgttcggtggtgaccagtgacagcgcatcaggaacgagatgaaccgtgccgccagagacgagtggcgtaaagcattcgtacaccgccaagtcaaaattaagtgaggtggcgaacagggtatgcgccaactcctccggattgaaagtccgttgcgcccaagtgaggaaattcacggtattgcggtgggcgatcgctacccctttgggcaggccggtagagccggaggtgtagatcatatacgccagatggtgtgacgtcagccccagcgcctgtgcctccgggttgtggatcgattgtgccgccagaaacgatgcctgggggtctagcaccaccgtggggacggggctgatcagcgtatcaacccacgctgtctgggtgagcaaggctaccggtgcggcgtcatcgagcatataggccagccgttcggccggataggccggatcgagtggcacataggcaccgcccgccttgaggatcgcgagcagtcccaccaccatctccggactgcgtgtcatacaaatcgctacccgatcgtccggccgtacccccagtgcgatcagatgatgggcgagacgattggcgcggcggtttagttcgccatagctgagtatttgctccccgcataccacggcggtggcatcgggactgtgtgctgcctgagtctcgaacagttggtggatcagggcatcctgcgggaagtctacttgggtggcgttgaagtccaccagcaactgttgccgttccgagtctggcagcattggcagacatgcgagagtttgtgtcgcatcggctaccattgctgccagcacctgttgcaaatagccgaccatacgctcaacggtcgtggtgtcgaacagatcggtggcatattccagtcccccgaccagacccgcttcggtttcggtcagcaacagcatcagatcaaagtgcgcgctatgactctcctgttcgacctgagagatttgcaaactgggtaatgtctggtcttgagccggcgtgttgtttagggacagcatcacctgaaagaccggactgtagctgagactgcgttcgggctgtagcgcttcgaccacctgctcgaagggcagatcctgatgggcataggcggcgagtgcgcgctcacgaacctgcgcgagcagatcaaccacacggggcgcatcacccggtgtcacgcgcagggccagggtattgacgaagaaaccgatcataccctctaactcgcggtgagggcggttagcgacgggggtaccgataacaatgtcatcctgaccactcagccgggtgaggacgatgctccaggcggtcagtacggtcataaacagggtggtgttgtggcgttgtccgagcgccttaagcgacgttaataaggcgctgtcgagccggaagggaacttggccgccggtgtagcgctgtatggatgggcgtggtcgatcggtagggagtgccagcaaggccggggcattctggagctgtgcacaccagaaatcacgctgttccgtaaggacggttccttgcagccagtcacgctgccagagcgcatagtcggcgtactggagggacagcggcggcaggggatcgctgtggccatcgaggacggcgtggtagagagtgcccagttcgtgcaccagcaccccgatagaccagccgtcagagatgatgtgatgctgggtgagcaacaacacatgcatttcgtccgcgagttgcaatagttgaccgcggatcagcggaccctgagtaaaatcgaatggcgtctgcgcctcaagatcagcaagctcggtaatgcggtgagtgtgcattaccggattcagcgcgcgcagatcctgacaggacagggcaaaaccgacatcggcgggatcaatgtgctggcagggttgaccctcaacgagtacgaagcgggtacgcaggctttcgtgccgggcgatcaggtgatcgagcgccgtgctcagggcatggaggttgagttggccggtaaggcgtagtgtcaccggaatatgataggccagactagcggccggatcgagttgactgagaaaccacaatcgctgctgagcgaaggacagtgctagcggctggttgcgatcggcggcggggatgatgacttgagcgattgccgaagcggcgctgagcgcctgagccaaatcggccagaagaggcagggcaaaaagttgctgtagcggcaattcccgcgccagatcctgacgtacgcgtgcggcgagctgaacagcaagcagcgaatggccgccgagttcgaagaaatggtcgtgacggccgacccgctccagtcccaataagtcttgccagatctgcgccaaggtggtttctgtttcaccgaccggtgcagcatagccccgcgtgactacggcggacgagtcgggcgcagggagcgcctgacggtcaagtttgccattgggggtgagcgggaaaacgtcaagtgtcataaaggcgctgggcagcatatattcggcaaggtgccgggcaagttgctggcgcagctcggcgggaaccagttcaacgccggcctgaggccgcagataagcgaccagtcgcttgtgccccggctcgtcttcgcgcgccagaacgatggcttcgcacacaccgtggcattgcatcagttgcgcctcgatctcaccgagttcgatacggaagccgcgcagtttgacctgaaagtcattgcggccgaggtattcaatattgccgtcagaaagccagcggccgagatcgccggtcttgtacatacgggcgtccggatcgaaagagaagggatcggcaaggaaacgttcggcagtcagttcagggcggttcaggtagccgcgggcaacatcagcgccggcgatatggatttcgccggtaacgccgagggggacgggttgaccctgcgggtcgaggagatagatttgggtgttggcaatcgggcgaccaatgggaggaaaagttggccactgatccatattcttatccagcgtatatgccgtaaccacgtggctttcagtcgggccatagtgattgtgcaactggcatgatccggaacgttgtagaaagcggcgaatagcaggcgtgatacgtaattgttcaccggcggtaatgatgtgggctaagcaagaaaaatctccctcaatgtgactggccgcttcggcaagatgttgtagtgcaatgtaggggaggaagattctatcaatctgtttttgctgaatcaggcggaggaattgttgcggatcccgacgtgtttcttcattaatcaagaccagacatccgccttcgcacagcgtcgtaaatatctcctgaaaagcgacatcgaatccaagcgcggcaaactgtagcgttttaccggttccggatagatgtgaaggatcttgacggtgccattgcaacaagttcgacaatgctgccagaggcattcccactcccttgggcagccccgtggagccggaggtgtagatgacatacgccagatggcgtgacgtcagccccagagcctgtgtatccggattatgatccggttgcgccatcagggacgcatcctgagtatcgagtacgattttgggtacgggagtagagacgtggctggtcagccccgtctgggtgagtaagaccacgggtgccgcatcattgagcatatacgccagccgctcggccggataagccggatcgagcggcacataggcgccgccggccttaaggataccgagtaagcccaccaccatctcaaggctgcgttcaacacaaatcgccacccgatcgtccggacgtactcccagtgcgatgaggtgatgagccagacgattggcgcggtggttaagttcgtcataactgagtgtctggtcttcgtacactacggcggtggcgtcgggattatgtgtagcctgagcctcaaacagtgaatggataaacccatcctgcggcaagtccgtctgggtagcgttgaagttcaccagcagttgctgtcgctctgccggcggcaaaacaggtaagcttcggatctgtgtctcgggagaagtgagagcggcttccatcaacatggctaaacgcgattggagaaccatcacttcagtgcagtttaggtagtgggttgagtaattgaattcaatcgtaacgggctgattgatatcctcattgttagcgaatgtgtattggtagatcgcgataaaaaaaggaaacggtgttccacgttgtatttttgagtatttgatagtggcaccgggcaggtcagcgttcgcctgaaacgactcaaatgacagcatgatgtcgaatagttgagcgcgtcctgttttctgctggatttgtatatgccgattaatctccgcgattggtaagcgctgacgtttatagcaatgacgcaactctgttgccgctttgtgcataacatcaaggaaggtgtcatgaggtgtaatggttatgccgacgggaatgactgacgagaacatgcccaacgtgcgtttttgcctgacgttcttacggttgcgcacaggaatgccgatgacgatttcctccgcctgggtggtacgggcgaaatagcaagccagaacggcatacatgaagtgcaagacagacaacccatgctcggtcacagtatcttcgatgcgctggaaaagccccttatccaattgccaaagcaccggttcggtttgtccgtgatctgccgttctatcgggattaggcggttggagcaatgccggaggcaagttcacatagcgttccaaccagaattgccggtcgtgtacatagcgttgtgaatcgagataggcacgatcctcggcaataaaatcgagataggaaggaggggtttctggtagtgcctcttctctgattaagtgacgataagtgttggcaagatcttcgggaattaaccctaaactcgtggcatcgccgatcagatgatgacaacaaaaatgccagtaccagcgtgtatcactgacttgcagcagttcgcagcgccatagctccccatataactcgaacggacgcatgaaagtagcgcgtatgtgttgtgcggcttgggcttctgcgtcggcatgatgtgagaagtcgtgggttgtcacggataccggaagcgtgtccataagttcctgaagcggcagtttctgggtattgatgagtcgtaaacgtaatgcgtcatgacgataaacaatggcttcaaaggcgcgcactaacagtgtttcatccagctttccatcaatgacgacaagtgaagcgagattgtagctgggactgtcaggatggagaatttggtcaagccagacaacttgttgggtagagctgagcgaaaatttgcaagaggaggattcagaggaactttcaaacgcaagctgatctttgttgatacgattgcatgacataggcattacttaactcctgctcgctaggctaatagatggaatgtgagttatgtgatgttgctggacattgaaaaatgagttatttcataagcagatactttatttttttaatcccacttataaaagagttagaattcatttatttttgataagtatcattaaaattactggtggtttggtcgtgatggattggatactgaggtatcattgctgtcagtatgtgtggtaattatttaatcacgttaaggtatttataaaatcagcgttattacagtaataacagagaatgaaaaaaggtatattgttatgattatatttaataaaattataactttatttaaaagttattaactgtatttatttattctatcaatatttcacatggctaatttttataataagatcattatttattatttattatttattatttattatttattatttattatttattatttattatttattatttgttatttgttatttgttatttgttatttgttatttgttatttgttatttgttatttgttatttgttatttgttatttgttatttgttatttgttatttgttatttgttatttgcccttggtttaatattttattcaacattttcaaagggaatttctttgtgttcatctacagttattaaaaattaactttcgttttctttatgtgattattattgttttatgctacatttgaaaataatataaaatgaaactaaaatactatgattgcaattactttattataactgaaaattatatattaatataaagatgcgtgagttaaatcacaaactaaaatgttattattaataataatcattgtcctcttattaataatttaaatggaaggttgtaatgtctgatattattgtaacccaaagtaataaagaaaaaatgtggtgggaagaagatgctggtttctttggggaactatataaagaagcggatgattcaacgcggactttttttggaggagaaaataatttagtacaaagaacaaataaagaggttgacggagttattaatttatgtggtcttaaatcagggcagtatcttatcgattgtccctgtggatatggaaggcacagtgttgctcttagagaaaagggtataaatgttatcggaatagatgtcaatgacgagcacttatctattgcacgtaggcatgccgaagtacataattcagatgtgattttcagaaaagatgatatgcgtacattcaaattggaaagacaagtggatgtgctaataaatatgttttattcttttggttttttttccgatgaagaaaatgttaatgccgcaaggaatttttatgatgcattgaaagagggcggtaaattccttatgcacacaatgataacagttcctgcattcggagatggtagaattccgttggaagaaaaaagaaaattgcaatcagggaggactttagtttcaaaacgaagattcaatcatataacaaaaagagaagaggggatatggtctttattaaacgaaaataatgaagaaatttctttgaggccatatgatgtgaggatttatactgatattgaattcaaagcgctttgtcttgaagctggattttctaaagtcgaattatatggggattgggatggttctccatacaatgacaattcgacttatttaattgtggttgctgaaaaataaaatgttaaatgtctttttttaatacatgtattttataaataataatatatataaaatcagttaccctcgttgacaagtttaaggttttttactgcattgatgatgttttttatcatattttatctgaaaaatattcagtagaaatatgaaaatgaaattcaaaaaatattttctaatgcaggttctatgggggtaacttttttcttttgtttgagttactttattcttgcctgaacgcaagttagttgttgtgatatcctcccgaggaagatcacctgactggaaagacgtttactcagcgtactcgagtaaaaagactgaatagaaaaactatcagttattcaaaatccgaagaactaatgggatgggattcaacatctgctggagcgcgttcactggaatgtcgacgtcgcccgcgatattttgcggggctatgtgacagagcatttgggcgatgaacagaggatgctcattgtggatgaaaccggctttatcaaaaaaggcacacattctgtcggtgtgcaacgtcaatacagtggcaacacgcccggcacaaccgtatggcgtttggtgtgccagattgaacatgacgacatgaaagatctgaaagaatgggcagacacccagatccttaatcagccaaatgaataattggctttattttttaatttaaatcgcgtttttctgttgctgcatatgatgtagtcaaactacgatttccccgccgcttaagggcaattctgggaggtgaggtgagctttttcgacaatggtataggttgtcgtcgatgcacaattaggtggttctgtcgcaaaatgtcagagactatcatgccacaatggaatgtacggctgtagtacttagatgatggtgaagtagggtatgaaaatttcggataaatccctattttgctcatcataaaaagtggttatatttcccgcctaatcatttattttcctaattaaatataatgttttttctttttatatcagtccgttgctttctttaagaaaaaaagcaatgggctgatttttgtcattacgtgttgtcaatgtacatcaggacatggcactattttttgcttgaaaaatatactgcattaaacatgagcagcccattttatgcgcattggcgttggggcgggtttgattttttgggtcgcagggtgaaataacgaaaatgggaaaacgaaaaacgcattctatcggtctggcctgcttggtttcatttggggcacaggctgaaccatccactgaaccgcgtgctgatgagcagcctttcattcatcagtcatagcagcaacaggcacaacaacaaaaactggatgcccatccgccggatgtgcgtttgtcgtcaccattatcttcaccgttctctttggcgtttcctaaagaaaccccctgtttcctgatacagaaggtgaccgtctccggccgtgaagggcttccccattgggtgcctgtacagcgcttggccgatcttgccaaagatcactgcttgggcgtacggggcattaatcaagtaatgtcaaacctgcaaaaccgactgattgcccacggttgggtaaccacgcgagtcttagcacctgaacaggatttaagtcaaggcgaactgaaattgcgggttttaccgggaacggtgcggcatatccgttataccgatgattctgataaatacgcaacgctctatactgccatgccagcccgtgaaggaaagttactggatttgcgtgatattgaacaggggatggagaacctgcaacgtttacccaacgtccaggccagcatggaaatagtgccgggggaacagccgggagaaagtgacatcgtgattaagcgccagcagccccgtttctggcatatgggtgcctgggtcgataacagcggaactaaggccaccggacggacgcagggcgggctgatgttggcgctggataatccgacgtcactcagtgacttgttttatctctccatgacgcgtgatttggctttctccaatcgcaaaaactcgaccaattacagtgcacattattcagtgcccttgggctattcgcagtttgcgataacaggcagtagttacacctacgcacaaaccgtgccccagctcaatgaagaggcaaaatatcgcggccgtagccagagcctgaatgcgcagctaagccgggtattgcatcgcaatgcccgttccaaaacaaccctgacctatggaattaatctccgtcagacgcgtaatttcaccaaggatacggaaattgaaggccaaaagcgtcgcaccagtagctggaatttagggctcggccatcgccattatatcggtgcggcggtgctggataccggtattcgttaccagaaagggacccgctggtttggggcgctaccggcttatgaagagcggaatgaccgtgacagcgctgactatgcgacggcgcaatcggaaattatccagctttctgcttcgctcaacacgccctttacgctgggcgaccaacaatttcagcaccgtgtggagtatcagcgccagtggagtaataccccactgacgccacaagatcagttcagtatcggcaaccgctggagtgtgcgcggctttgatggcgaacggacgctgagtgcagataaaggctggacgttgcgtaataccttgtcatggcagacgccgttgcctgatcagcagttgtatctgggggcggattatggccgggtcgggggacggggggcggatatcatcatcggccgtacgttggcggggggcgttctcggcttcaggggtaatattcgtcccgctaatctttcatacgatgtttcggtgggtacgccgttctccaaaccggatggctttaaaactgacaacgctcacataggttttagcctgaactggcagtactgaaggagtcaaatcatgttgataggtcaatacgacgtgcgtgcccccctgattttaggcagtgaagagaatgaaaccgagatgctgggtgcagctacttggttgtggatgcattcccccctgcaccggaatgcaccgctgattgcgttatctacgcttttgctgccgatgattaaggcgggtcagtatgtcctggtgagtcatcacggccagccgattttctacctgagctgggcgctgtttaccgaagaaaccgaattacgttatctcacgaaacgacatgagcacaacagagatccgcagctacacggcggtgatcggctctggatactggactggattgccccgtttggccatagccgggaaatgagcagtctggtcaggcaagaactatttttacatcactgttatcgtgccctgtatcacaaagggactcagcggggcgcgcaggttatccgttttagagggaaaggcgtcagccgcgagcaggccgcgcactggtggaacacccatcccctcacacagtccttacccgaaagaggtttttcgcgatgaacaaacattgttaccgagtgattttcaataaaacccgccagatgctgatggtggtttccgacctggcccgcagtcacacgccggggcaggcgcgtcgtggaatgcattcatgttcatcgcagactgccaacgtttcattgataccgctggtctgggggatctcactggcattgggactggtcagccaaacggcgcaggcaggcattgtggcggataataacgcccccggtacgcaacagccgaccgtgatttctgcggccaatggtgttcctcaagtcaatattcagacaccgaacagtgatggtgtttcccgcaaccagtacagtcagtttgatgtggagcagcggggcgcgatccttaataacagtggcgtgaatacccggactgatctgggtggtctgattacggctaacccctggctggctcagggggaagccaacattattttaaatgaagtcaacagccgtgatcccagccaactgaacggctttattgaagtggcgggaaaacgggcggatgtgattattgccaacccggcgggaattacctgtaacgggtgtggttttatcaatgccagtcaaacgacactggccgccggtcagacaatattggaaaacggccgtctgaaaggatttgaagtgggtgacggtaccctgaccgttgacggtaagggcctgaatgataccacgagtgattatacccgcctgattgcccgtgccgtcaatatcaatgccaaattgcacgcgcaggatttgactgtaacaaccggccgtaaccgcgtcgatgcacaaggtaacgtggaaaaagttcacgccaaggatactgaaaaacgggaattcagccttgatgtggcggcggttggcggaatgtatgccaataaaattaagctggtcggcaccgagcagggagtgggtgtccgtaatgccgggcagctgggtgcacaggccggtaacctgacgctcgatacacagggcaatctgactaatagcggtatgatgacgacttccgcagaggtggctatccagaatcaggggacgctaactaatcagggggatattaaagcgggtcagagtataaaaattcaaacccgtgatgcccttgaaaatcaagggcggatgctggcaggacggcacctcgatatccaaagtgcctcattagagaacaaggaaaagggcgtattagccgcaggcgttgacaaagacggtaaactgactcaacagggtaacttgacgatccacagtcgtggcgcactggctaatcaagggatgatggcggcttcggataatatgattatccagaataagagcggtttggccaatcagggacaaatactggcagggagcaataaacatggcaatctgacgctccacagtgagggtaaactcgacaacagcggtacgataaatgcttcagtggatgtctttcttcagaatcagggggagttagataacgttggggagattacttcaggtcgtgacgtcacgataaaggcacgtgatcatctcactaatcaagggaaaatatcagcaggacggaatcttgacatcacaagtgcctcgttaaacaaccagaaaaatggggtgctggcagcaggcattggccgtcatgataaattgactccgccgggcaatgtggtgctccgtagtgatggtcacctgattaatcggggggttatcaccgcgacaggcaatatcacactcccgactcatgataatttagttcagggcaatttagtcaaccagggagatattacggcggggcaggatatttcaatagaaaaccgtaatcatctcgacaatcagggacagatgctggccggacgtcaacttgatatccacagtgcctcattggaaaaccaacaaaagggaatactggcaaggcaatcgcatctaaatttgatgcgctttgcccagtactgtaagtagatattcaccatcccaaccagcccgtttacggcgtgctttaattcccgctttggtgggagctaagcgcagtaaattcaacgcgattttattgagtaatgccatattggcggctgcattgccttcccgcatccgctgctgatcttcattaaaagcaatatccagacaccaatggagttgcgtttctatttgccagtgactgcggatcgctgtcgctgcccgttgagcctctgtcggacgtaaggtgctgataaaataacagctctcccggctcacttcatttcctacatagcgttcgcggatcacccgtattatgctgtgtaaaccacaccagcacgccttttccggcaaccaatcaacatgggtcatttgtactgtgcgtcgctcaatgcggccatgtccggcatccacgtcttcatattcgctcaggcgctccggttgggatgagacataatcgaaataatggctgacatcattatacaggccgggatgattttctttcaggctcagtacgtaatccgcgcccgcttcatgtaattgatgagcaatcgctttctggcatcccatggcatcgatagtcaccagacttccagacaaaaccaatcgtcgaagtaactcaggaatagcggtgatttcattggatttactctccactttcacttgtcccagaactaagcgattggtacaggcaaaggcgctgaccagatggattgccgccttgccgttggctttatcgagtgaccggcgcatggttttgccatcaatagcgatgatatcctgatcaactccttgtgccagcgtagatatccaggaggtgaaacagtcggcaaaagcctgcgcatcaagtgcagcaaagacacgaccaaaggtatcgtgagaggggatgccattagtgagatcaagcagttgggtaaagaaatcctgtttagattcgccaaactcttcaatttcgacccaaccttcagcgccacaaatcacagcgcagatggcgatagtcaggatattttccaaactatgcaactgagttcgttgaactcggggatcttcaagtgaggcaaaatgcggtaacaaagggctgacagaggacataaggatggatttaaaagctgcataacgacatgaaattaaaccattgtcaatgaattttagatgcgattgccctgggaatactggcggcaggggttgacagtcaaggcaaactgattcaatcgggtagtctggctatccgcagtaacggtaagctcaccaaccggggggtgatcaccgcttcggatgatgtaatcctccaaaatcagggggatttaaccaaccaaggggatatcaccgtaggtcaggacgtcacgatcaaaacccgtgatcactttgacaaccaaggccggatattggccgggcgtcatcttgacagccaaagtgcctcgttgcacagcgggacagacagtgtcctgtccgcaggcgttgataaatacggcaaactgacccaaaacggcaatctgacactgaaagcccgtgaagcagcacaactgtatggtcagaatctggcccatgacaatttatctgtcgacgcaaaaaatatcgcccttcagggcagccaaacggccgccggtaacctgcaactgacgtccggtacgcaattaaacttacaggacgcgaaagtccgtgcccgccaaaatctgacgttatctgcacccgaactgattgataaccaacgcggtgaattggaggcggaaacgctgtccctcaccagccgaaagctgaagaataatcagggtaagatcacccaaaccggacagttatcgttggtacttgatcatcacgccggcattgacaacaccgaaggggtgattgcgtccagcgggcaggatttgatgctcagggccagtactctcacgagtgaaaaaggcgtattgacccatgccggaacgggggtgatgtccattgatacgcaacagtttcagggtaagaaaagtcgcctgatctctgacggtgaacttaagctgacgggagggaattatcatttggttaagagccggacatccgcacagcagatcacggcgcatatccagtcacttgaccatcgcttgggtgacatgacccagcacggaaaacgttcactgacgctcgatgtccagcaagagctggataacggcagtggcaccattgctgccaacggcacggtggaaatcacggctgacagactgaataacaatacgctgacggaaaaccagcttaataacgataaagatcaacagaacaaaggggttttggataaagccgaactgaataaccagccgggtaaaatcattgccgctgaagacggtcatcttcaggtgaccgtgaaaaatccgctgaacaatcaggccgggcaattactggcctcgaaaagtctggtcgtttcggcctcagcgatagataaccggcaggggaagataacgtcttctggcggggatattaccctgacaaccgggcaactggacaatctctcgggcaaaatcgccggacagcaccatctgcaactgaacacacaaagtatcaacaacgaaaaaggtcacatgagtgcggatacggtggatatcaacacgcatcaacaagggctgaataataccgcagggctgattgtggctgagcgcaatatgatcctgcgtaccggcgaattactgaaccggcaggggtcggtacgcagcggacaggatctgaccctcaatacccacggcaatcagctggataaccgggacagtggcctgcaagggggcttgttcagtcagggcgcgatgcacctgaatactggctatctgaataaccagtccggtcatattgaaagccgcgaaagcctctctgtcaccgggaaaaatgttgccaaccaacaaggccagatactgggcggaaagggaacgcgcctcaccgtggccgatctgaacaacgatcagggtttgctgcaaagtggcggcaagctgacactcaaaacgacagccttgagtaaccgccagaatcgcgacaagcaaggtataaccagtaagcaggcactggaactggagacgggcaccctgaataacgaaaacggggtgattatctcggcggacagtctgcatattcaggttaatgccgccggcgtgaataaccaacaggggttactggcggcacacaccatgctcacgctggtcggtctgggactcagtaaccaatccggccgtattcaatcccatcaggctttatgggttgatacgcaagggcagacactcaataacaccggtggcgtgattgacagtcaggatgcgctggacgttcgcagcggcgatctgctcaaccagaacggcacactgcatggcaagtccgccgtgacattaacggccaaacatctggataaccggcatcagggcaagatcctgagtgaaaacggactggttattgaggcggatgacctctcgaatgaacagggccggatgctggcgctgggtgattttcaggcgaaggtcaaaaatcatattgataacaaggcgggattgatacgcagtgggggtgatctccgtttaaacgcgcagcacctcagcaaccaggcgacccgacaacaggataaaggcattgacggcagaaatatcgtggttacggcggagacactgcacaacaggcaggggcaactgaccgccactgaaaatgcggatttgacgctgtcttcaagactcgacaacacgcaggggctgttacaggccaaccagaaattgacagcacagggtcaaacactggcggtcacgaataccgggggggatatcaaaaccgggcaagcgctggggatggaagcggactcactgacgggggacggtaagctgcgttcgctgggcgatatgacgctgaccctgcttaaggactttacccataccggtgaaacgattgccaatggccgtctggtgctggatagccggggtgacatcatcaataacagcctgatcagtgcaggcactctggaaggccgtgcagccaatctgaccaacgaggtgaccgggaagattctggctaatcatcatcaatggaccattaaggacaacctcaacaacaccgggttgttagatggtgcacaaacctacctgaaagccgcccatttgaccaatcagggaaccggccgcatttacggtgatcatatcgcgattgaggcggtcagtctggataatctggctgaaaataataaatctgctgtgattgctgcccgtaatcgtcttgatatcggcacagatgaactcaataacaaaacccacagcctgatctacagtgacggtgatttatctattggtgggcagctcgacagccagcgacacgccagcggccaagggaaaaccctcaacaaccacagtgccagtattgaagccacgggcgatatgaggctggcgatggcgaacatcaataacctcaacgaccattttgagactgaactccggccaatctcgcaggaatccgttgaggaatatcaggtttgggggcaacgttataatgtcaaaaatcacaagatcactatcgacaatgatgaggttgatcacgcctgtattgataatatagggtgtgaggatgaatttcagatttataaatacacgagaacgacagaggaatcccgtgtaaaaacgactgatccggcaaaaattctggcagggaaaaacctaaccgttgataccacggtgctgacgaacgataaaagtcaggtggtagcgggaggattactgacggtgacgggcgggcaaatcaataatacggatgtacagggtgaacggcagactaccgataaggggcatatcgagtatttctggcgtatcaataaaaaaggcagtgatgatcagggttgggattcagacaaatatgaaccccctacggaaattcaggcgattaccctgaaacccagtaccgtacaggcacagcagaaccgtgtcgtgctgaagggtcagcgccctggtgcctatcagggcgctgacatacaaattacgccggtgaacaacggtcaaattgatgccggttttgccagtagtgaagccagcatccccgaaattgcccagaggccggggcagcgcctagaggtcgtgagccagcagcctgcggcaatcggtgaaaaaccgtcggtgatccgcacggaagtgccgaattaccgtttgccggacaacagtctgtttaaattgaacctgcctgcggaaataaagccacacccagcaaacagtcagttaaaaccgtatccggtacagggtaatgatctactcaagtcgcccccggataatcaccctccggcccccgacaatagcgtgttgattgaaaccgacccgcagtttacccagcttaaaaaatggctgggtacggattatatgcagcagtcgatgctgagtgatcataataacatgcataaacgtttgggtggcggtttctatgaacaacgcctgatacgtgagcagattatcaacctgacgggcaaacgctatctgccgggacaccagaatgatgaagagcagtttaagtcactgatgaatgcaggcctgcgtgcccggaaagcctttgatttggctccggggatcgcactcagtgcggaacagatgtcgacgctcactgaagacatggtgtggttggtcaatattccggtcacgttaccggatggccgtcaacaaaccgtactggtcccccaggtctatgtgcgcactcaggccggatcgctggatggcagtggtgcgttgttaagtggcagccaggttaatctgcaattgacgggggatttactcaatcaaggccgggttgtcggacaggatattcatgtgctggctgacaatatccgtaatcagggcagccatttgcaaggggatacattgtccttacaggcgcgaaccgatatggtccagcgcggcggcacggtcagggcgaaagatttcctggctattcaggcgggcaacaacattgatatcgccagtaccacgcgttctggcgaaaatcaggcaggcaatggccgtttcagctccacctatgtagataacgtggcgggtatttatgtgcaaggtgctgatggcaaactacaccttcaggcaggtaacgacatcagcctgtcagcggcgcaactcgctacgcaggggaaaaacagcgacatccggttggcggcggggcggaatattcagctcggttcggtcaaaacagcccgttatgaacatacggcaatcggcgatgaccaccgtattacccgcagccagtcggggggcgtgggttcgggggtcaatagtgccggacaaattcaggtagccgcagggcgtgatgtcaacgcgaaagcggctgaggtgacggcgggcagtgcactgcaagtcagtgccgggcgtgatgtcaatattctggccgatgagcaacagcagagccatgatgaatatcaccgggtggagggcagcaacagtctggtatcatcaaaaaccacgataactcagtatcagtttgaccataagcaggcactgagcagtaccctgagtggcgataccgtcaatgttcaggccggaaaagacatcaccgtagcgggcagcaacgtcgtggggacgcacgatatcacgatgagtgccggtgacaacctgaccgccaccacggccagggaaacccatcacgagactcaccgtaaagaagaaaaacaatcggggctgatgggcacgggggggataggttttaccgtgggggcggcggagtttaaacagtccaatgacagcgatgaggtgcggtataaaggcagcacggtgggcagcagtgggggaaacgtcaccctgacggccaaaaatcaggctatcttgcacggcagtgatgtgatggccggaaaagatatcgacattgaggcaaaagacgttgccattacggcggcgaaaaacagccatacctacctgagtaaaactgaacagaaacagtcgggctttacgctggggctgtccggcgcggtgggcagtgcgattgacacggcggtgaagaccgcgaatgaagccaaagaaacgaccggcgacagccggttgcaggcgctgaaaggcacgcaggcggtgctgtccggggcgcagggttatcaggcgtaccagctcagcgaggcgaattccgccaaagctgacgccatcaatcaggccgggggcgatgcgaaaaaaccgaatgacaccatcggtattcagctttcctatggcagtcagtccgcgaaatccgaaacccgccatgacgccagcgaatcgcagggcagcagcctgaacgccggacgggatattcgtatcacagcgaccggagataatgtgacggacagccgcggggatatccggattgagggcagtggcctgaaagccgggcgcgatgttgaactggacgcgaaacgggatgttgtgctgacgtcagcggaaaatacccagacgacgcggggtgaaaacagcagcaagggcggcagcgtgggtgtggggctgacggtgggtcagggcggctacgggattaaattctcggccagtgtcaatgcgggcaaaggccatgaaaaaggcgatggtgtcacccacagcgaaaccctgattgatgccggtaatcaggtgaacatcaaatcggggcaggacaccctgcttaaaggcgcgcaggtcagtggcgaaagcgtcacggcaaacatcggccgcaatctgcatctgcaaagtgagcaggacaaggatagctacgacagtaaacaggaaaacatcagcgcgggggccagcttcacctatggttccatgagtggttcagccagcgtcaatgccggccgtgacaaaatgcacagtcagtttgactcggtcaacgagcagacgggcatttttgccggtaaaggcgggtttgatgtcaaggtgggcgaacatacccaactggatggcgcggtgattgccagtaccgccgacaaagacaagaaccgtctggaaacaggcacactcggcttcagtgatattgagaacaaggcagaataccagactgaacaccagagtgtgggcatcagtaccggcggatcaatggggagccagatgggcaccaatatggcctccaatatgctggccggcacccacaagagtgacagtcaatcgtcaacgactcatgcggctgtgggtgacggtacgattattgtgcgtgatgcggataagcaaaaacaggctgtttcagacctgagccgtgataccgataacgccgccaatggtttgaatccgattttcgataaggaaaaagagcagcaacggctggcgcaggcgattgccaatatcggcacccaggtgttggatatctacaatacgcaggaggctatcactgcgacgaagaaagccaccgaaaaactgaaagaccggcaagagcagcaggcgctgaaacagcaggccgaagctcagttgaaagcggaagctgaacgtaaaaatgatagccgtccggttaccgaagcggacattgccgaccgggcgtataaaatcgcctatgacacggcgctgactaaacagggggcggcgattggcggcagccaacgtcaggcggttaccgcagtagtcacagcgcttcaggggctcgctggcggtgacatcaaagcggctattgccagcggtgccgcgccttatctggccaatgcagtgaaagtgctgacctacggcaataaaaagtatgggcaactgacagcagaagaaaaagcgaccaatctggtggcccatgcgattttgggtggcgtgattgctgagatgaaagggggctctgctatggcggcttcggcgatagccagtgcgctttacccagccaaaaatctgagtgaattgtcaccggatgagaaggaaaaagtcagtaacctgtctacactggcaggagggatagcggcagggctggcgacggattcaatggcaggtggtgttgccggtgcgcagaccgcgaagaacgcggtggagaataacttcttgggggatatctcacgcgacgcactggagaaaaaccgggaagcgctgggtgagaataaatacactgagaaacagttgcgtgaattgctggcacttgaggcccgtgaccaagttaacgatgacctgctgaaccagtaccggaaaaatcccgcgtccctgacgccagagcagcaacagctattccagcgggaattgcagcagtatgcctatgaaacaacccaactgtacggcgctgaaatggcggtgcagttggttacgttgttgttgaaagaaggggactcgccgcttattccgaacaaaggcttcccgtatgcgggtggctcggaggcgaagaatgcctgggcggatcgggaaaggcagcagtagtcacaccatactaggctgacaacctgccggccattagtaaattgggatgcgttgacgtcactcacgaaagccgccgcaatcaggggaccaacaccgggaatagtcagcaagtgcccataccctgcttgctggcgggaaagtgccgtaatttcgttatccatttcatgaatgctgacgttcaaattctgcagatcttcccacagcgtatgcaataaacgacgcagcacacaagacagagcattatcaccttcttccagaatatcagggaggtgctgttggagtttttgaatccccacaggcacaatgattccctgctcagcgagaaaggccctgatttgattagcaatagcagtacgctgttccaccatgagctgacgggcacggcgcagtgctttgatatcttgctgttctacggttttgatgggaacaaaatggagaccgggccggcaggccgtttcaccgatagccaacgcattattggcatcgtttttttgatgatggctgaaagcttttacatgctgggtgggaacaattcggacatgatagcccatagactgcaacgtccgtccccaaaaatgagaagtggcacaggcttccatagcgatgagggtttcaggtgggaaagtccgtagggtatcaagaaatttttcggttcgaagcaacagaaccgtcttccatccagacacaaacttgaaagacatttttagcgaggtcaatacccaccactttgatcgtactcataagatgttctcccgaaattcagtgcatcggataaaagatggcactattttccactgaaaaagggggcgtccatcacatcaacccatcgtaaacccatcgtacttttcccccgtttcgctaccccgtcaaaaactttatggcatggaatacgaatattatggcaaacacggagatgagtagaatcgataaaagcgagtcctgtgggttttccttttagatgggtcaaatagctacaaagaggaactaaaacagaggcagccatcccgataaaacgggtgtaactgagtaaaaccggaaaatcgttgcggtggtattgccaaatgagtcccaaataaaatgttttaaaactacggtgatttgacatatgaaaaaaaatcagaatggtcatgatctcactgacactcatgcgcccatgacggcggcgttgtctgtgtccgttctcgatacactgttgttcccactgaggaatgaaaatacgacaaaaatcgtcgacatcgcaaaaaagttcaactaatttatccatgcccgttccttattagatcgtttttttcttggtcgaaaattctgatcttggaacaggcacttagttcaattttttatccagaattcaggtgaattatgtactcaatttgtacacaatggcaagtgaacgagtcagctacaaccaaaaacgaacagggacaaaacgaaacaaataaaggcaaaaaacttgattaaaacaggcagaaagagataagatacaaacagttcgaaacaaactgaaacagaatagtaaaaagtccccttagttaaatggatataacgagcccctcctaagggctagttgtaggttcgattcctgcaggggacgccatacatgactaaacctacctaaacaaccacacttaaaaccccagaatatcaagcaatcatactaaacccacctaaatcgaactaaactggaataaaccccattgcgggggtattatcgggggtagggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccctactttggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataaacgggggaattcgtgacaccgctcggatcctgaaagtcgccaccgccaccgtcatgaaaacattaaaaacctcagactccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttacgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgacctgaattatcgtatttaggtataaggtatatattagaattccagtcgctacgtctcactggtttattcaaatacacttgaatcactgcccacggaaaagaacctacaggtgctacatcatccacctcaatcttcttcttatattggtcaggattaaatgagcattttttaccaatattatccagcttattaattttagacataaatccctcactttattattcgttaaaggtcatttcatcttactgctaaattgccagtcaatattacttaggatggttttttatatcaattgaataccgtatagcaaaattaatacgcatttaaatagggttgcgcattataaaatctgtctattagtcgagtacgtgattcagggagctgtcaatttgaagtttgctgctgattacaaataccctttattgaatacagggcaataaaaaacccacctattaagtgggttaatttattacttacaattctggcaagatatcagaattaattaaaatacggctgatttcggacacttttgcaagttttatagatcatggtctgatttttgtttaattcttaatctgatgatatcttggagtgcttctctatccatgttttcgcataactccaccaaggctatccaatgtgccgcataattatttttccaattgtataaactcaccccagtcaagctggccaattctgatctggtataagataagaaattctctgaacgacaccccttggcacgttgctgaacggccaaccataccaatccttttaatctcgtgctgactttgattgataaccgacggtttgtttgccctgccagaaagcctccccagagatattcgcatatttcaacctgatagcgataatccagggaatgtgcataacagtacagcacccatgccagtttgggtttatccatggccagtactgcccgccgccacgaactccccctgtatgttatcgggttaataggcggtttgggctgttttctcatgcgggtttcaagacaaaaaaccggatcggtatcctgtacgacccagtgatttcctaccctaatacgggctttattgcgcttatagtgatctgtacatgtcagtggagagtcttcaaatgccgccaattgccccttggtttcaccggcaatatcaaacaatgcggggataatctgcgagcgtacgtattgcaagtcatgcgaataccattttgtcattatttgattgcccctattcccagcgatctgtccagaaaacgaaataataaatccacctggctaccgtgtttttcttcccatgccagcctgtcccgatgcaggtcgtcatgacattcccggcaaagtggcagacaaaacaaatcatgcgccttagtacccatcccgccctgcccatgaccgataatgtggtggggatcatcggcaggacgctgacaggccgcacagggctgggatttcacccattgcagccattgggtattgcgccaccgttgtaattttggcaaacgcataaagctggcgggcggttcagcgtcaacctctgaccaacctgggaaaaccgactttaagatagtgtttgacatgctgaatataaaacgttttaaaatcacgataatggctcatgtggaataaaatgaggagcgtcatcacttcactgagagaatccgctgaccttagatagtgattttggcggttggataaacagttattccgatcaaccgatcccgcttgaacagatggaagagtgacgaacgggtactatgcaacgaattgatgccctgtatccccgtcatttactggaaataggctgtggtacaggtttactgttatagaagaatcatattaatatggcataatatttcaattcaaatgacaggggataaagcgagatgagatacagtttggattttcgaaagtgagtactggcatacaaataagagtcatgggaggtgcttgattatcgataaaaggaatgactatttcggtcgtttggctatataactgtccccattctgaaaatgttatcggtaacaatgaaaaacccattcaggggatgaataatatcgcaaagacgatgactttattgatattattccactgcataattttctctttaagtaaagataaagtatgatgattttatcttctatcaatgaggtaaaaaagctgttatgaatattgtttggttaattttttgttaaataattttgtatgggttttcttgattgtttgcaaattatgaataaaataaaatgcctaattagattaaccaaaaaagcgatggtgactaaatgacaccacctgaagtgaaaacaaataaatgacaccaccaattagtgttatttttaataaaagcacatggcgtcgttgttgtatttattttggctctgtagtcgttaactccatttcatagtcactgacagggaactgcccataagtatcatgtaatagttgcttgcagctttcttgtttaatcaggtcgctaagttcacttaatcgtttttgcaacaatcgcttcgtttctttttcattatccaagacagtttgtaaaatttgggttaatttttgctgtaatgaaagtggggcgtctgaattttctgataatagggtaaccacttcaaccgccttcagataagtgatttccatatcaacaagttcatcccactgttcatttttagctaaatcaagcatttgctcacttaaactaaggatccgctggtaagctgacaaaagatccagatcatttttcattaaacaatatcctgactggcgttgtaatgaggacctatttgccgccaagaatctgaaatctcggtaagtaaatcaatcacttcggtaatggccttctcatcattgcgaaaattagcatggagtaaacgacgattcatataatcatataaagcaaacagattctgagcaatctctccgcctttttcgaaatctaatccctctttgagaccattatcaatgatattgattgccttggaaatagctaaacctttctctgggatattgccctgttgcatcagaataattgcacgacgtagggcgctaagcgccccattgaacaatatctgaatcaactgatagggagaggcattcataatttcgctctcaagatctacctgagcgtataactggcttgccgaacgttgatacataatgtccttttattatcttaaaagctggaatagggatgaacttgtgctcttcaatgaattaacaagtttatccagttctgtaaattgacgtttatagcgttctattgttgcatcaatatttttattggtctgttccacttgtctttcaagtgttttcagacgcttgttgatgccttcggtcgctgtggcgatagtcccttcgtgactatccagcgtttgctttaatatattataagtttgggttgcgaaaccggttttttcaccatcacccatgaagaaagccttaacgttggcaggtttctctttcaggtttttttccagtttttcgttgctgatttcgagagtgccgtctaatttttgtttgatacccaatttattcagggtagcaatatcagcaacatcctgtggtgagaaaatctggtgcctcaattggctttgaatactttttaaggtgccgtcaccgagcagggcgccattgtctttggaagcggattcacctttggctacaggcttgaatttggtcagtgattcgaaagtcgtctgtaccccattataggcttcaacccactttttaatcgcttctttcgttggctcaatatcacgggaaaccaccagtgtttctggttttggttttccagactcatctttttctgtgagctttttcagattcagagtaatgccttccggcgcatcttttatctcattggtctgacgttcaatctcaatgccattgacctttaattttgcatctgcggcttccactgtttgcgtcattgcaccggagccacttttagggacactttcgctaccagacgtgtaattcagccacttactcagtttgtcatcaccttcaactttgattgtcatgacggactgtattcctgcttttttcgacgtcaggatcaggtagtttttattctcgcctttattgtctttattgtctttattgtcggttgctttgatgatgctggcattaacgttgccttcctgtttattgatcgcatcacggatttcaatcagagacgtttcatcatctttcagggaaatacgcagcggcttttcttcacccggctgggtgatgacaatggtgcgggttttcccttcgcccagtttctctccttgcgggaatttcacatcggaaaccgcaggggattggagggactgtgccttagcaagctgattgatttcaataatatagttacccggactagccttggaatccgtagttggggtaaatgttttatggtcttcgctgactttggtggtattgagcttatcgaattttttcagttcttcggatgcgcttttaagtttctctaaactgccttttaatgtgccaaaaccggttaatttggctttatagctggtttgctgctgtgctaatggttctaaacgttttctttctgctgcctgaagtttatccagtatagaacctaaatccatcccggatccggctcctaatgaagaaatgctagccatgttgactcctttattagtaaagcatcactgggtatgttatcggattaatttgcgaaaagtttactgacaaaatgatttttttgatggacggaataattgacgagaacaggcgctgtttgggttatcggcaagaaaagtgcgaaaaaagaaaaaagtttttcaataaaaattaaaggttctttttaaggagccgataaaactgttggcggtgatgaacaccgtgagcgaaaaagctcaaactaattatatcgacttgattttaaaaaggaactctactatggcatcagttattaataccaactattcatctctgctggctcagaacaacttaagcaaatcccaaggtgttttaggtactgctattgagcgtctgtcctctggtttacgtattaacagcgcgaaggatgacgctgctggtcaagcgatcgctaaccgttttactgcgaacgttaaaggtctgactcaggctgcccgtaacgctaacgacggtatctctattgcccaaacgaccgaaggttctctgaacgaaatcaacaacaatctgcaacgtattcgtgaactggctgttcaggcccaaaacggcactaactctgaaagtgaccggaaatccattcaggaagaagtcactaagcgtctggatgaaatcaatcgtatttctgaacaaactcagtttaatggagtaaaagtattaagcaaagatactactctgaacattcaggttggtgctaacgatggtgaaaaaatcgctatcgacctgaagaaaattgataaggaaacattaaaactgggtgattttagcgttgaattacaaagaactagtgaggaaaaaacgaaaattacagaggctgaaggtaaagtaaaaaaggctgaagaggacgcgaaaaaagcaacaggtgctgcaaaaactgcggcagaagcaacgcttaaaacagagcaagcagctcttgaaaaagcaaaagaagcaggggcattaccagcagatacattggctaaattagatggcgctttgtctacagttgacagcctgcgcagctccctaggtgcagttcaaaaccgtctggaatccactgttaacaacctgaacaacacggttaacaacctgagtgcagcgaagagtcgtatcgaagacgctgactacgcaactgaagtttccaacatgagccgtggccagatcctgcaacaggcgggtacttctgttctggctcaggctaatcaggttccacaatctgttctgtctctgctgcgttaatttttatttcccagttgagagtttatgcaggacaccctgcataaataatctctaaaaaataaggatcggcttgccgatccttattttttaacctttgtcagggacagactgaaacttacgatgcatttgggcggacgacaaaaaaatttcgcataggtgaaaaagaagcgcttttacttcattgttcaaacgattgtaccgattaggtgattggataatggtagccagtctcttatccaaaggtgtctgttgttgtgagcgatttgtataccgccgaaggcgtgatggacaaaaatagcctctggaagcgctatgtaccactagttcgccatgaagcattgaggctacaggtgaggctgcctgccagcgtggagcttgatgatctgcttcaggctggtggtataggcttactgaatgcggtggagcgttttgattccttgcagggaaccgcgtttaccacctatgcggtacagcgcatcagaggtgcaatgttggatgagttgaggagccgtgattgggctccgcgtagtgtgcggcgtaatgcacgtgaagtcacgcagaccatccgtaaacttgagcaagagttaggccgtccagctagtgagcaggaagttgctaaagaattaaagattaatctgatagaatatcggcaaatactgttagacacaaataacagtcaactgttttcttatgacgagtggcacgaaattcatggcgaaagctgtgagccggtaattgaggacgagcatgagacaaatcctctccaacaattgctggaaggtgatcttcgtcagcgggttatcgatgtcattgagtcgctgcctgaacgggaaaaaatggttctgacgctgtactatcaggaagaactgaatcttaaagagattggcgcagtacttaatgtgggagaatcccgcgtgagtcagcttcacagccaggcaataaaacggctgagggcgcgtttgaatccagaaaagtaactttttgcttatttgttttttgttaagttaagactacacacagggctttatttcttatgtctgttacaacacaaaagaaacggcctctcagccgttatatcaaggactataaacatagtcagactcattgtttgcactgtcataaaacccttgaccgtatttctctcgtttttaacggtcaggtaatcaacaaggaagctatctctgagatgactgaattagttgatgacaaaacatgggatgagttacagggtaaatttgtggcgctgtgccgcttctgtagcgaaatttattgcaatagccaaactgattatttcgacattatgtcatttaaacagtatctgtttgagcaaacagagatgagccatagcactgtgcgcgaatatgtggttcgtttgcggcgattggatgaattactaacatcaagcaattacccagcacaagagtttacgccggaaaaaattcaggaaaaactcagtgagaaattgtctcagtctgcttttagtaattacaatatcgcgctgcgtaaatatgagcaatatctgagctggcaacagaacgggtattgattaattacgtagagatataacgttatcagactgcacgattctagaggggaatgcgataataacgcattccccctatattttaattatatatttattagttatatatttataaccaaattatcttacccaattgtcattagactggcattaccccctgcggcggcagtattaatacttaatgagcgttcatgtaatagacgttccagtagcaggtttgtttcaccacgggcaaaaccctgtactgaaacaatcggccctttgcgttgagcgatgataccgcagacatgacgtagctggtcgcaatcaccgtgataaataacggcttccatttccgtctcttcattttgccaatcgttgatcagacgaattgagtggcgaacctcatccggcaattgacgcagtaattgctgatgcaaatcgtctttctcccagatggcctgacagccgacagacaacacggcagacaattgtaccaacgtatcttgctcattatcggccagacacaaaacttcaccgcgtggcaagagcgtataagtattgcgttcccctgtaggtcccggtagtaatcgaatggttccgccctgagctaacaggctgtatttctgaattaatttgctcaaagcatcgttatgttgtgctgttacccattcagccaatttgttgaaaggggagcgcagggcgacacgcgctctggcatcaagctgatattcctcatcctgacgttccagtgtctggctggcagcattgacgggacgctgtgataacagacgatacagataaagcggcccacccgcttttggcccggtgcctgacagaccttcgccaccaaatggctgtacaccgacgacagccccgaccatattgcggttgacatacaagttaccgactttagcgttggccgtgacttgtgcgatggtttcatcaatgcgcgtatgaacacctagcgttaatccgtaaccagaagcgttgatttgttccagcagtttatccagctcattacggttaaaacgcactacatgcagtacggggccgaaaacttctttctttaattcatcaaaattttccagctcaatcagcgtgggtttgacaaacgtgccttgtgaagattcctgactatcggcttcatttttatgtactgcttgataaaccggcctgcctttggtgcgcatggtctggatatggcgctcaatgccagcccttcgcttcggcatcaatcaccgggccgatatccgttgataagtgttcaggatttgctatccgacactcagccatggctcctttcagcatagtaagggttctttctgccacatcgtcttgtacgcacagaatacgcagagcggaacaacgctgacccgcactgtcaaaggccgacgcgaccacatcggtgacaacttgttccgtcagtgctgaggaatcgacaatcatggcattcagtccgcccgtctcggcgatcaatggcgttgggcgcccctgtgcatcaagacggccggcaatattgcgctgcaacaggctggcaacttcggtggagcctgtaaacatcacgccccgcacacgctcatcaccaaccagcaaagccccgacagtttccccttgaccaggcagcaattgcagcacatcacgcgggatacctgcctgatgcagcattttgactgcaacagcggcaattaatggcgtctgttccgctggttttgccaagacactattacctgccgccaatgctgcggcgatttggccagtgaaaatcgccatcgggaagttccacggactgatacaaactactggccctagtgggcgatgggtgtcattggcgaaatcctgccgaacttgatttgcgtaataatagagaaagtcaacggcttcacgcacttcagcgatggcattgttgaaggttttaccggattcacgaaccaaaatgccgagcagggattgcaggttattttccatcaattccgctgcacgcaccaaaatcgcggcgcgttctgaggggggagttgcaaaccaaatagtacctgcatcgatggcaacgtccagagcgtggctgacttcttgctcagtcgcttcacggacatagcccacgatatcggaaggccgcgcaggattattgacggatttagctgtcggcaattcgccggtatgtgcataatcaccacccagcagcggctcgctgttccatgtttccatcgaagagctcagtaatgcgctggagagtgaagccaaacggtgctcattcgacagatccagccccgaggaattgacgcggttcttgccgtataaatcatgtggtagtggaattttcggatgtggcagaccaatttgtccttcagattgtgcgagttcctgaactactttcaccggatcagcaacaagttcatcaaggggcagggaggtatctgcaatgcgattaacgaacgaagtattggcgccattttccaacaggcggcgaaccagataagccaatagtgtttcatgtgtcccgacaggcgcataaatgcgacatgggcggttgagcctgccatcggcaatcttgccgacaacctgctcatacagcggttcacccatgccgtgcagacactggaactcatattgtcccggataataattctgtccagccagatggtaaaccgcagatagagtatgcgcgttgtgggtcgcaaactgtggatagatcagattggggacggaaagcagtttacgggcgcaggcgatgtaagaaacgtcggtatacactttgcgggtatacaccgggtagccttccagaccatcaatttgggcacgtttgatttcactatcccaataagctcctttcaccagacggatcatcaagcgatggcggctgcgttgcgccaggtcgataatgctgtcaatcacaaaaggacagcgcttttggtaagcctgaataacaaaaccgataccgttccagccttccagttttggttcaaaacacaatttttccagcaaatcgagagagatttccagacgatctgcttcttctgcatcgatattgataccgatgtcatattgacaagcctgtaaagtcagagaaagcaggcgtggataaagctcatctatgacgcgttcatattgagcacggctataacgtggatgcagggctgacagcttaatggagatgcccggtccttcataaatgccgcggccgttcgatgccttaccaatggcgtggattgcctgttgataagaaaccatgtatgcctgtgcatcttcttctgtcagcgcagcttcacccagcatgtcatatgaatagcggaagcctttttcttccagcttgcgagcgttggcgagggcttgggcgatggtttcacctgtgacaaattgttctcccatcaggcgcatcgccatatcaacacctttgcgcaccaatggttcaccgctcttgctgataatgcggttcaaggacttggataatttggcttcattatgggtagataccagcttgcccgtgaacaacagaccccaagttgcggcattgacgaacatagatgggctttggccaagatgagaatgccaattaccgttgctgattttgtcacggatcagcgcatcacgggtcgctttgtcgggaatacgcagcagggcttcggcaagacacatcagcgcaacgccttcctgtgaagaaagggagaactcttgcagtaacccttgaactaaaccggcgcggccagtgccatgtttttgctggcgtagtttttcagcgatggagtaagcgagtttgtgggtcgctttggcttgttctcctgataattgagcacgttgcagcaacatgggaactgcctgcgtttcgggcagacgatacgctgaagtaattgcagaacgtttcaccgattggggcaaaatatgctcggcaaaatccaaaaatggttgagaagtcgcctcaatctgtgattcttcttcggaaatcttttcttctttgttatcctgaaacactgatatttctgggatcttttcctcattttccaggcgttcaagataattaaaaatggcttgcttaatcagccagtgtggtgtgcgttcaattcgttgtgcagcagattttatacgattacgcgttgcttcatcgagcttcacgcccatagtggtactacccattctcactccttaataggtaagacttaaccaagttacataacaatatctgtcatgttgcaactttgtgcaaccatgttaaaagcggccgttctaaatttgtgaaactaatcttgttttgattattttgttggtaaatattataacttgttagtatttatttaattgatatttaatggtttttattgttgtaattatggaggtgtaactgattctttaatgaaaggtacaacttctgaagtgataaatgtgacttagcgagcgtttctaagaaaaaacatcgttaattagttgttaaaaatgttttagctaatctaggatagaaagtgattttaaaataattacaaacataaattatacataccaaaattaatgccgctttaggtgaaatgatcttcaggtgcaacctggtaggcaagtgccttgtactgcaaatatattgcactgaaaacatatcatgttgaacaagagtggctttaagtacagataacattatttacgcaaataacacgatttgcagaaacactatggagaagaacctgcatgacagtaaattcaccaatgctaataactttcattgtctacatttccgcgatgctggtgataggctacatggcttatcgttccaccaaaaattttgatgactatatattgggtgggcggcgattgggcagtgtggtaacagcattatctgctggcgcttctgatatgagtggctggttattgatggggttgccgggcttgatttttttatctggaatttcaggtggttggatagcaatcggctgtttgatgggcgcttatttgaactggctctgggttgccggtcgattgcgcgtgcatactgaggtgaataacaacgcgttaaccttaccggattatttcacccatcgttttgaagacagcagtaaaatcctgcgcatcatttcagcgttggttattcttgttttctttaccatttattgtgcatctggtgtcgttgcgggtggtctgttattcgagagcacttttggtatcagctatgaaaaagcaatatggcttggggcactggcgactattggctataccttcctcgggggttttttggcagtaagctggacggataccgttcaggcaactctgatgatttttgccctgattttggtacccgtactaattttgttcaatgttggtgggtttgagaatgctatcgcggttattgaagcaaaacataccttctatctggatatgttcaagggattaaatgctatcgccattatctcgctattgggatggggatttggttatttcggccagcctcacatccttgcgcgttttatggctgcggactctcacaaaaccattcacaaagcccgtcgtatcagtatgacgtggatgtttctgtgccttgctggaaccgtagctgttggtttctttggcattgcctattttgagctgtacccagagcaggcggctcccgtattacaaaagaacgaacgtatctttatcgagttaggtacgctgttgttcaatccgtggattaccggtatcttgctgtcggcagtattggcggcagtgatgagtactttgagctgccagttattggtttgttctagtgcgttgacggaagatctctataaagcctttgtgcgcactaaagccagtcagaatgagttggtatgggttggccgtttgatggtgttgctggtggctgcgattgcgattgttattgcaaccaatccgaacaataaagtgctggctctggcaagtaatgcatgggctgggtttggtgcggcatttggccctgtagtactgatttcggtactttggaaacggatgacgcgcaatggtgcattgatcggtatgctggtgggagcgattacggtattggtatggatgcagtacaaatggttcgggctgtatgaaattattccaggttttatctttgcttctattgccattattggtgttagcctgttagggaaagcgccaagtcaggcaactcaacagcgttttgatgaggcggaagcccattataaaactaaataaaaaaatagactgtgataaaaagcctctgaacaatcagaggctttttaattagttgtttattataaattggttctttcataagtactggctctgtaattgtatcttatagaaagagggattattggtattggttcagaattaaaggtagcttgaatataagatggaggttctgagccatctgaattactatccatttgatttaaacgtgctggacaatattgtctggtataaaaaatccataaaaataagacggatcaaataatccacccttttgttcgatcataccaatacggctagtccataataacttattattctgtgtaatgattttatttaatcacctttagtcattaataagtattaatagtcataaatttaatttaatgcattgaatttaaatataaattcaatcaaagtttgtcaggtttaatcacggatagtcaaaggatatcatcttgcgtcatgacaagtatgtacatatcagtgtacataaactacattaaaagctgtattgttttttgaggaaggtgatatggcaattactgattcatggctgcgctctaccagtggcaagccccaagaaaaaatggttaccaaatcagacagagacggattatctattcgtgttactccgaaaggtaaagtgatttttcagttccggtatcgctgggatggaaaaggagatcgaattgacataggtacatatccagcgactagcctaaaagatgcgcgtgatgctgtgattttttaccgtggagaattagagcaacaccataaccctaaaatggttaagcgcgttcttcgcgagtccgtcttaaaggctgtgacagtggaaaggcttatccgagattggtgggaaacagcgatgaaaggagtgctagtgaaagcgaatgaaattttacgttcgttcgaattatatgtttttcccaaaatcggtaaattaccccatgatgaagtcactctccatatttggttagccttaattgaagatgttactaaacagcacccatcaattggggttcggatattgaataacaccaaaaatgcacatcggtgggctgtgcggagaggaatgactaaaatcacccctctatccgatgtattgatcagtgatttaggaagaaaaaaaaccaacaaagatgacagtacgttgagcgaagagagattaatagttctatttaaaattattgattcccctagttataatccacgtaatgcgttaataataaaactatgccttttatttggatgtcgtattggtgaattgctgaaagctaaagttaccgattttgactatgaaaaaaatatctggattatccctcccgaaaatcacaaaactggggctaaatcccaaaaacctattatcaggccaattgttctagaagccagggaattaattaaacaagcgaagacgctaaatcgcggaagcgaacatctatttatagtatccagtggtaaaccatttgcggaaggatcgcatcttcaaataattaattcactgaataaaaaaatgtctagttatttcgaacattataccccttggtcaatccacgacttgcgcaaaacaatgcgcacagggatttctgatctgacttcacctcatgtggccgagattatgctggggcacaaattaccgggagtatggcaggtgtacgataagcacacctacctgaatgagcagagagaagcatatgaacgctggtgggataagttgactaaaattgtttcccgccctcccagtcaagaatatcctgccgtagaaaattaagctggtcggataaaaatttaggttttgggaagccttttcttctttgcttcccattaccacaccacaacctgatagtatgtggttttacactgtatcgagctgccagttcctgagttttgatatanggtgactccgncatcatgcacctnctttctgataaccgntctccaaaccattttcgctactcccgcagtgtcgccttttcttccatgtcgcataaaaaatatgttgtttaacttcgttgttagaata

SEQ ID NO: 14973 - DNA, 112740 bp, Xenorhabdus bovienii
  unsure (1)..(112740): unsure at all n locations
  Genomic contig Name=Xb4151_4152.C432
gcatatgaattttcgggactagacctgaacccaaactgtaccgtataattctcccacttcactggccccttagctcagtggttagagcaggcgactcataatcgcttggtcgctggttcaagtccagcaggggccaccaaataaaacaaggagttagatgataaatcatctgactcttttttgttttatacgaatcgggtcaggtaatgggtcaggtaaggaattacctccctgccctcttcatctcgctgccagcatccccggatagtgcttcgccacaatatcattcatcttttctgtcagatcacaccgcttaaaagtgatgtgcgcggttcctttctgaaaataacggatactgaagaaaccatcttcgtagacatccttcgaagggttgtcccgaatatgctccatcaaccgtgtagtgacatcgccacggttgtcgggtatcggtttaccatccagcagaaacagcattcgctccaggtccgccagttgatcccgccgccaaccccagttcagactaaatccccagcgattgtgacttaccagattattgatgatgatcttcttaccgaagttgcagggactattggttttgtaatcccacgacaggcctttgaagacgttgatgatgccacgttcaaagacatccattttgttcagatgtagctgctcaaaagtactgaggatattcgcctcgctgatggcaggaaggtcgccctcctccaggttcttgtgccactggtcgcgagcctgtgcatccatcaaggccatcatgccggacttcagcatcaaatcgcaccagatactgcggtcaatattgcgggtgacggcaggcatcgctttatcaaccttctcagtcagccagctatcgtagcggtgcacggacttcatcgcccaatcttgcgctgtgccaccgccaatttctgaggttagccgtgaaatggcatcaagctgctgaataagttgttctatctgtttcagtgcggcatcgcggccagtgaccacacgttcgatattggtcgaaaggataagttcgttgtgatctgttaacacgtcgggttctgtttgcatcgttaatcgtccataaaagcaaacacgcctgccaggagtggcaggcgcattatgctctgaataaaaaaggtgggaagttcagaggtaacaatcaggaatgaggctcgaagaattcaggtatttattaagcccgttgctcgcctggctctgagaatatcggcggcggtcaggaacggcgtctgttcctgccaggtgaatcccttgcggtcgatgcgtaccagttcataacgttccacgagaaaattcaccgcatcagcaagagtgatacccgcctcgatatgttcctggatggctgaatcatcgtggaatggcgtgtcgttgagtgtgaggccgtaatggtgttccagtagatacgttaacagttgttgccacacttggacgggagacaggcgtgatgaaaccggcaccgtggccggtacagttgaggtttgcatgattagaaccctgagaaaagaagaagagagaaggtgttacggggtcggataaatagaaatgtaaacgtaaccgcagctaccacgggtatcagctatacaggttaaactcgcaagttgaatgttcacctgacgttgctgatgtggatttagttcgccagcacgcagcatatcttccagttgttctacaaacagcgggaaagccagatctaatttcttcaggtgtatcgggctaaagctcccccgtaaaaccagccctgtcagccaggtaatgcagacgcttgccctcctgtaccagccttgcgccaaagcggggggtaatatcactttgcagtccccattggggagaatcagataacgacataacagtttccttttaatgatattttgccggacctacagccaaccgcgctctgcaaatgacatcacgtcatcccctaccacgaggtgatccagcacacgcacttcgaccaaggccagtgcactcactacccgctttgtgatgtgccgatctgcctggctgggctccatttcgccggatggatggttgtgggccagaatgaccgcagcggcgttatggcgtagagccgctttgaccacttcgcgaggatgtacctccgtatggctgagcgtgccggtaaacagcgtttcacgctccagcaaacgatgctggttatcgaggtacaggacgataaagatttcccgctcaaggcccgccatttgcagctgcagccaggttttagtgacgctggttgaggtaaacgactctcccggctggcgctgatatttctccagcagacgcagggctcgacggataatgcgttgttcgttaaccggaaaaacgggagataatgcgatttcggacatcacagttccttaaaacataatgccccgccggtttattggcagggcatgaaagataattaaaaggttcatgaagcaagctgcaacatattctcagccatcacccacagagcacggttaagcttcacatcaccgtcgatacctttaacagcgcgtgtatgggcacgtttgcctttggtggttcgtccagacagaccgcctttaatcaggttttcctgaatgcgctgataagtggtccacaggtcgttactttcatcctgccagcggcgtggggataggatttgcgattccgtcaccggctgatgctcttcaccaaagcgataggttaatgctgctttcgccatcgcctgctgtgctggcggcgataacattagcgattgcatggcatcgcgcttctcttctactcggtcaaatatccccagtacttcgtaagccccttcaatgactttctccaccacattgcctttatgcggcacccgcaaatcagtccattttggcaaaccgatctaaatagccccggcagcatttggtatgaactggagccgtcatgactgttaagcaaaataatttccggtacttgtttgccagtaatctgtccttcacgccgcaggcgcaacatgtgcttcgtatgttcgcgtttgctctggtcacgtactcgggtctggcatgcaaagaaaggctggaaaccttcacgttgcaagttatctagcagggtgatggttgggatgtaagtgtatcggtcgctgcgggattcatgcttttcttcgctgaacacactcggcacataatgcgccagttcgtcgtgagttaatgggcggtcgcggcgtacaacattaaccgcaccaaagcggctggctaatcgggtcatgattaattccttttttggagattaaaaacgaagaggccatgcttcccaaaggaggcatggcccgtaagatggtgggatggttacttataagaaatgttaaccagcgatatttctgcaaccgctgaggtcatccagctctttttctgtattcttaataccaggagtaaaacttcctacttttttatcattaacataaacatcgaacgttgcggcgtgaccaagggcatcaataaactgaatccaggcgttatccccatttcgccagcccagcgatgcaggtaacgggaactgttgatcatcggtcacaaccgttattgttgttttgtcatcgcgtgagtccaagcgagtaccgtcaggtaggtcgatgagtacattgtgctgtaggatattctgctcatccggattcatggtgcagttaaggttaaaaacgacattttccgggctgatgatcaggtattcagttatgccctgaccaaagccactggcccacatattaggaaccgcaaaagaggtaatagggaataacaatatggtaaaaatagatagtcttttcatatccaaaccttaattcattataatttattttgagtcaggccatttataacggaagacttcttttccattatacggtccgaccatgtcatcaaattgaggtcttttactattaggtctaaaggttactttcatgccgggactgcacagttccttgactgtcacattaagtttagcatcagcagtaatggtataacccgttgcaatataatcagttaggatattcttgtcaccaggattgatccatccccaaacaccagcttcgcaatcttttaaaggggcagaacgtatcaagataaacccacctgacgcatcaatttcagttgctttgcacatttttctcacctgctgataagcattgcaccaaaacctgttgccatccttattgttgactgcggcaggtaatacacctttataaaggctggatgcctccgctaattttgatgtaattattccagcagcgatcccagatattaataacaataactttgtttttttcatttcattgtccttttatttggttaaatattgttggtactaaaggaagatataacgtcttcgatacactgaaagtgtggtagtgcctgaagaaaatcgggacgagaaagaatttcgcgcacagccatatccggggcaaaactgtccttattaagcgtgacagcccgtatatccgccagaggaaacacggcgatccgggcctgatgctcaccggtcagataccactcacggtcacgcaataccagacgatagggagcgagtcccgtgcagcggcaaccattacccagtagtgtcaccctccgatgttccgaaactgcactcaccagtctggtaaatacgccgaggtctggtgattgcaatagtgaatccccgttccaaataaggcatggagactcacccggcccgctcagaagtgaactgaccagatggttgtccatatcaggaaacagcgcttcaacacccgactgacgagcaaacgtcatcaccgccagctctctctgtcgacctccggacagcaagcgacactgacctttgcgatactccagatccagatacatcagacgttcccgaaagtcccggcgcagggtacgaaccgacacaccaaattcagttgccagctttcgcaaatccagagtttcacccgccaccaggcggctgataattaacgacagcctgacggcaagccggtcatgacggcgttcagcctgagtcatgagacaggttctccagtaatataattaacctgaattctggttaagccgtcactaagacatccttttccgagtggataatattcagtgacggtttattctttttcaggcaataagcaatcagtccgcccaaaacagtcaacatgagcccttgtagactacgatggcgtgagtgctctatttgagagatattttttaattggtcattaatcgtttctataataaaacgctttgataacatcatattatcccatgcactgagggctttagctttcatgttatgccgctttttggtgatgaacgtcacccctgtctccgctaaagtatccacaagggattggctgatatagcctttatctccgtaaagagaaccggttaatccttttgctaattcatgcactggctcgcggtcatccacattgcctggcgtgagtttggctgccataatttccccttgatgattgactatcagatgcagcttaaacccgtaaaaccagcccatcgtacttttcccccgtttcgctaccccgtcaaaaactttatggcgtggaatacgaatattatggcaaacacggagatgagtagaatcgataaaagcgagtcctgtgggttttccttttagatgggtcaaatagctacaaagaggaactaaaacagaggaagccatcccgataaaacgggtgtaactgagtaagaccggaaaatcgttgcggtggtattgccaaatgagccccaaataaaatgttttgaaattacggtgatttgacatatgaaaaaaaatcagaatggtcatgatctcactgacactcatgcgcccataacggcggcgttgtctgtgtccgttctcgatacactgttgttcccactgtggaatgaaaatacgacaaaaatcgtcgacatcacaaaaaagttcaacgaatttatccatgcctgttccttattagatcgtttttttcttggtcgaaaattctgatcttggaacaggcacttagttcaattttttatccagaattcaggttaattagctgaaaattaaaaatttattctaacgaacggatgggacagggtatggacacaagaagacgtattttttactgttgctgaaatcagccttgatggggtgtaaagaggaaactttagaaattcagtagcttataaacctcagaatggacagggtgtgtcctgaatataatggcaggtaagccagctcagaagaaaaaccagtcccaaacggcacgggcaacggataccactgcctcacggatagtacgaataaccgtttttagtggcacgggaataaatgatgccgcttccgcagaatcaaacacctccccgatcgcattaccaaagccctcacgagcctgcttttttaccagttcaccgcataacctcccgtgcagttgtgtcgccaatgggctggtggctcggtctggcaggtagcacatcatcgtttctaccattgatggcagattccattctgttctcgctgagacagcgcacaccggatggagtggtgaaaataactgacgaatggatgccagcctggcctcaatattcacccactggtgcggtgatggtgcattgccggtgacataccactcatggcttggctcgattttgtcaacctgattaacgacaaacagtacccgttgttggtagccagtcatcactcgccggtagaagcgttcatccacagagaaggcccgatcatcggctttgataacccacaagatgagatccagctcggggagaatattgcgatatagagattcatattctttatcccgttgctcactctcacctactccggggaggtctatcagtatcaggctatgttcaccttttctcaggcgaaatcgcagtacgtcacgggtgcaggcgtggacgtcactgatgggcgtaacctccccctggaaaagcgcattacacagagatgattttcccgcgcctgttttgcccatgatcccgatgactggttcgtagtgagtgagcttttgaatatggtcaagaatatgtttgccaatggcatgggggagtgaagccagcggtttctcgatggcctgcagaccttctgattttttcatgaaacgacctcagacagaaaaacaaaacccccgagccaggaaggcttcgggggtgattcgttaggataatatgtgtctgagattattttaaatgtcggtatctctgaatcggtatccaggcgattgaaccgttattcttggttagttgcattagtagctggagcgagatgaatcaatggattttgcatacaaacgccttcatttccactaagctctaaaaataaatttcacccacattcaacaagttgattaacccgccatgagaaaatctgaggtttatatttcagtcgatgtcgaaacatcaggacctgtgcccggagtattcagcctcctttccatcggagcgtgtctggtacatcaggctgaagtagctatataccttgaattacaacctgacagtcccgagcacgatcctgaatctcttgctgtaaccgggttagatctaatgcaacttgaacaggacgggcttcccccttcagcagcaatgcatcaatttaaagtatggatagaaagcgtcattgatccgggacagaaagcgatttttgtggggctcaataccccttttgattggtcatttatcaattattacttctacaaatatgtcggaatcaatccttttggttttaccgcaatagatataaaagcatatttcatgggtgcctacggatacagctggtccgaaacaaaatcatcccatatgtcagccattctgaaaccttgcactaagccaaaccacaatgcgcttgaagatgctcgctttcaggccgaattgtttgccctaatgcttgccaggcaaaccggagatattcgctcaggttaatctgcgccatttatcctcaaagcttcaatacaggttcccgctctgatagaccaggctttaacgccttctggtgaaagtgaagtccccactatgacagctatggggtagggtagctcttgggcataacgttgagcaaagcgtgcgaaactcaaaatatcagtggaagaaatctgcgggataacttgtggatgtgtatgccagtagcctaccagacgtaggccttggtcattcgcgttttcaatctcttctctgcaacgtttagcatccagctccaaccaggtccttccagctctatcggcataatggggaacagttgcaaaagacagcaacatgccggaagggtaagtggggtcgacgaacagttgcccacctttttctgtagaagagttattctgtctgtagctggaaaagacatcggatactgaccgggaaaccatcagctcagtttctatcccaggccatatccagtgccatactgggccgctcatatattatttttctcagattcgggccagcctcgctccagaacactcaggattgttccttcaggaagttctggtcctagatatttcccgccactcaacactgcatcctgaggacggtaaagactggtcacccacgcagggccatgctgatgcgtgttcagaaatcttatggctgcttgtgctaccatggccgcaatattagtcatcccagccgaaccaccgggaataaaactttccccacatgccgggagtggaataacaccgccctcaggccagtttgtataacggtgaataaaatcaccgttatcgctaaacaggtatcggccatcatgtgccccttgaggagcaattaaggcatgtccaaccagagtatgtggttcgctccatccctgtaatagaccccaggtcgcaccttctgctttttttgtccacagtgcaacttccgattcccagtctgctgtagtgacaataattaaatctgccttttcaaaaatctccggctttaactccataataaattgtgcataagtattgaatgcggctacatcaatagtcggtaaatcccgagtgagcctgtactgtaatgcctgcgcctttggtttcccaagatcatcagccccaagtatatgtctgcccaaattcgctgattcgagattatctggatcgatcagcgtcagttgcttcagaccagctcttaccagttgcgacgccactgccccacccaaagaaccaactccgacaaaaacaacatgcgcagtttcaagcccttttatttcattacttaggtcacgagaatggatatctgcacggtcaattacattcaggccggatgaacgaatacattccggtaactcacctgaggcccggacaggcttacggcgtgaagccctgagtccaagcttcggtcctcgatcggtattatgccgacgagcatagaggttcagtgtgtaaactggtgatccattattcccaggtaattcaaggatgatccaccttgctaccattgagctgctcttctcaaaccagtcagataacttttgtgcgtcgccctcggatatatgaggcagcaaccatgcaatcaaaccctttggtgtgggaaatttgatatcagggtagctctccagttttatatagaaccctgccgccatgggtgaccgaactgttacagttcgcccggtcattcgtttgaagtgcttcttgatagcctccacgtcagacgacaaccagacggtttctttcccggagggtatgagatatcgcggatcgctaacagcaaaaagctctgaagcctctattggacgacccagcagaataaggtcctgtaaagacttaccatgctgtcgaatccagtatgatgtaatttcgttctgaaattcagcctttctccgctcagcatcacttcccatcaatgacaatgaaaggatactcgtcagccgtgaaatactgtcccgaacaatgcttgcaggggagcctgtaatagggcgttctttaaaaccatgaagacataacccggactccatggcgtgaggccagagaagccagggcgaaggctcaacgtggagccgcagggattcggaaggaaaattgttgggaaaaccaatatacagtttccgctcttcacccgcgcaatcaatcggcaaaggaaagcaaaatgccgcagcttctccagcccgcacactggcgggctggagcattcctgaggtgtcaccatttccgagaatttccctcagagcggctattccctgctgaagtggagtatctgttagttcagccaaggcgtcccaccggtttcacgtttacctgagaccggctactgcccgtcgcactcccgaaaagtgcgcccattgaggctgcattccgggttacccccgcagctcgacccggcattgtccaacttgctgggacctgcgaattaatctcatcaacaaatgcacgcccgatgccaaaattttccttaactgccaaggcgaaggaatctgtggaggaataattctgaagcccaagattcacggcttgactggcgttttcatgccagtcatagaaagcccgacgataaaatgggccttcccctggacgattccacttctcagcaaaattctcaccgctatctcgcggattacaaatcatatattcgtggccgttgagtcgaataaattgcggcattatgcgcacaatctcaatgatagcctccagaggcgtaaaaggccgctgttgagattgtttcaccacgtccagatacgcgtgagttgccagcgttgtgattactgcagatattgggcgattcttttcatttttcgtccggatagcccattcatcgcgatgacgtttcagcagtttaatactagcacgcagcggatcctccttctgataatctccatactcgggtagaggctcctgggtagcagaatccgctgtcgcaaaacttttgttaagcgcaacataactttcgagcataacttccaggctggaagcatgatggagccagtcggaataaggaatggggctacttgccttccatccgagctcacgatcgggaacttcaagcatgccaagcccgttatcctgttcattccagaagcaggcacgtgccggggtgacatcgatatgaaaaccggggttttgatcggcgtaaacgattcttacaccgcgacgaagttgttggatatccccctgtacccggcttccctctttaaaacgcttttcgatcgcgtttaatactcttcctgcatccacgcctttggcatgtggcaaccagacaatagcatccgcatcgatagtccccaagtcagctggagcatcgggtaccggatttatagttgtttttagccgcattgacccctgaggaaaaatatgagcttcagcaagaagaggatcgtcagatgcagaaaggatgctctgcaattggtcataacgaccattgatcttctcgtactgaggttctgatagcgagatttttcttgctgcgcgaaggagaaaatactcccagctgctacgtttcgtttgttcattgttcatcactatagctcctgagaatgaccaatagtcagcattggcctgaactggttctgactcatgttttcacggtcgaatatgacatacggatgttgatgctgtgttgttaacaaagcaccgaactcgatggctaaagctgcaggaatagcggcaaaaacatggattgcttcatcagtgcttgcttcaagctggcttaagcgtttctgtagctcatcacgaaaggcatggatcacctcacggcagctgactattgcataccccggttcaggaatagtgaactcagcaatgcggacatcaggtatagctgtcatgacatcacgcggcgggatcttggcagaaatagaaataacaagagccaatgggcctttcccttcaggagccgaagaaaacaggaaatcaggaggctcagctgatttatccggccagcgtagaccatgcgaacggctcattgaaaaaagaaaacgtttcgtacgatcgccaatggcttgcccgagtaacattaatgcaggaatatcagcgacgccaataaccgctaatgctggtaaatctccatacatcccaccacggcgtgccaactcaccagctagtttatagtgaatgtcatctttcacattctgccagtagtataaatccctgcccctgggacctggtgctgggaagataatgttaatcgggtgcccaaaagcggttaacccctctgaagacatcaccattagcaaatcaccgacaggaatgttgttggtagtggcaaagtgctggctttgcacaataacaggaatagctcgaccttctctcggcgaagacgctgccagcctgatacgctccaggcaggcctgatgcaacccgcttaaatcattttcagggtagccgtcttcgtcccgatcaatcctgtcatggcaaccagggcacaaaagcattaggttggcgaaatcatttgtgagtgccagagctcgatcaccactatgatcaacgtttcctcggggccctttaggacttgccggtaaaatatgggcaacttctccccatctcattggtgtaccaactctgtaatcatgagtcaggtcgactccacagagttcacaatggcctgcggtccggatccagacaatacgtttcacttcgtcagttgtattaaaacgcccgccagaagtactcgtttgttctttagtattcaaagcactgtccctccggaactcttcggtttgcggcaagccgtgcaatggggaataactaggactttgccctttttcggcagaatcaccttacccgtcttttcatgaatggcttttgtagcaaaagtgatttcacaatccggtttacagcgtgggcagtagggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccggcagtagcccattcgtggcgtggtcatataccactccttgtgttgcacggagtgtcatttcaccggaggcaggcttgtcggctacgcaataattaacgtatactcaacattctgatcagcaagactcagtggtgaatgacgttccgcagagtttttgtttttctggtgaaggactgtttgcagacagtccttcaccgtcccctcagaaataatccagccagaccaacaacttcacctgaacgaaccttcctgaactatcatgtcgatatgattactttctcgacagaatcgatcctatctcattgcttaaaacagtgcaacatgaaataatgcacggtatatttaatgtatcataacctggagcgtatcgatgacaaagtttcatgacgtttatctggaactgctggtcgacgcctattctcttccccaggcggaacgactggcgtacatagacctctgcattcgctaccttggcagcatttccagagctgaaattatggctgagttcaaggttgctcaggcagcagcatcaaaggaccttgctctttatcgagagttgaaaccagataactgcagcattgataccgcaaccaaaaggaccactatcctcgcggacagctatacccctttggtcaggatcggcgttcatacagcacttaacctgattcaatatggatttacgcgctccgaattaatgcaaaagcggcccatgctacctattgatgaagtggacccactctatcaaccggaacgtctcaaagaagaacaggtggctgcggtaacccgagcaataaaggaacggtgcgccattagatgctcatatggttcaaaaagcggagatcacagggaaaggatactgtttccatcagcattgtttgttgaccgtaagaactggtatttcagagcctacgatcgaaataacggagaaccgaatcgcagtggatttaaaaactttaagttttccaggctcttcaatgctcataaggaaccatccgtctcaccgactctggctgagaagacggacatagaatggaatgaagaaatcacttttattattgaatttaaaaagaatcttccaaaggaaacgattaatgaaatatcgcgtgagttttcaataaatggcagcgtgcattctgttacctgccgggcagctttagcctgctacgtgaagaccaactggaaaattgatttaaccaataatgaaaacaaccagtggctgtactttgatgtactgaatgctgaggcgttgtgggaagttcagtgtttagcaccattgtttgaacaaaaaaacagttaattattataaaagattgattgtggctgcttttgcagccaccccttgatctttttcgggctgttcccatcttaactaacatgccattgttggcttatctcctgctcagtagctttgcaataaagctcatccatcacatccctctatcagtctcctgccggaaaatataccgcaagaatcagtactgttattcgtaataaatacggatttatagtcggcatcaccttttgaggtggctcgcttgtttagaatgaggctgttatctgtttgtaatttagagggatatatggcagcagagaatcgttcaaaattgcttcgcatgaccatccggaacattggatgtatcgggaatgaaggcatcgatattgcacttgataacattgtttgtcttgtaggtaaaaacaacgctggtaaatcaacagtcttgcgagcatatgagttagctaagggtccaacagcatttgatgccagcagcgatcgacatcagcatgcctcagaggatgaacattcagaaattttgctcgaagttcacattcctgacggtattggtaatgtagatgcaaaatggaagcaagaaagagacggttttctcgtcgttaaaagccgttggcagtggaaagcacctgattttttgaaagtccgtacaacctgggatcctaccgctggagaacatggtgaaggggactgggcagaggacactaaagcaggcggcgctgattcagttttcaactcacgtctgccaagacctttgcgtataggatctctggatgatgcaggtaaaacagaagatgtgcttttgagttttgctctcgcccctttacaaaaagagcttgagaacgcgcggcttaatcccgaatcgtcattagcaaaagcgattgaaagtgtttccggaagtatcaacttgcttagtgaacagcatcaagaacattttaatggtattgcgggccgagtttccgaaggatttaaaggtatttttccggggctggatgttagtctgagcatcggtgccgcccctctggctcctaaagttgcggatctcatcaagaatggctccagtttaaaaatcactgacgggagggctaatacctctcttagccagcagggcacaggcgctcgccgcgcactattctggtcaatgttgcaagttcacaatgaacttaatcgcgacaaagaagtacgtgctgaattccgcaagcggcttgagaaagaagtaactgaacttgagaagaaactaaaaaagccgcctaaaaacgctgatttgaatgcccttaatgatgagcttattcaggttagagcccaactggatgcccatgatagtggtgctccaatccctgatagccctgatgatccagcttttcctggctatttactgttaattgatgaacccgagaatgcccttcatcccatggctgctcgtgcagcacagagacacctgtatcagttggctaagaatccagactggcaggtgattatgactacccactctccgtgttttatcaatccatttgaagatcacacaaccattgagaggcttgaacgcgataattctgaagaaaattcagcagttacaccaagaacttaccgctctgaccatatagcttttgagggggatgaaaaacagcgcttgcaggcattgcaacatatcgaacccagcttttcagaggtattcttcggttctcatccaattctcgttgaaggcgataccgaacatgcagcatttatgacctcgatcatcgagcgtgataatgcattgatggatcagattgcggtcatacgagccagagggaaggccatactagtaccgctaatcaaggtactgactcacttcaaaatccacttcagtcttgtccatgattcggattcacctaaccgctccgatggagttaaaaatggaatgtggactgaaaaccgaaaaatccatgaagcattgtgccaagccagaaacgcggggctaacagtccgccatcgagtcagtgtacctgacttcgaacgcttccttggtcaccgggaagcatacaaggataagccattgaatgcttacctgcagatcaagttggatgatgggttagcgaaacgggttcagaggctcatggattcccttctgaactctgatgagcattgctcctttgggaatgaaatcgatcacgatcgttatatggaaaagctactgggagttgtttctgggtgggctgaggcgaatggatatgcggaggatctgcgctttaagagccaaagataagagaagcggcatgtatatgatttttctgtggtagtagaaatctaacggggatggattacgtcagaaatgtggttactcacacagtagccacaattaccttgctcggtacttgtaagcaatctctagacatccctaacatgcactttagaatggtatcaattcaatcctaaatccaaagaaaatcaatgcaatcaatccagttcgacctccacaaacttggatggaaggctttcgaggatctcgtatcatgtatcttgaaagagacctttgggcaaacatttcaagtattctctgacggcgttgatggcggccgcgacggggccttctatggcacttggtctggaactggtttcggcgatggcataagtaatagttttactacccaatgtaaacacactagcaaacaaggtatgaaactttcaaagggagttgttagtgatgaacttcctaagattgagcggcttgtgagtaaagggctagccgatgtgtaccttctattcactaattgttcagtttccgcagaaacagctgccgtgatggaagaggatatgcggaaagctggtgtaaagttcgcaaagatttatggggcagaatggataaaccacagcatatccttatacccaagccttaggcgcatggtaccccgaatatatggccttggtgacctttcccaaataattactaatcaggcatttcggcaagcgaaaagtgttctcgattcaattgctccagatcttgcatgtttcgtccccacagaggcataccgccgttgtgcacacgctctcagggattacggatttgtaatgctgataggtgaaccagcaagtggtaaaacgatgatagctaacttgttagcgctctcagcggctgatgagtggggactgcaaacgttgattttaagttcgccggaagatttggataggcaatggaacccagatgatccaggacaatttttttgggttgacgatgcttttggatctaatcattgcgactttaaccgagtccaggaatggaatcaaaggctccctaagttgaaagctgctatacacaagggagcgcgagtgattttcacttcgcgcagctatatcttccgtgcagctcagaatcgcttaaatacaaataaattcgagttattcagagatagtcgagtcacaattgaagtcgagaaactctccgatcctgaaaaagccatgatcctgtacaaccacttgaagcttgggaaacagactaaggcttttcgaagggcaataaagagttttctaccgtcagtagtatcagtacccaaatttcttccagaaattgctcggagattcgccaatccgcagttcacgaataagcttgtgcctaacgaagctgcagtcgttggttttttctcaaatcctacggggatcatggcagacattattggtgggcttgcacccgctgaaagagcggcattagcccttatattttcaaatggaggggagctaccaatcccacttcggtttgaaaaccctcagacaaccaatatcatcacgtccatgcaatcaaatcttggcgacgtaaaagcagcattgtcagcattggatgattcacttatcagaataagtaaaacacaagacgaacactactggaaattccgccacccaaccattcgcgatgctttcgcaactgatgtttcgggtaatccagaactcatcgatatctacctttcaggagtcacaaaggaaagattaatcgaggaaatcagttgtggggatatggggatcgaggggataaaactggttgtgccgcacagtatgttcaaaagtgttctgaacatcatcgatcccagtggtaacagagccctcatcagtaggccaatactcacttttttggcaagcagatgttcaattgaattcttggggctttatttcaatagcggcgaagcaaagacttatttgcttgatttaatcagctctgcgagaacatacgataatagcctgacaatactgagtaggctgaatgtaaatggtctactcggggatgacctcagaagaaaagcactggacaaactgagcgcccttgccgcaataaaccattcagattgtttcattgacgccgactttgtcggagttttactctcaaaagaagagaatgaagccaggctttctgtccaaaaagtcgagttctactctaacatgaatgaaataatccaagatatagaggactcttgggctacagacgatgatgtagacgaagcattttacgatgtcacacgccttttggagcgatttcgtgacgagaacaatgaattatactgtgaggatttttatgataaagatgaatggcaaaaatctgaacaatttactcgtgaaatcgaagccaaaaaaaacaggatgaagcagaagcaatccgaggctgtggattacgaagaattagaaacagaagaagcccagagtgcaaatttgtcatcaggtaggagtattttcgatgatgttgacgaatagaatcttagctccatcacgagtgagatagagggcttgacccgagctgctcacttcgaaatcttgccaaacgatagataacggcaggtgataatccggtccgcctaaaaagcgaggccgcactagtagcacgttgtggtgtcattccgttgccagtatcttctggaaaaacggtcaggcatcgattaaatcgtggcggctcgcgtgaaggggatatacgagggtttataacttgggagcaacattacagttttcataagcatgagagccttcctgtttagtgaacgctcaccatgagacgagcatacaaaaagtatcaggctatatgaccaaacccaacgatgccactccctcttgaggcagacgctgatgggtcgcgagcagcatcttcatttgtcgtaaaacaaagcgcggcatccaaccacacagcgactcaaaatcgaaccgttcgctgttggcatttccttcaggcgtcacccagcaatttaagatcagttcatcatagagccaccgatccaattgtaggctgatatcgtaatcactaagtagcttacagtacagctgatgggcgatttttaagcccgccacatccaaatcgccaaaatagagcagttgttttacctgttcgaccttgagaagttgtgacacgcactctgcttggcctgacactttgtttcccgcgccataaataaccagtgaccagtgagtctgaactcgattaagttggcaaagtcgataatacacatcagagttttcaacaatgatagccggaagatcgcggcaacctgatgactcatacggtaaaggcggagcacgtcgaaacgcgcccatatcagccaaagtcagtgtgacatgcttccagccgtcaggcggcatggaatccagtgctttttcatcaccaaatataagcagagaccgctcacggtgtccgagcaagcccggaaagagtggcttgtcgcccttagtttggcgaaagagatatgtattcaactgttgtaaacgtgccttgattggcagtggcagttgccctgtaatacgttccgccaaccagggatgccaggctatttctgatgcagtttttgtagggacgatggcaccttcgtaaacaaaagtatttggtaggctcataccccgccagtagcgatgccagctagctttatgcttaggctgagcccgccagtccccttcaagcagttgcgtaacggcctgactcaataaacttggaacatcctggcgcaaagcctcttggctatgtgtttctaatatctcatccagaatcgcattggctttaactgttcggacggccttaccggctgcaaaacggtgcttatttgctgtcgactccagccgggatagccagatcattacgctactcataccatatctaccttaaaagactggttcggactttggcttagcaaccagggaagccgaccacagggcgtggcgttctttatcaacggttaccagatcgcgccgcctcagtttctgaactttgttcaggaagagatggttatcaaacatcgactgggcgttttcatccgagatgccagtcaagtagatgagctggattttataagccctggccatttgggtttgaattcgcatcaagtcatcagcattcgatttgcccaacgggttgtcggccagtaagaatcctgcacttgaaatacccgtatcgtattcacgcactttgccgactgtcacaaacagcaaaaaggcagatgtgaggcgctgcccacctgagccttcgagccgggtgacaggagtccattgtggacgactggcgttcgtcttcagcagacgtacttccagctctccttcgccaaataccgactgaaccaaatctgctgtcaaggcatcccggtttggcgcacggggtacctgccctcgggctatccactgctgtaagcggccactggcaaaacccctgagatcagctgtgacatcacggagccggtcagtcattttgataatgggccgaccaggcagtacaggacagtcatcaggaattttgaccgacatcgcgcgcttgaggagttttatcgccccctccagatgtgcagtcagatgggtgacagtcagttcaatcgaacgctggaattgttccaagctgtcctgcaccgcttcgaatacctgcgtgatccctgtaccgaccctgtccaagtcgcccaaaacttcatgataagttgcgactgagtccaactgtcgtaagtattcctgactggctcggatatctgggcccttagccaactcttcttcgattcttttgcggaagtgtccccagaccgtagcgacacgtatactttgctgtttaagcgtttcttttaggcttgcgtacatttggcattgcttactcagcgcgtcagcatactcagtgatactcagaatcctactaggcagacccgccgcagagctcggagttatggactggatcgtcgcctgagctgttttggcgttctgtagtcgttctttcacattttccatcttcttcaacagcagcgcttttttctccagttggagtttgagctggtattcagtttcatggaggctgttggcgatttcagccaaagacgtttggattgcctctatttcgacgggtttctctttccacacaaagtcctcatcaagcgcgttgcgggcattcgcgcaattttgggacaaattttgcagagttaccttcgagttaattagattctgcgtgaattgcctctgctgttcgttaaggcgtgtgatgcggttgttaattaccgctagctcattgatagcctccgcttttacctcatccggatatgcactgtagatgggttgagctatcaaacgctcagaggcgtaacgttgtgcctgttcagcatctttccgttgtttcttgagggcggtaacctgatcaccgttggctgcttcgagtaattgtttgagcgcctgagcagccttctcatgggcatctttggggcttcgtccttccataccttcagtcgccgtaatctctgaatagaacggctcgttggatagattattccattcgctaatctggatacttatacaggtttgttcggcgctcttgttatccgcgagctctttctgccgctcttgcgcctccctcaggttaacaagagtctcctcgcttcgctgaatctgctcggctagctgttccagtttcattatcgccgtttcacgcttcgcccattccatttcaacaaaacggttcagtttatcacgtgctttttcggcctgaattttttgctgttgagcactgtttaaccgcgccagagcatcagccttctcgtcgcgcagtgtttgcgcataatgctccgcctgcttaagtgctacatcagcattttccagcagtaagcgagcctgctcgcggtgatcaactagtcttgcccaatgcttaccatactgatcgtaatgcaaacgccagtcacccctgaaagattccagtatattaaaggcgtcctccacagccttcacactggtctcctgcgacgctacagtgtcctccaactcttgcaaccgggcattgtaagcggccttgctataaccgtgtttatcggggtttgagaggacgacctgcaccaattcaggcgtttccctgcggagatcctgtgcttcatccagcagatgaatagcaataggtgctttcttccagggcaatttctcactgattttgtggactaactcaaaagttgcatcatcaagtgcgaccaggctcaggtagcggcctggatcatgatcgatcactgcagcgatactctccgcctcatcgaggaagacagaggccagatagtggggaaatgcccagagcttatcccgtgcaatgcccgccgcatagaacgcttcaagcgcctgattgttctgcttagtgaccagttcatgccccgtcagttttaactcttccagttcgtgctgtgcttgcagtaagcgctgtttcatttcattcagcgtttgagcattcgcattcaataccttctcgagctgtaatccgcaccgctcgttgtgccaacttatgtcctcaacatcaagatcatgttgcgttgacgctggtagtgtttgataggtttttactaagccctgcgcgctatccattgccaactggtgatttagatctgcttgagtgcacgtctgctgcgccttactttgctcaactaacgcatttgtcacgacattctgctgcgcttccagcgcctgctctttctgataatgatcagtattagccagctcttcactctgctgcgcatcatgtaaggttaattccagtcggtattgagcaacactaggcgtttctcccttttggatcaacccaacttcacaaagtttttcccgttgcaattcaccctggcgtttgtctattttatatctgtcacgacccacctccaggccgcccaacttcttttgtagctcgtcgtatgactgtctaagggcattactttccttgcttatctgcccttgctcttccacaagtttcgcctcctgctggcgatgcctgttgattgcccactctaatacgcccaaggcctcaccagcagtacgctcaaaaatcacctgcagtggcctttccgtttcactttggaataccttcagatcttcgtctgcctgacggtacgcatcccgcaccttcgcataagctttgtagtctatagcagtacgagtaatatcaatttgacgttgattggcatcggcttcatctttaagtgcgtcgaccttggttttttgtttgttgagctgatgctgcgcgaaatcatattcaagcagcgttctgcgcttgcccaactgttcaagcagaaacctcttctggtcaatgtatttttgcaagtttcccgtgtcttcttctagttgtatctgttcaatctgagcttccccaataaaggctgtgagatcgcgcattgattcgcggaaaccgtcatccaacagttgcagctgcgtctgagtgctttccagttgtttggcgggttcaagaaacgtctgccagttagccagcacgtccttgagaaatgactcgttacgacggataccttccagctctccctgacgttcaacttcatgcgctaccagttcccgcaaccgctcagctgcatctttagacatggtgcaagcaaagaacgcaccaaggaaatcatgctcagttttgtattcaataaaacgggtcaagccaccttcttcggagttgaaagtcaccattgttttgatgagatcaacgttgatttgttgttccagcaaaaatgtgcgccattcactctgcctggaggttttgcgccagtgcatccccccctcgccgcccgctttgagattaagccagctttcgaagctgtgcaggctattagcgtaggaacgtagctcagaatcgcgttccgcgcgggaataagaagggacttcgtcaaatggcgcccccaacagggagtcaggcgcatcacaaataaacagcgtgcggtcaacatcatccccattgcgctgatgagcatgccccagtaataacgtttggcctgattcattgaccatctctaccaggataacagagagctctttatagaaataattgcggtagtggtattcactttgccgacggttagccaagtattgggtgaaatcactaacggagggctcaaaaatcgataacagtagtgcgatgtaagttgacttgccacccccattaacaagctgttgataggtactggtcaccaccttcgcattcctgacgggcgagcgctgccgttcaatagcaggactatcgactgcttgagacaggccaatatagtccagcgtgaggtctttgtagaaagcttcttcatggcctgcgccatctatataaacccgtttaatcagccacatatttaaatctccagcaagcgttgcgtatctgaggttccagtgggggcaggtcgttcattgaccggagggaaccttggggtgcctactaatgcagcgatatcgctttcaactagatctaacgaccgatcttctgtggctggactgatgctcatcacaaaacgcaccgtctcttcgatgccggtatggcgcagatagtgtttgagcttttgagtcggataccagtcggactcacccgacagactgctgtcttcggccagaaaaccttcctcctgcagcagctgtatccagcgcgtggccatttctgtttgtgagcgaatactcgagacacggcccaccttttcgtcgtgaatgcgaggaatgcgttcttcctgcacaaacctggccaccgttagtagaccgtcgacggtatcgtcgccctcggccttgcgttgtacaattacctggtcggcaacatcattgagcctggccactaccgaggcagcattaatggcactactctgaccgaattcgacacgaaccgtgtccggaattggaaacagctcggccagcagcgcaatcagagtcaagcctgcaaacagtcgctgctctttgcgttctttactcaactgctcccccgttatttctggcagcaggcgcttgttcagccaacctaaagacggagcaaatgggcctcggccatctgctgccagtaacaccccgtacgactcatgaatcccaaggtaccgcaatttcatgcctgccgcgacgccacggataatttcagcaaacaaggtatcaccttgcaggtctagcgcgcgttggagcggctcatctcccattttgtatcccagtgagttcataattgcctgtgtggcaatctcggcgtagcgtttagcttgttgatgcgtgttgtcggacatgactactcctcaaagtggtgtacgggagctaccgttaacagttttaaattgctagcccaccaccgcgctgtttcgatagcgtcaccgcttatctccacctctattgtgggatcactgttagccgccacactgccaatatgaagtaaacaaacctgttgttcttgttcggacaattcgtcgcactcataggcgtcgaaaacatctctaaagctcacatgcccccgattcttcaaccggtcactcacccaatcactgcatttcttaatgacagattcagggatcccacgcagggtagtttcaatagctacgggctggtcggtagggtcctgtatctcatgtggcagcgcttgttcaaatctatcaagatagagattcagcagcgcctcaaggtcaaagaggatgtgtctatcatcatcctgacttcggggagccagcacgcgcgtgatgagatcatctatttccttttcgacaatgtcgggggaatgtaacagcaagggtttgagtgcacctttttccagcgtttcacgaaaaagggtgttatctctgggaataatgagtttcaggcgagctcgctcaaaatctttgttcacatcatgtaagcagtcttgatagcgctgagtaaatatgcagacatcggcaaaaatctcttgcgcattacgcagcttatttaatttatcggggtgtaattctgagcgtccatcaacgagcatttccgtaatggccgacatcgtggtccgaatatgctccagcacttccccagtcttatcaaatgagtcattaagtaccggacgaatatcacgcgcataggatgcactcaaatcaccagactgagcggcgcgtactttcatccgcatcccaatcagatattgctccagttgcctctgagttgactgaatctgatgcacggccttgtcgatctcaccgcgacggatggtttttaacgtgcgccaggccagaatagccgcgcgctcaatcggcgtttcatccaaacggagggtatagaacagcattccttcatcggtcagtgaccagagaattacatctgagccggatagctggtcgtagcggaccagacggactatctgttcttcggaatgcgttcgttgcgtgaaatcgtaataacggagacggaaagggtctttaatcgctgcaaaaatcttgctggcaacctgcgcgtaggccgaggcttcttgtcccggataagcttcatttaggtgcccaaccaggcataactccgcttctttccgcgtcataccgggttggcgctcgcggtcagcataataaagcatagcgtcaaagagatgcataatagccgccagcgcatcaagctcgacgccttcccacggattgcgctgtagggtgcgatagattgaatccagcgtccgcacgaccagcaatgcatgagactgaatagtcagctcgcggcgtgccatagattcattacgagcctgctccaaaaactctagcgacatagtattctccctaagtaacagggccactatagtacggcaaaataatttaggcaaagaaactttgcctaaatttttaaagtagcaatgttatttgttttgaagcagttcacctcctatactgaatccatacatcagattgccaataattaacctgcaaagacaaaacaaaactggtatgtattactcaacgtttcttgagaaacacaaaacatccctcagccacgcacagtggttgcgtttgcgctatatcgagcgccagctactatgggagcgaaaagtcacttcacgcatgattgctgaagaatttggtgtctcagcgcagcaagcccgtaccgacgtacgaacctaccttgagatagcaccaggtaatgctttcgaacagggaggcggccgaaagggatattttcccagtgagacgtttgtgcctgttttactgggagacaacgacctaatatggcgtgcgacggctgagtttcaatcgccacaaacggctcacgcgcaggaaattccactcatacatcgcgcagtgcatagccgcacactggcaatttttttgtcagcgatcgagctgcggggccaagtgcaagtagtctatgcgtcaatggaaaaccctgaaggcacgtcccgtacactgacccctacgattattattaccgtcaatggccgtcagcatgtacgtgcctatgactgggacagttctacgtttaaggactttgttttggcgcgatttctgggcttaccggaactgattgtcccagctgcagccccaccgcgtgaagacacttcgtgggagatcgcgatccctgtacgttttattgtcaacccagctctaagcgaggcgcagcaggaagtgattgagcgagactacatactcgaaccacgtgagttcactattcgcgcaccgatgattttttatttgtgccccgagaacaatctgcctaaaaccgacgatgaatatgcacaggctacagatcccagtggtcaaggcccctttgtctatccaattcttgctgtgcatacccaaacaggtgagcctattcacaaataccgccatgcaggcgagagatagcccttctgtttgctaatttattgccatgcgctgttactgggcggatgatggcctggagatctgagcggaagcaatactggtcgatcttcgctcctagggttggcttgaagtactcgcacactttcattaaggatgctgtcgctttggtatcacgaggaataacggtgtagcactctcgctccatgcgcttcaatacatcagcccacgtccgcttgttgtcgagcttcatcttattgacgtaaccgtgaaccagttctttaaacgatccctgcgaacgatgaagctgcatgatgtgctgctcggccaggcgttgttgctcaagctcttgttgcggttcttttccttcaataagccaggcaccatactttttcgccagctcattggccatcaccagtttcatctcaggccagatgcccaactggatgaacttctctttcttccctttctcaacgtaataacggaaataaaaaaccttactgcctgaaggctgaaccttaacaccaagcctgccggtgccacgctgagcgctgttgctccacacgtagtacgcagtactttttgtcttcaatccacgtatagcagtctcggtaagattagcggccataaatctacctttataaggatgagcattacctgacccgatgccaatttcgggtcaggtaacgggtcaggtaaggatgatacaatgaggatatcaggcaaccaaaaagaaacaaaattaacatcataactgattgattatagacaattaaaaatacaaacaaagccaaatccgaacatttcaaaacatgccgattttatgactcataatcgcttggtcgctggttcaagtccagcaggggccaccagaattatcaaggggttgcatcaaaatgcgaccccttagttttttctaggatacccataggataccttctggcagtagcgtgaggtataaccgattaacaccgctacggtaatgaagtgttctcatatttccctccatgacatttatcacatcccatgaacattaagacgcccagataaataacagcagattagtgattattccagcggcttctcgcgcactttacgctcaattggttgaccatacgaatcaaagtagcggctagtactacagtcgtaagtgctctgtaatcatcaggttatcccggctctgataatgacattgttgtgcggagtattgatgtcgccgccgccagtctgaccaatgtaaaacctgttcgacggtctctccggcctttttcatcaattttgacaatagcctacgcagttccgccacactgagggctaccagccccgtcggcgttttttttctcaaaactgccagcactgcatgggccaggagcgataaggtgatgtgccgataccaactgtgccattgccgcacttcgtaatgatccagaccgcattctccctttgtttcctcaaaaccccattcaatttcccagcggcaacctgccacctgagccagggttttcagagccgcctggtctctgcgcgcatacacgatatagtaagcccgttcctgtttttcatcccggctgcgacgaaccagcagataatggccatattcccgttctttctcactgagttgtaaacgccagagcggtacccgaacccagtcatactgacgttcgcctttcgctccccaccccgccgaatgggtttcccatcgctgaggtgtcagattgtagacaatctgacacctctgacaaaagttggcccttgccaccacaacggttcatttttggggatcgccagcacaaacggttgatatcgggattccagccagcagcgcaggcggcgatcctgaccataaacggcatctgccgtcacccagcgacaaggcatcccggcctcgaatgcgcgttcccgcatctgccgggcgagttggggtttagtggcaaaggggacggcgtcaggaatgccggcagcttcacagcggggccgatcatcgtccattgtctgggcaggtataacgcccggtcaataaaggcatgaccgccctgaccggcataacagagaaagacgcctatttgactgttttcgacgcgaccggcggtgccactgtattgacgttgcacaccggcagaatgcgtgccttttttgataaagccggtttcatccacaatgagcaccccgtgttcatcccccaaatgctctgtgacatagtcgcgcaaaatatcgcgggcgatatcaacatcccagtgggcgcgctccagcagatgctgaaccccatcaggcgtacgttcgcctatccattccgccagttgccagccatttttacgctcaacgtcactgagcagtccccggagataagcgaggctgcgttgttgtgggccgggatggtgaaacaacggagccagacgagtatggagtgagagcagttcctgttcccaggcgtgagtcggtaagtgcattgaacacctccccgtatttcaggaaaaaatgtcaggcgttatcatgccacaatggggcgtacggctgtagtactaagttgattacgcaaacctagaatctaattcatgtaggtatctttattttaacctacaccatcccatcaacataatataaccattggtaatatctattatctccccattgcccgtatttgctgttactcctgaaacagtatggtgatgggaacctatatatacagaatgagtgtgattgccttgagtatctgtatatgcaactttaaaatttttggtcacgtattcatcccgttgtttctcacgtataatgagggtaaatacgtgagggatagtgatggcattagttgaagtgaagtgtcggttttgtggccaaaccacgcctgttaaaaaacacggtaaaggagaaggtgggcatcaacgatattattgccagtcctgtcgtagaaccttccagctcgaatacacttaccgggcttgccattcgggtatgaaagagcaaatcgtcgagcttgccatgaataacgccggtattcgtgatacggcacgggcacttcatgtcagcattaacgctgttgtacgcactttaaaaaactcgcgccgcgatgtgtaaccacgctgccgctggatacccctgagcttcagcttatctgtgaagtcgatgaaatggggtcattcatcagtaacaaaaaacggcaacgctggctgtggtacgcgtgggagcctcgcttgaaacgtattgtcgctcacgcttttggcgctcgtagcaaacagacactcaggacgttgctggaaaagttatccgcttttgatgtggcattctggtgcaccgataatttcggggcatatgacatattggctgatgagaaacatatcaccggtaaactttatactcaacgtattgaacgagaaaatctgaacctgcgtaacaggctaaagcgactcaatcgcaagacgctgggttattctaagtcagttgaaatgcatgacaagatcattggcacattcatcgaacgtaagttctattattgatggccaatcaacaggttgaatacacgacccacaaaagcggcaaaagtaatagaaatggtccattttgggaaccattcgaacatcacaactctctggcctaaacttatagaccaaatcatgtaagctatccagatgccaaaagggacaagaataaagtaaacaggtaatgattttttcttgttaccctgactatatgatttgaattgatagtccataaagaccttttataggctgagaaacttcttttttagaagatttcattattttttaatatttttcatgtcacattgccagaaaaagtacaggaactggcgactcggctgactgataatttccagaccctaaaacctgcatcttcaagttaattgcgtatatatcatcattcatatataactacatagattttcacgggataacgggataaatagatatttttgtatttatttcaaatggttatcctaccccattttatcccacttatcccgtagcacagaaatactatttttaactctctaatattcaattaattatatacccgtcgtcattgaagatgcttgatttttcatttgtatcagatcatgattgcgcccatgaaaattaatctaacagatgcccaaaaagaagccctcgaattgatgcatgatacgactcgcgatggacgagtacgtgaccgcatcaaggccgtgcttttggcctcagaaggctggactgcccagatgattgctcaggctttgcggatctatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctacccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgtgccacttttttcatgtcacattgccagaaaaagcgaaagaactcaccactcggttgactgataacttccagattttaaaacccgcctcttcaagttaattgcgtatagcctaccaaaaaaatctttttcgggataactaaattatcagaatacaacattatctatcttcacatcacattacgggatgcaatgggataatacgggataattcaaaaaaaacataacttactgattataaatgttttttatcacgtcaacccgttatcccaatgtttttcatcttacatgagcctcaatcttcatccttgaaaatcagaaccacaaaccgcccctgagtgccattcactgaaatggttttactgataaagcggtttttctccattttaatcaacataacggcattgagtttaccctgcctgctattggtgaaaacttgccggatggggctatgggtaattccaatatgaaggtggctgttaagggacatgtggataaattaaacagtaaagatatttttgtcaccgaacagattggcatgtatttaaaagatacctatgattttgttggcgctaatgaacctttaggcatttggagtaaaaatggtatattagataaaattagttccgttgattatgccgctctttatgcgactggaagttggctggccttatggattaaatataatgggtatattcctgtaaataatgatagttttagaaaatggcagaaaaaacataatgaaggtagtgattttattgttttttctgatattttatggatgaacccgttaccacaatataaaactattcacctatgaaaaataaatataaattcttttttagaaaaccatggctggttttgttttttatcattatttttataatatggatgttatttccatcaacattgttcttcggtaattggaataaatattttgaggataggggtgaagatggtcaatataccgcagtggtatataagaaattgccaatatctccatatgcaatgtggaagtatgtcattttgggagacaaatattttattgttttatatgataataaaaacagagatatctggaagagttctccttttacgtcaatatcatatggggcattttctgcctcatttagccttccaaccgctaataaagatgcttttatctatccaacaaatgatggatatgaagtcatctatgtaaataaattaaaataatttttgtaaatattttgtcttcatgtttctctctatttagcctctaagtttcagagtcttttttattattgtgtgattgaacaccatagcaaaccttctttcttattatttttcatgttgttaaatatattccatcaaaaataaatcgatataaaaacacggtcgtgacatcaatttattgaatcatgtatagtctgtctatttggaaaacattcaaatggcaaagattgatgtaacttgcccctcttgttccgcagtgaaagggatccatcgcaatgggtgctcgcgttctggtcaccaacgttatctttgccaatcctgccgtcactcctggcaactggagttcacttatgccgcttgtcgtcttggtacccataagcaaatcgtcgatatggctatgaatggaacgggatgtcgggcgacagcacgagtgatggggattggcctgaataccgtacttcggcatttaaaaaactcaaacccaaatcggtaacagaagcgattaaacctggcactgaagtgattgtctgctgcgaaatggatgaacaatggtcttacgtaaagtcaaagaagccgcctcgttggctcttttatgcctacgacagaataagacgaaaagtgatcgcccatgtttttggtccaagaacaaaaaagacattaatgcgcctattcatatacaggctcttaagcattaagcctttcaaaacacgcatccaatgttttgtatttacatgattttctttgtggtgttttgaacgcattctgacataaatacgcttgggctttttccagccaaaaaccggtttccgaccacgcccgttggagtaggttttcgattatgggccacagccagacttccgtattttgggctgctttgagcaatgaaacggcggggaataatctgctggccagcgaacgtctgagcaacagagccagcaaactcagccaaatgaggcccgtgactaacgtttcttttctcgtggcaaatcgatgccagtttgtgtgtgattttaactctttgaacagcagttctacttgccagcggcaacgataaatatccatgatgtcattagccgtaaactcttccacggacaagttgctcaaccagagacaaaagcgtttttcttcggcaaaccagcgacgaattaagcgaaattcatagccattacgccgacaaatcagatccagcacttcggaacggttggttcggcgagtgatggatttcagcggcttattgagcagcttgggcaataatttcccctgaccattgcgggtcaccactatctgaggattaagggacttgcttcccctgacaataaacgaaccaccggaaagtgacacttgctcaaaatacgcaaagtcgacataaccggcatcggccaataataattggtcacgtaacatcgccggtacaggcaggtaagcccgctcaggggcggtatctgcggtcacggtcatttttaccggtgactgagtcagcaaggacattgtcatgtgacattccaccgcggcccccgttgtcctgaagcgatagggaaaaacatcggccagggcagaatggactttgaacgaactcccatcctggagaataacctgtttaaatttcatgagtttttggggtgaggagacctgtttctctacccattgcgccatggcaaatctgaccaatattttgacaaattcgacaaaagccgctttacggagctggttataaaaggggcggtaactgactggttgctttttatccgggcacaggccattaaatttttggtgtaactgggcaatagacgtgattttacccgtgctcagtgcagcgataaggctgaggatcaacacgtggggctcgatatttctgatgcgtttcataaacgcacattggaaggcaatatgttgcaaagaaatgtcactgaagaattgcattaactggtgttttatagcgataatcgtcacaggcttcatccgtggttttgatatgagtttggcgacgattatcagatcataaatgaagccttttttctacctaaaataacgcgttattgcttaagatcctgtatatgtgcgcctattagctttactggcacctttcaacattattatttatatgacagatggctggaaaagttacgaaaaagcactcgcagggaaacgccatgtggccagcaagcgttatacccaacgcatagagaggcataacctgaatcttcgtcaacatttggcaagactgactcgcaaaacattgtctttttcaaaatccatagaaataatgggatggacgccccattcaagcggcatcagtgtgccaaaatggaagtgtattaacacagttatttaataacgggagcgtccaccatgaagatgacaacggttggtatcgatctggcaaaaatgtctttcagatccacggcgttgatgcacaagggaaaacggtgctcaaaaaacagctaccacgcgcgaaaatgctgacgtttttcgtcaaccttcccccctgccttattggtatggaagcctgtggtggggcgcattattgggcacgcaagctgcgaagttttggtcacgacacgcatctttgacttacggcattcaaccaagattgatacggttggtaaggtcgcaacggctatcggacatcaattaacggtgtccattgaataaaaatcaccatcaatcaacaggctgcgttaatatgtagccttgttgatgttttctgcctgaagtattagagtaactctgttagtttatcagctgcaattttgcccacgttctttttcagttttccgcttttgtccttttccccttgcttatgccagtcattatcagccgcaaggataattttcgattcaggccactgagttctgaccaattcggcaacattcagtaaattgctttcatcaatggcagacagtaccgtgccatcatgatgtaactggctgacagtcaacgcggtcgcgtagccttcggtaatgatgatggtgtccggcgttccgataatttcagatgccagaataaagcttcctttcttctgtgtacccgagacaaggcgcttttcaccattcggtttgatggtctgagcgcccgtgatagtgccgtccagtgtctgagttaccagcaatagagaattctgtaatagccgctgattggggcattgcagcccctttctcgccaaatacggagattctccccttatcgattttgccaccagctccgcgatccgttctgcaatgggtttcactgttcggggctgctctttaactggtttgggttcagggaatggaattgccaatacatcagcaacctgcttagcggcggtcagaatagtgatacctttagctcttgccactaaatccagaccatccccgtgattgggctgatcgcactggcgacaatgccagtcgccatgatggttatcatctataaagtgaaaacggtcagtgcctccgcatatcgggcaagcgccatgcttcccctttgccggaacatcaacgccacaggcggttaacaagctttatgacgcatttgaacttgaccagatacaggacggccagactatgaagatagctacgaaaggcgacctagtaattatgatgtatcggcaacaatcagagagcaaataacacattgccaccacagagtaaatgatactgaggtggcaggacagggcaatcgcatctaaaattcattgacaatggtttaatttcatgtcgttatgcagcttttaaatccatccttatgtcctctgtcagccctttgttacagcattttgcctcacttgaagatccccgagttcaacgaactcagttgcatagtttggaaaatatcctgactatcgccatctgcgctgtgatttgtggcgctgaaggttgggtcgaaattgaagagtttggcgaatctaaacaggatttctttacccaactgcttgctctcactaatggcatcccctctcacgatacctttggtcgtgtctttgctgcacttgatgcgcaggcttttgccgactgtttcacctcctggatatctacgctggcacaaggagttgatcaggatatcatcgctattgatggcaaaaccatgcgccggtcactcgataaagccaacggcaaggcggcaatccatctggtcagcgcctttgcctgtaccaatcgcttagttctgggacaagtgaaagtggagagtaaatccaatgaaatcaccgctattcctaagttacttcgacgattggttttgtctggaagtctggtgactatcgatgccatgggatgccagaaagcgattgctcatcaattacatgaagcgggcgcggattacgtactgagcctgaaagaaaatcatcccggcctgtataatgatgtcagccattatttcgattatgtctcatcccaaccggagcgcctgagcgaatatgaagacgtggatgccggacatggccgcattgagcgacgcacagtacaaatgacccatgttgattggttgccggaaaaggcgtgctggtgtggtttacacagcataatacgggtgatccgcgaacgctatgtaggaaatgaagtgagccgggagagctgttattttatcagcactttacgtccgacagaggctcaacgggcagcgacagcgatccgcagtcactggcaaatagaaacgcaactccattggtgtctggatattgcttttaatgaagatcagcagcgaatgcgggaaggcaatgcagccgccaatatggcattactcaataaaatcgcgttgaatttactgcgcttagctcccaccaaagcgggaattaaagcacgccgtaaacgggctggttgggatggtgaatatctacttacagtactgggcaaagcgcatcaaatttagatgcgattgccttgggtggcaggagccatcctgtctcctgtttgattgttattataaacagtattgagtcgtgttatccgaatttaacaaaagacaagtagctgtacactctgcatataataggggtgacagagccaaaggtaagcagaaagaagcataagtctgcattgaagctaaaagagtcgtgcctgctactaggcaaagaagaagatattttttcataatcattctccacatcttttacaacgttattatcacaaagacgagtaaatctaataaacccatctccacccaacaacaagcgaataatactgaacaattagttactctctgaaactaaagccaatatttctttacccattcccttgagtggttaaaggaatcccccatgccatcagttaacacgggtggcatttttgtatctgcatttcaccgcgcaccgcagcgcaattctaacgtcgagcctttatttaggaatgaacctttgaggaatcagctaaaactgatgctactctacatacagcggctaacacatcaaacggggcgactggctgaatgggtaaaaaatcagcttcaaaaaaacactcttgtgtggttgcttgtgcactcgcgaacaagttcgctcggattgcttgggcaataacgacccaacgaactgagtttaatccatcctgataacgtcgaactaagtgactacgtaatcatagataaaagaagttacttatctggttttgcgaagactggtaattgatgactgaacggcctgacggcctggtgataaacctaacaaaaaaaatggctcatagaagccgggcggttaatgagatggtccccaccaccctgtgagcggtatgctggcagggtgtttctttcaggagaagaccatcatgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtgataaaaagactttcaaccgtcttggcagagaacgaacttcctccctatctggcacagttgctgatgcgcttacatgcccattatctttatcttgtcgaacagctcaccgagcttgagacggcactggagcaggagctgagacgtgatgaaacaggacagcgtcttcagacaataccgggcgtgggtccgataactgccagcgtcttatcatcgcagctgggcgatggtaagcagtatggctgtagccgggattttgctgcttcaaccggtctggtaccacgccagtacagcacgggtggcaaaaatacgcttttagggataagtaaacgcggagacaaaaatctgcgacggttacttgtccagtgcgccagagtctttatccagagaatcgattatcagtcaggaaggctggctgaatgggtaaaggctcagcttgagcgaaaacactcaaatgttgtggcctgtgcgctggccaacaaattagcccggatagcctgggcaatcacaacacggcaaactgtgttcgaaaggtaacgacgacgccagtctgactggcaggttaatcgttaattaaagcagttcccaatctggttttgcgaagactgattattgatgacatgaacggcttatcgacctgatggaatcctgacataaaaaatggctctctgaagccgtgcggttttttaggcttatcaggtgcggaactcatcgaggcgcgggcatccctgcccatagtgacgccggatagatttaagcaagccaacatcaatcaaaaatcagtgttgcaaaaaaggtggggaccatagattttgtacggatatttccgtccaggctggctggcgagacagagatgatttgctcgggcactacaatgcgtttgagcgacgcttctatgaaaaagattgtctacaggcattgtacaaagcccgtacgccacgctgggaggatacctgtaatgtcatcctgcttgacgagatgaatctgtcacggcctgagcaatattttgcggagtttttgtccgcgctggaaaaaaacaatgcagatgaacgtttgattagcctctctgagacggcgttgccaaacgcaccgcagatgctgcgggaagggcgcaaaatcctcgtgccgggcaacgtgtggtttattggtaccgctaaccatgatgaaaccacgaatgaatttgctgataagacctacgatcgtgcgcacgtgatgacattaccaaaacaggatagtcaatttaagatcaagccaatggggaaaaggcattactcctttagttcactgcgcaaagcatttgaggcggcgcgccagaaacacaaaggcgaagtgacggaactactccaggcgctaactcgcgatagctttaccgattgccttgaccgcgagtttaatcttggctggggcaaccgttttgaaaagcaggcgctggattttattcccgttatgctggcaagtggtgcaatgaaaggtatcgcgctggatcatttgctttcaacacgcgtgatgcgctcaggtaaagtcacggggcgctataacgtgagtgttgatgccgtcaaggcactgaaaggggcgctggagtctttctggagtagagaaaaactggtaggtgagccggtcaaatcgctggaatttctgaatgccgatatccgacgcatggagggacggaactgatgtggctggatcggctaacgggtgaaacaatatctcagctgccatcacagattgaagcgggtcgttatcagcttgcggtctcgtctttggtcttcaacagccacaccacggacttttctggtgtgctggttagcgatggcggcgagcgttgccagttgggagatgaggtccggacatttgtcatgccgcgacaggttaagtccaataaatccgccttacttttcagggcggtagaaaccatctatccggacatgatgccttcgtcagcgttgatttcgcctctcatgcctggggcgatcattgaccagcaaagccagcttctgccatttgaacagaacttgctcgaggtggtgaagaaagggcatctgcaccaaatttcacagcggccgcgtttggatgttcattacgaagacgaagtcgcggatatcgcccgcgcacgacgtcttgcgaaaggtgcgctggtgcatctggcctcgcattcagagtgctggcagcggcagacactcaatggcgtcattccccggaaggtactggcgcgttttagccatgacgattacgacatttatgaaaatcgcgtttatgcgcgcctgctcgataaggcagaacgtcatttgcgcacccggctatcgacccttctaagcctgcaggtcacactggagcaggctctggaattttaccaaacggagggtactcatcaccttctggcctatgaggtttgtcagctctggggaatgacatttaatgaggataagacaaatcaggcgttggttcacctgaatgaaactgtggacacccttcacatgttacataaaaccctctctggtttgcaacaaacggggttgtacacactggttaaccgcaatgcacaggtcacggggatactgcatccaacaaatattcttggacatgacccgcattaccggcatttgactatgctttgggaacttctcgatagcacaaccgtggagaaaaccacgccacaggaacgtttccggcataatcagtatctggtggaagcttattcgcgttatgcaggtctggtattaaggcatgcgctttacccttatctgcagggcgaaagcgaaggtttgtgggcaggtaaaacattgcaactcgcacaaaaggggctggaatggcatttgatttgccggacagagaagggtaattcagcaggtaatacattgcttattctggttccgtggctcactgacctggcggagcccattaacgagacgaaactgacctctgagcgatttgttgcatggccgtctcaggatttggcgctatcaccctcaggctacgtggataactggatcgcgctttcgccgtcagacatgtactgtgtcgaacgttttggcctgcttattaatcgaaccctttaccggcaggttctgaaatccttcgctagaccaatcactaaaattccgacgaaagcgctagccgtggcggaaaaaattgcacatatccacgttgaacatcaatcacattgcctgacggtgcaaggtgaagtggcggatatcgatttggaaaaattaaagcgcacattgaaagaagcgaacgcacatgaaaaagcctctgatgtcgtgcagcgttgtcgggagattttgtttctgcaaagctgcccggtttgtcagcacaaaacaactattgctttccagcctcctggtggttttaagacgatctgtggcaagtgtggtacagagcgttatctaaggcagaaagaggaagggttgtttttggagcaaacaggcaccaaaggtgtgcaaacaagcaattttatgactctgggaaaacgaagtttctccatgcagatttaatttaaaatcctgccttaacttctgattagttattcacgctcgcttttccgccgagcgtgaaatgtgcattgttggtggtacagaatgacatcaattcactctgctcgcacaataagaatgagatttaaaatatggaattacatggtcatttgttgtatgtggatattacttagatatgcggtattggttgcgttttttgcatgtacgcggatatctttgcttgccgatgccttatcgactggcttggctgaagaaacgtacgcatgggggaatccaggcgctatcaaaaatattgtggcgcaggccagagacttaatcgtaaccattaccgatgagcaattaatctgggagcaggtatactgaaacgacaacatctctcggtaatttgtccgtcagtctccctcggtaatctcactaatacaagaaacattcctatatcttcctgttgtatactttcagctatattttgctgttgcggccaatcacgcgcaacatcttctttgatatgtctcaatatctgtggctcgattaaggttagtaattttcctagaaccagaaggtcacgtgtgccctcattttctatcgacctggcataatactttccaaacccattcaatccacctaataaccctagttgtacaaaatcaaacaaacatcacaggtcaacaagcgtatttaacttcataataccttattaacccgaattctggataagaaattgacgagaagcctgttccgggagcaaagttttggtgaacgcctaacacagttcctaggggaataggctatggacaacttagttgaaattttctgcgatgtcgacgatttttgccgttttttcattcctcagtgggagcggttttgtctcgataacgggtaccgttttcgttgtcggcaaggtcacatgtatctcagtgaaatcatgacgattttgatcctctttcatatgtcacattatcgtgactttaaagccttttatttgaaattcctttgggtctatcaccacaaagattttcccaccttgctcagctatacccgttttgtcagtgttgcgccttccgttatggtatcgctaagcagctacctgagccgttcatataatcatgctacctaccttgatgaaaagaaggcaatgatgcaagaatggtctgctaatcttgatgagtggtctggataggtagacaaagttccagagaatagaaactggctctagatatgtctaatcaagtataaagtggtacagtatatagataagttaggatgcggacagtacggatgctttttgaatatgcccttaatgattcaaacacaatagttcacgtagattcagtgccaaacggaaagcgctgtaactgtgtttgtaagcactgtggtgataccctcattgcaaggaacaatggaaagatcgtcacacaccacttctctcatactacaaaggaagaaagccgtgactgtcggatgacgcagttacatatagcgatgcaactacatttttcttcgctatctgaaattactcttccaacaaatgagataaccatcgacgaaacagatattgttgttttcgacctaacaactgaagttaaaaaatcagtactcgaatataggatcgggccctacctggcagacgtatatcttgcgacagatactggctatgtagctattgaagtctgcgttactcacaaatgtgatgaggataaagaacggtattacattgaccaacaaattgattcaattgagtactactttcctcttgctaaaggtaatagcatctctgaatggatttatctagtaagaaataatctcgtcgagtacaaatggatttatcactcagaacttgaaattaagaaaatcgagtattttaaacagatagaagaagagaaaaggaataaaaaggcagaaaaaagaaacagtgctttaacatcgcttcgtaacgccatatctagcaaaagaattcacttacccaatatacataaagagatggagcatatttatgcaggacaatcttacaaagaaagactgttgatctattccaaaagggatgtaacttgtgacaaggttttactttgccatgaatcaagtgactattcggtaatagaaggatatatagacaatcgcgtgatatcgattatctattcttttaccgaagagatacctactctaaattatcaagatgacagaagtatagtttgttgtcattattcaaatgaatcgaatacatcgacgtggacttgggttaagcatccatcattaaccaagaaatttgataaaataaagttacaattcagatctgattgcaagcatatctatcataaaagagtaaggtcagtatatctaaaggatgaggtgaccaagttcgcatccgaatacttagataaccgtcaagcttactttaatcgggactatcagaaatggagaagatggatgattaataaagagttatttatacctagccaaaataaaaaaaatccttcattccctgacatcttgaagaagagagagtatcgcatgctctggccattccaagcatgggatataatagtgttatgtaatctagcagaaatggtggatgcttaccctgttagccagaagatatattaccacgatttatttattgaactcgtaggaaaatatgatttatcagaacaatatcgatacctatcgaaagagtttaaagatttaaatacctctactactacctttgattcacttattgatgaagatagaataattcaaaatgtattatctacctttgactcacttattgctgaagatagaatgattcaagatgcattatctccctttgccaagatgagtatcatttctgttagcaaggatcacttaataagaaaaggttctcttatattagcactagtaatttagcctcatgttatttatatgccatctactgatcattttacaagcatttagcacaaaatactacaattctatacagggctagggacagggctgctctcgctgccaagctgatctgtcccctattgattgagaagcattactattaattatcctttcgttctgatgctgataaccattgctgactataagcagatcagtctgctcctcgctcaaacctgcctgccaacgttttctcgcactatttttagtttttgttggaatcgaataagtaatttgcgaactggtcgtcaactaaagtatgaacgagtaagcggttagatgcgaatacacactgtgtttcactcttctacgattcgggcaacacctccctgaataaaagactggcatcgggccgcatgtttctttaatacttccccctgctttttatcatagtctttgtcccagggaacaaagtgaagcatattcagatagtcatttttgatcgtggccggacacagaagtttaacgttattaagggaataaatcagaattccttcaaccgtaaaacttttgccagccaccagtggactaaccttccactcagaacgcgtaaagagtgccatcggcattctgctttcatctatctgatagcgccggatatgccagtctgccacgccagcggcagacagcgatttatcgatgagtacaggaatgaacgaggggacatacatactgatgagtaggatcatggtcaggatgattatccctgaaaaatgccgaaatctcttcgtcacaacggcctggcccaatttcacgtaccccattccgggaaggatcgaaagcagagcaacaataagcatcgatatacccgtttcatcagtgtcgcaccttccgttttagtggcactatgtagttatctgaattccttatccagaattcagataccgtctcagtcattaaactgcaagcggtatttctgcgttaaataatgtgcctgatttcatcacgccatcggcactaacacacaatgtcggatagacgacacctgttaccaagtgccgtcctcctaagaaccgtacgtgcaactttcactgcatacggctcaagcctccactaaggcgtattacgttacccagcaacctacattgcagtcagagcaggatcgtgccaagagtgacgactttcctttttcgatttactcttagccaaataggtttggtattgaggatcgaatagcgttgctacactcctaatcttcacatgcctttttatcggcgtttgagctatttgaaccagattaaaatggccgtccatattggctattttctgccaaccatgaaattgccattctccttgacggttcatgtagtattttcgacgtacccaatctttggatttagttggatgacgtctgaccgcccatcgccataacaaccagaagagttgatgacctggatagccgaaggttcgctttgccacgcaatggcgataataattcgcccatcctctcagtttgggattcaacattttgatgagatcgtttactggagtcgttgcgtgtctcttaatgagttcgcgcaggtgactcaaaaataatagcacgttacttttactcagttttatgaggagcttgcctctgtactttctaagattaaacccaagaaaatcaaagccatcattgatatgagtgatatgcgttttctcttcggagagtgtcaaacctctttctctcagaaaatcaatgagctgtggcttgacttcattcaacaagacatcttctgatgcccctgtcatcacgaagttatcggcgtattcgatggagtttattctatcgtccgttttacgtgccacttctttaacacgcttttccaagccagccaacgtcagtagcatgagcgtcggagagataataccgccttgcggtgttccttccgctgttcgataaaacaatcccttatcgataaaatccgatccaagccactgcttcagcatccgtttgtctatttgaatattttcaattagccattgatacccgatcttatcgaagcaggctttgagatcctcttccaaaacccatcgggcagaacgtttttgacacaagcatttgaagcattgtgcaatcgcgtctgccgtgctgcggttaggtcgaaaaccgtaactgttcggatcagctattgtctcagagattggatccaaagcaagaagatgcaacgcttgctgtgttctatctatcatgcaagggataactaagggtctgagtttgccgtttttcttggggatatagagacgcctgagtggtttaacttgatagcctttccgacttcaattgatttgccgcagccatgcgacgagcatctgtgttccaaatgatgccgtcaattcctagtgtgtgactgcctttgttttgagacactcgcttaacagcaagaagttttgctaatatcgagtgcgtgagtacccactgcaacgctttcgccttgccgtgttcaccctctcgggttgcttttgcaatgcgcatttgaagctttaacacatgcgactcaatcgctttccagtcaatggattgccactgtgtgccgttaggagaggcactcacttctgtagaagccatcatttgcgtttctccttaaataaagttcttcaaatcatcttgcaatgggagacccgccagaagtcggctcgctttcgcgccagatatcaatctgtatccgcctcattacaacgcggccttcgctttttctagcctcctttacctgcacatctatcggctctcttcacagataactttcccaacgggagatatacaggcttaccttgttccgtatgtcgcgcaaaatatcaggttagatgcccactctagtacggagagtttatcgatcacgaaagagtactgcccaacttctttccaactctcgttgccattttggccacagcgtattaaccacttccgctgtttctcatataacgtaccttacatggattcacctatgttcatcatactgacaccctggcgcttacccgatctgtggttatcaggaagaacctcctctcacgattcgattcccattcagccttgtggccgaatttcgttacattgtcagatccgctgctttattcagaatcccagggtcacctggtgatacaggtggttcactcttctcgtggtgaacaacgcttcatacgacttcaggtcgcacgggcataaatgagttatagaccaagcggccagaacgggtcaccgcgtgaaatgagcattgacagcctaccccccgattaacccaaaaggccatcgtgttcctgacattattttttgtcccgggaaatgaattacccattgaccttatgatttccgtttattagcgtagtcagacttatcgatgatccggtcgcttgtaaggatcaccttcgggcagcgacaataacactcctgtaacctgcaagggagtacacaaccgtgtggtacatctgcgcacctttggaagcagatatcgtcagtctgatgacgatgaaggtttcttaatctcaaccatcatggccaacaggccagtcacccaacggggaacacgtttcctattgggtcaggtgttccccgttgttttatcaggagaataccatgcaacaaaatacaaccccggcaacggcacacactgtgcccgcgtctgaacactccccttttgctgaaatttttccacaaaccagttcactggaattgatgctgctggaacacacgttcattaaagccgccgccgtgctgtgtgacgatgaccggtgtgatcagtgggagtaccggaaagtgtcagacaacatcgcctatgtcgtgccggcacggtcggattcatctgttgtcaacgtcaataccacgggctttaaaggcgaggtctccgccgatgccttcgggctgatggtgaccctgagcgtgttgggttatctggcggccctgatgaagctggacgggtacgctgaacggttttgcgacctgcgtgaatatgcgctgcaacatcctcaggctcagtgtatccgggcggctttaggcttaaaggatgcatagagggagaacgtaatgccaaataatgaactgattatgctggacagtcttgcgctgtcggtcgtgtttcccgacaaaaccccgctggaacggttgtttctggggttcctgctggcgaataccgcatcaacgttatgcggcgattatcagcctgaacagtggacaagccgacaggtgtctgaatcgctgacttatatggtgccgacacgggcggaaacgtattccgtttacctgccggatacgcagctgacggtcacgctttcagccgatgccttcgggctggcggtcacggccatcgtatcagcccgtatcgcggtgctggagaccccgaatgaggaggtgtaccggttctgcgcattgcaggagtatgcacaacagcatccggaaagcggcctgataacatcgatcatgacactgaaacccagagaggacgttatcagtccgtcacttatccctgacaaaaataatcatcactgacgttatcagcccatgaggctgttaacgcttttcttcagcgcctgaccggggaagcgaaaacaccttcccggtatcgggcgggtgttttctttatttaacgtgaaatcaaggaacaacaccatgaatcccatttttttaccggcaccggatgaggccggcaccacattacgtgaagagctgtttaccgctcaggtcaccggcctgaggcaacacccgaaagcacttcaatcattgcagccggaaaccctgatggtgtgcgaagccgccaccgtcgcggaagtggtgcagcggctgaaggtgatccatctactgggtgactggccggtgccggagaggttatctgctcaggtttcggggactttttttccgctgaccgtcatgatttttgacgcacaggacagaaaagtgctcggtggccggtttgatgaagagattatctgggcgcagccggtcacactgacgtcagaacgcctgtcattggaacagcaacagcagcggttatgtcaggcagcgatgcttgagcagagctggcagaatactccgacggcgcgtgcgttgtggcacaaggcacatttattgtcactgcacatggtttcatcccgttatcagcagtgcagtgaagtgcaggatattctccggcacggcgtatctgtcagtattccggaggccgcgtgatgaccactacacgtttaaccgtttggcaggtgattgcggcggctttgctgaaacggcattttggcttgaatctgactgacacggtattgtgtgaaaccggtacggtggcagcactgatagcccgcggtgtccggccttcagaagccattaacgaactggtggataaatacgacttaatccggctgaacacgcaggttatcctgcgcagtacgccttatctggatatccacgatgagctgacggttatttttgacagtggtctggctgacaggctattcaggcagaccggacagtaatcctttttgttcaatctacccatcgggggaactgtgccctgggtgggccgttcctcctgtttattcttatcattcaagtgaggaacttaaccatggcagaatggtgcactaatcaactggaaatcaccggcaaatccgtctgtctcgatgtaatgcagcagtgggtctgcggggaagaagtcccccgttaccgtcaggcggtgttacaaagcctgcggttatttctggcgggttgtgcgggaatactgaaaccgaccaaaccacaaacctacactccgtacccggcgctggtgcgcggcacggcggtgccaacggcgcagcatctggcctttgagcagtggttgttgttgttacagaataatgtgccgctgaataatgacaatatcaaacgcattgataacctgtaccggcagtccggtctcagcctgatgtcctgggacaaggtgccggaagcggcgcgtgatattatcgcccgtctgctgacccgccagtataccgactggttcggcatggtgggctggtctgacacacccgatatcggggcatgctgggataagctgaatgcgtacccgcaggcggcacagccctgcgatatgctgatgatgatgtcaacgaatctggcgactgaaatcaacggtaacagcaccctgctgaaaggcattgccacgacagcgcagttttacgaagagcaatacgggctggaatggccgtttggtcaccatgtccgctgggagcgccgcaatgtcagcagcttaaccgtgcgctttgattccccctgggcaccgccttcacccgaactgatgggcgagctgtccgcgatgtttgactgtgaaatccgccactggtacagcgatgcgtcaggccagctcaaaggctacgattgctatgaccagggcgagcacgtggacagcggctacgggcagtcaggacgggaaaaccggccggcactctatctggtcaccggtgagcaggcggaaacggcactggctctgccggctatcgcggtcgggcaatagcccttcgtttaacgcagtatccatttatttttacctcaaccgaaaggggaactattcccttttcggggtgtgttttccttttttcgctttttgttcagcaaggaaaacacgcaatggcctcccgaaccgatcatcagaaagaatttatttcgctgtttaagcaaacggcccgttatcatacccgttatcaggtcttccgggatttttgcaattgtgctatggcagcgatccacaataaacactgtttcagtgaggagctggagcagtattatctgaaaaccattaacaagtacgagcgggccgatgttgaccggatcgtacaattgttttcgcatgtggtgctcggactggcgcaggaacccggtgattttctgggtagtgtgtttatgcggctggaactgggtgataaggatcttcagcagttctttaccccctggagtgtggccagaatgatggcacagatgcagttgcaggatgccgccgggctgttgcagacacaaccgtttgtcaccttgtgcgagccgtgctgtggtgctggctgtataactttggccgccgctgaagtgctgcgggagctggggcacgatccgttgtgcagtctgtgggtttatgcgattgatattgacccgctggcggccgtgatggcgtatattcaattatccctgaccggtattccggccgccgtcaccatcggcaatgccctgcatgatggtggtgacaagcgaacccgttatacgcccgcgcattatctgggcaactggtctcagcgtttgcgggaggcggagcttatcgccgcctgaacgcattttttcaacgatgaatattgcgcctttcggggcgctttttttttgtttttaaatggcgttaatacaaagggttatagtgaaaattaagctgattctttaaatcaatcaggggatgaaccgggtcagtttaattttcatttccgaaaaaagagttgttccttgtttccggcagggattgaccgacactgagccaaatctgaaccgaaagaggaaaagtgatgtttcagcgttttaaatcccgttttacccgccagaaactcccgcaacccaaatcacgcccaccggaagacagtcggtttttttttcaaccccaatcggctgacgaattgttagcaacgcccctgcgccgtcaatatctccaacaattatggcaaaacagtgcgctccctgaaggattgtatcagcgcttttatcttgcgccggtgaagcaattgctgggtaatgtccagcaggtgccggcaaccccgaagggggaatggtcagcgtcggggggatttgctgatctgacgctggcatttaccacctgtgctgtacggctggcaaaagggcatatgctgcctccgggggtaccgccggaaacccaggccgtgcaaagtctgctgtggcaggcggtggtattctgggtcgcgttgttttatcacctgccgctgttgcggcaactggaaggggaactggaagacgggtatcactggcaaccgggtgtctgtgtgcctgacaaaccctttcgtttccgctttcgcactcctgaaaacacgccttcgatcccccaggaagcgttgctggcggcctgtctgttaccggaaaaggccatgatgtggctggtttcggtaccggaagtctggcactgcctgatgcagcatcttaatggccgtccgtccactgtgccgctgattgatgcgctgcttcaggaagcggccggattggttcattcaccgcgggtgaagccgtctgtttcacccgcagtggcagacacggcttgtgtgtctgaaacgggagcaacaacggctccggaaacaacaccgatcccgcccgccagtgaaatgaacagttcgtccccgttcacggctgacgatacccggacactgctgtcattatttcaatcaactgattgatttcttgacggcaacctgacggaaaaaataaccatcctgactcaaaactgatcaaacgatcgggacgggagaaagaagtattgtcactgacagtcacctaacttcatcatttaacaataaataatttaaatagttatgggtattttgggcacctgaagggggcttctgaacaggaaaccgcatgaaggcgtgataattgagggaaaaagaagatgttgtacacagcagaaacattcagttgggaagcgttattagacgagtactttttttcacatatcctgagaccggataccgagtggagttaccggaaggtcgtacggggttttatccggtttatgggggaagcggcctcaccggcgcaggtcactcaccgggatgtgctccggtggcggcgtcatcttctgctggagaaaaaacagtcgagccatacctggaacaataaggtggcgcatctgcgggccatttttaattttggcatggagcaaaaactgttgcctcataccgagaacccgtttaataacgcggtggtgaaaaaagagaagaaaaagaaaaaaattctgagtgaatcgcagataaaccgcattaatctgctgatggggaaatttgcggaagacgaaagaactcaggtcgcaccaaagggagggcgttgtgccctgtatccgacctggtactggtcaacggtgctggcgacattgcgttttacggggatgcggcagaatcagttgctgcacctgcggttgcgggatatcaacctggaagggaactccattgaactgggtctggcaggcagcaagaaccactgtgaatgggaggtgccgattgttcatcccctgaaaccccggctggcacacttaattgaacgggcaaccgccgccggggctgaagctggcgatccgatttttgacctcagccggttgagtgtgccgcatccaagccggctttcccgttacaaatacgatattaaccgggaaaaacaacagctccggtctttcttccggcggttgtccagagagtgtgactttgccgtctcccctcaccggtttcgtcatactgtggcttcaacgctgatgaaagcgccggatcgcaatctgccgctggtgaaaagattgctggggcatcgtaatgtcgcgaccacgatggagtacattgatctcgatatggaagtaacggggaaaacactggagcgggaactggggttgtacaccgaccgtgctgatgaaagtggcggtgagagtgaataaaacggattaaaaaagacagggcgggtctcagacaggatttaggaggtggtttgtgcgagctgccctgcatcaatattgatggtatgaaaaaggaatattactgatcctgcatcccgtgaagttttcactgacttgacatcagaatcaattactgaaatcattaccttcaacaagaaaggggtaactgttaaaacagctacccttcaatcttgtctaaacttttttaaacaccacaatagtgtgcaaattgtcattcaacatcttattaactattgtttgtttttcgcgcctttgtcaggaaatttaacaacctctgacaaacccgcataaaatcttggtgcccggactcggaatcgaaccaaggacacggggattttcaatcccctgctctaccgactgagctatccgggctaacggggcgcattaaaccgtattcagctaaatccgtcaatgactttctgcgaaaaaaccgtgaaaaacggtcgtttgctgtattttcatcccaatttagagtgattattcagattgggctgctttttattaactgaatgcgccattttttcggcattttgcaatggtcagaatatcctgtgccagcaattttgccgttattacatcttcaagttctctttttactaatagtttgctgaggcatccctcaaggatcagttccatttgtttggcaacccgttcactgttttcgatctcaagttgctgtaataactctacggtataatgaaaagaattttgtttttgtagctctgccaattggtggatcggatgctctgtatcagggaagacactgcaagctgcaatgaacagacaacccggataacgctgtttctgtactttttccttgagggtgtcgtaacgtgccagtaatttttgctcagggctcaaaacctcatctagcaggatctggcgctgccagatttcaatctgctgaccgtgatggcgcaggcaatcgtagagcaaggcttcgcgatcaggccagaaatgctttatttgattgatatcaactttcaggggagttaaaagcgtctccaatgttgatgacaggccatgctgctcaagtaaagtcagggcatgactaagaacatattcacgttgcacaattactctccttttaaattatttttgtagatgctgtaaatggcggctaaagcgtcctgcatccatgaaaccactgactcgtgaatcgggtagctcttttccatgagcatcaaaaaacaagatagtgggaagccccaataccttcaatttatccagtaattctttctgttttgaaccgttctccgtgacatttgcctgcaatacgaggaattgactcaattgcgcctgcacttgtggatcggggaaggtgtatttttcaaattccttacacgctacacaccaatctgcataaagatccagcatgatgagttgatgacggttcttggctaggatctggcttagttcctgccagttactgacttgctgaaacttcaacgatggttgctgttgtgtcgtagctgaatttccccatacccaatcctgtatggggcgggaggcgatgagtgtcagcaccagtaagatgagttgcagggtgcgtagccagccttttttgctgtttaaggtcaatgcgaaagcccagccaaggaaagcgattgccagcaaactccatagtcttatgccccacgtatcaccaagtacacgctccaataggaatacagggagcgccagaataatgaatccgaaggcttctttaacgtactgcatccacgggcctctgcggggcaggagtttgtgaccgaatagcgtgacggcaataagtggcaggcccatgccaagagcatagaggtaaagggtcagcccgccaagcagggtattaccgctttgggcgatataaagtaaaatggcactgaggggagcggtagtacagggggaggcgatcagccccgccaggattcccatgacgaatacgccaatgtaagagccgcttttttgttggttgctccagtcaactaaacgagtctgtacagaagaagggagctgtaatgagtacatcccaaacatggacaaggccagcaaaataaacagaattgatagccccaccagaatgtaagggttctgcaatgcagcctgaaactgcaatccggcggcggcaacgatcaatcccaacacggtataagtgagcgccattccctgtacgtaactcattgccaaccagaaaatgcgttttaagctatcgggtcgccgctgtcctagaataataccggaaatcaacggatacattggcagaacgcaaggtgtaaaggcaatgccaatcccaatcagcaatgcccataatggtgaaaatggcacgtcaggtacgttgggaggggattcttcctgcggcaatgatgccttctgagatgtcgttatgtcaggttgttttgcggcttcattggctgaaggagccgaggcaataatggctgacaatggcacagttattgtctctggagcatagcagaatccggcttctgcacaaccttggtacgtgacttgcaaattggagtcattggaggcagaaaggataggggcgttaatctgtgctgaaccaaaatgaaccttagtcttgccaaaaaactcatcttcgtgatctaccgattcggagaaattgagatgacccaacgttgcttttatcggagtgataatgaactgcttttgataaaggtaataaccgggtttgatatcccagtttagtgtaagttcgttgcctttctgttgaaaatcaaacacgaatgcttgggctacaggaagatagcgattttgtcccggctgctcaaacagcgcattggccttgacaggagaaatagctataccacccaacagcagaaacaatatgagaatacgtttcatcataagataatctttgacctgtctgtatcttggttcataaaatttgccagagttagcatgatatctgagttagaactataactgatgaaactcatggcagaaagcgactagcctaatattaaggcaataagcgggttattttaagaaaagggtttgaggcgggaatatttcaggggtgtttaagcccctaaaataacatactgaaaatttggataattacaggatcataccaccaactaggaaaccgaatgtcacggctaatgcaacagcaatggtacccggaatgaagaatgggtggttgaatacaaaacgcccaatacgagtggtgccggtatcatccatctgcacagccgcaaccagagtcggataagttggcagaataaataggccagaaaccgcagggaaagaggcgagagccgtcagtggtgtgacatgcagcgccagtaccatgggcatcagagccttcgcggttgctgcttgcgaatagagcagagcagagcagaagaagaatataacagccagcagccacggttgggcatgaatcaaactacccgcggtttctttaatccaatccatgttagcttgaacaaatgtatctcctaaccatgcgacacccataatacagatacacgcgctcataccggctttaaaggtgcttgaatttaaaatagcatcggtattcactgagcagataaccgttgtgagggtggcgatgcttaacatgataatcagaatcgcgctggtggtatttaccagtggtttttcaactaaaccaaggcttggactgttaataatcgcataaataacgatcccaactacccctaacagaaacagcagtacagagagtttagcttttggcttgatatcaactttatgactgccgcgtagctcaattaggccatctgcaaggcgtttttggtagacaggatcgtcagacagtttggaatcaaaaaaccatgagacaatgaatgacatcaaaataattgcagcaaacgatgagggaataatgaccatcaacatctgaatatagctgacaccttgcccttccatgacagaagacatataaactacggctgcggagattggcgaggaagtcagtccaatttgtgcggctacgacagcggttgatagcggtcggcatggtttaatgccttgctcttttgcgacttcggcaatgacaggttgtgttgccagagagatatttcctgttcccgccaatagcgtcaagcaataagtgacgatgggtgcgaggatagtgatgtattttggatttctgcgcagtagtttttctgtttgttgaactagataatctagccccccagccacttgcatgacagaaatagcggcgatgactcccataatgattgaaataacgtcaaatggaatgtttcccggcttgattccaattgtggccaatattaaaacaccaagtcctcctgcaaatccaattccgattccccctagtcgtgctcccaaaaaaatggccagcagaacgataactaattctacggctagcatgttatgtactccttagtttatttaatgttgtgaaaatttattgttaaatttttgtattgttgatgaaaataaaaggcattcgaacccactgagtgaatgaattgatcactaaaaatattgtatttcattaagtcatcatcaaaacgttttactttatatactggatatttttctttattaagtaatttaataaagattacatcattatactttgttttaacacaaacttttcacgtttttataagtgtaaattatatttaatttttgatataaaagtgagttacgattcataattaggaatagcataaatcatgtatctatagcgttaggcattaaattacgataagtaatttcaatgtgaatactgtgctgctgttaatgtataaaacatttttaatgtgatgcttgttaatctaaatgttcactaaatcaccttgatgttatcaaatggcaagagatatgaagtatttttgatggttataattaggtatagagcctgtaaattaaattgtgtatttaccttatctttgctcatcaagaatgttgtgctttaataaattcgggcactttggtaaaggaatgagtgactttaactaacctgagtttcgtttaagaagagaactaaagcgcctgagggacgatcaaagttttgtcaaagaaaactgaatagtaagactcctcaggctatgactactttagaagaactttattgctgcgtcgatgatttctgccaaaaatttagccctctctggcatcaacaacttatcgagaatggattatgtcaacgtaggcgctcctttttcctttctctcagcgaggttatgacgctcctcattttatttcatatgagccattaccggaattttaaatgcttttatctcgagcatgtcatcctttatctgcacaaggaattcccgggattagtcagttatacccgtatgcttacgttgaaaaaaagagcacttatttccctgcacacattcctgtcatcacgtaaaagccaaaccgcaggcattgcgtttattgactcaagcaaaactggctggttttatggttttaaacttcattggcttattgatgattacggggcgcttttagcggttaaattgacgcccggtaatacggatgatcgtcaatcggttaagacactattgaatggggtaatcggacatgtatatggcatcaaaggttatctttcacaggcactgtgtgatgagcttaccgcagaagggaatagaacattcaagacaccgtagtgtactcggttttttgctcgaagtggtgtcaggattaatggcttacacttttcagccgaaaaaaccgagcctgaatttacggagttctgaacgggctcttcttaaacgaagctgaggctaaatactctatttgaaggttatggcaatcaatatttgcaattaattgttcttgaacacttaataataaataagcgatatgatattaaaaataaaaactatttatattttgaattcaaatagccatctattattactttaaatagatggccatatttattattttatcctgcctgtcatccgggcataagagaataatccacccgccgcgacaatattcgccagttcgccaaccggatcggtgggatatttttcactattttccagcaaagttactgtctggttttcaatatcaatctcaatacgatcgccagtgactaatttgtcacacaagcgttcctgtgcagcaacgggcaacagctctccggtagaaacgcaattacggaaaaagatacgtgcataagactgtgctaaaaccgctttcacacctgaagcgcccaatgcagcgaccgcatgttcacgcgaagaaccacaaccaaagttctgtcctgccacaataatcgggtactttgctttgccctgttcttcatcaataaagggcagagatccttccggtaatccacacatcgctaatgaagctagttgagcgtatccttccggtgttgaggggtttaccttgaggtattcagccgtcaggatctgatcggtatcaatattgtcagtcaagacataaactgtgcctctgatgatgttttcctgcaacacactcataaaaactcccccggattagtaatacgtcctgtaatggctgcggcagctaccgagtaaggtgatgccagatagatattggcgcgtttatgccccattcgcccgacaaaattacgattggttgtagagatgaccgatatcggatcattcactcggccaaaggtatccggcgggccaccacagcaagccgcacatcctgattccgaggaaagtgtcactccggcatcagttaagatctgataaacagaaacaccatcaatctgggtggtgattgtcttatgaaaaacctctttggtagcagggacagcataagtaggaatggagactttattacccttaatgacacgagcggccgcaataaaatcttccagtttaccgccggtacaggagccgatataagcctgagaaatagcaacgttggctattttctcaatcggaacgacattatccggtgaatgaggtttggcaatcatcggctgcatatcggaaacatcgatgtttaacacccggctgtattctgcatcctcatccggataaacaatctcaaagggaaggtggtttctctcagccagataatcaagggtggcctgattaggcaccataatgccattcttggctccacactcaaccaccatattgcaaatggtcatgcgttcttctacagataattcatcaatgacattaccgccaaattcgatagcttcataagttgcgccatcaaccgttaactctgacaataccgccagaatcatatccttggccaacacgtgcgggggcttggttccggtaaaattcactttgatagaagtcggaactttgaggggaatttcccctgtacctaacgcataggcagcatcggtaatgcccagtccaatggcgaacgcgccaaaagcccccgccgtaacggtatgagaatcggttcccaacaggacttcaccggggcgagtatgccctccttccgccagaccaatatggcagacccctttatagtttggtgttcccacatcataaaaatatttgatgttctgctcggcggcaaattcgcgcattacgcgaatgttttgattggcctgcgggtcagcagaatagacaaaatggtcggggataagaataaagcgagtcgggtcccatattctggcatcttggccgaactcttttttaaatacactggcgactcccggtgtgcagggatcatgagacatcaggatgtccactttcgcccaaaccacttcacctggtgtgacctgctcacggccactcgctcgtgcgagaatcttttgtgtcatagtttggctcatctcacattgcctccgaaagattaaaacacattaaaaaaatagaagtcttaacgacattactaactcttatagcagggaaataccattgttgagcgcactgtttctctactggaacagttgttcttctgaggggaaattcctgcgcttttattctgacaccatttttgccgcgcagtttaatgcctggttaaaataccacctttatctgattgagtaatattggcctttctccataacatctgtgatatgttaggcggagattcccccaagtaaatcatcaggctatttcatgaataatatcgaaaatcttacttcgatggtgatctttgcccgcgtagtagaaacactgagttttactgaagctgcgaaatcattaaggctgtctaaatcttcggtcagtcgtgagatcgcacagctagaagtaagattgggtactcagctactcaatcgcaccacgcgcaaaattcaagtgacggaagtcggactgagctattaccaatactgttcccgtattcttaatgaagccaaaagcgccgagcgttttatccgcaactttcatgacgagccgatgggaaacctgcgcctgattgctccggtatcctttggcagtcagtgtatcgtccctgccctgaataactttatcgccagaaacattcatgtcagcgttgatctggaactgaccgacagaaccatcaatatgacagatgataactacgatattgcaattattgtgggacgagaaactccggatcatccacttgttatgcccctgattgatatcacttgggggctttacgctacaccagattatatgagtcagtttccgccgatagaaaagcccgaagacctgccccgctacgattatctgctgttccgtggccctgcccatacgatttccctgccgttccgtaaggagaggcaaaagctcgatattgaagttcgcagccgttttcgcatcaataacagcgtggcgttgatgagttcggcgctgtccggtgcaggcattgcttacctgccggattacatcgcccacgaatctgtagcagaaggcaaacttgtccggctactgccgggatggcacatggatatttatcaaacctggatgatgtttaaatcagaaaacacactttctgcacgtgtgcagctatttgccgacgctttgcagcagaaactacagggtgatctcggggacagcaaaagggaagaatagacagggaagatcagtgcgggtgtatccataacaataaatacacccgcaagaaaaatcagtaatagttaccgtgacggtagtcccaggttgtgaagatatcagacatcatcaccatgatcttatgcacatccagtcccttacggatcaataccggacacggggtgatatcgcgctgaccattctgcatcggcaccaatgccccgttgtcatccaccattgaaatcattactccctgttcatagcgggtctgctctgtttcgtttggctggatagatttaacgtagtggttggcatcaataatcaagtcagcacgttcttcaatgcgctcaccgatacactccaccaagccacggttacctttaccagatgggttagccgagctggcaaaagagaatttgccgtagttttcccacagggcttttgccagaatttcgcccggtttaccgaatttaatcacgaaacaactggtgccacggccatccatcatcagcgccttagaaccatcatcaggaatacgggcgacagcgtcttctttccacggcaggatgcagcccagcaacacatctgcatcccaatgtttttgatacagctcttcgatttccgggttaagctgagccaattctttcaactgttcgagagatccacataacacaacgccgggtttgttgcgattacgctgcttggcttcgaatttacgctccagaccttgtgcgtcagaagtcataataatgtagcccactttggtcgggcagacgatcattccaccctcgttggaaaggatctctaccgcttcctgctgtaatccattattccattcaatttttttattgctcatgcttataccttttaccggaatgaagaattgttaattaatcggttaacgctggaagcccgctaccagtcgaatgtctttgcaaacatcctagcggagtttttcgcagctgcaatatccggtcgtggttttacttgattgtttcaatttgggaacaataagtgaggaattcaggctacttgaaacaaagatcccccgctggccacggggggtctttgtaattgaatggcttaatcaaaaactaaactgcttttttcgacgcctgcaaatacagcaattccaatccaatcgtcgctgctgccagagcggtgatttcagactgatcataggcaggagccacttccaccacatccatgccgacgatattcaggggttgcagaccacgcaggattttcagtgcacgatcagacgtcaacccgccaatcactggcgtccctgtaccgggcgcaaaagcaggatcaaggcaatcaatatcgaatgtcaggtaaattggcagatcaccgacaacgtttttgatttgttcaacaacagcatcaacgctacgatcgttgacctgtgccgcatccaatacagtaaaaccattgtcagtatcgtgttcggtgcgaataccgatttgcaccgaacgatgaggatctattagcccttcgttaggtgcatgataaaacatcgtaccatgatcaaacttgctgccattcggataggtgtccgtatgagcatcaaaatgaatcagtgccattttgccgaaatgtttagcatgggcgcgcagtaatggcaaagtgacaaaatgatcaccgccgaaagacagcattttcttacccgatgccagcactttttcagcatgtgcctgcaacttgtcgctcatgtcctgagcatcaccgaagttaaagaccagatcaccgcaatccaccacattcaggcgtttgcgcaagctgaagtcccacggccagcgacagctttcccacgccagattagtcgatacctgacgaatagcggctggcccatgacggctgccggcacgcccagatgttgccatatcaaaaggcacaccggtaatcacccattctgcatcactggaataaggctggaaattcagcggaaagcgcaggaaaccgaaggcatttgaaaccaaagagttatcaatttggttccctaaggagctaatactcatgatatatcctcaaaagtcccgcgttcactaaatttcagcaacccggaacttgattacgctaaaagattactcttacaaataatccataattttaaatttaatttaaaaacaattaattaaacataaatcacaaacaaaaaaagccgcaaatgtgtacacatccatagacaaacaaaaaaagcacccagatcgccctgattcagcgactgattctatagtattaaacatgttttgcgcttgccacaactttgattaattcacatcgagtgccatgaccgatagccacctaaaacggtaattgtcaacatagttggcaccattaatgaatttaagcagaccgtttttctcgctcgggattcaacgtcactgtttctacccactgccagtttcttatgcggcgcgacccgcgttacgggtgtgtgagcttagcttgaaaacggcatcccgctgttttaaaatcactttgtcttcacctctgtgccgttgacccggtgtcacataatttatcccgctatgacggtgttcctcgttataccagtcggtaaaattatccccccagacacgcacttgtgtcagagcattgaagccgctttccggccacgccggcacatatttcagcgttcggaacagcgattctgcataggcattatcattgctgactcgtgggcggctgtgtgatggcgtaagctggcatattccggctggtgacaaacggccaatatctgttgctcttcttctggggttgatcggtttgccgacttgggccggacagccaacggccgccggtcttccggactcttttgccagcgccgctaggtgcgcaggctcaaagggatctctttaagcgcgaccgtcaaccgggcacccgcctcggccgccttgctcaccgcatccctactcgctttcgaaaatccagactgtatcccatctcgctttatcccctgtcatttgaattgagatattcatgccatattaatatgatttacatatggaattaatggataagtctttgtaaaaaagaccccatttaatggtaataattcccattttcatttatggttgcgttatgtgtccttacttctggataaaatgtactctttccctttattcaaataggttgaatgaaagttttgggtattcccatgccagaattctatttacgctctgatgattaaggaaattaaaaatgcagtgcaaatttactttttcctattaccgattaatcaccgttctttttgcttttatcgcactaattcttaccagtggctgtgataaaaaatcgacagaaattaaagccggacatccccaaccttctggggaaaccaccagcatggcgggctggccacgaaccttcgaaacagtaaaaggtcctctcacattaacacagccacctaagcgtattgtctctaccagtgtgacgctcagtggcactttgctggctatcaatgcccctttaatcgcttcaggcgcaaccggtccaaataccgatgtggctgatagccgaggattttttattcaatgggccaaagtcgcttatgaacgaggtgtaaagcttctctatatcagtgaacccaatgccgaagctgttgcggctatggtgccagatctgattgttatttcagcgacgggaggggattcagccatgaagctgtatgaacaactctcaaccattgcacccatactggttattgattatggcgataagagctggcaacagcttgccctgcaacttgggcaaataatcgggcatgaagctgatgccggggaaatcatcgcgcgctttgagcaacgtttgcagaaagtgaaacaagatatcaccttacccccgaatcccgtttctgcatttgtctattatgctgacgggagaggtgtcaatctttggacgccatcatctgcgcaagggcaattattgcatcaactaggttttacactcgccacattaccgaccaacctgaaaacagaaaccagtatgggcaaacgtgaagatatcattcagctttctgctgaagggttagcagatggtttaaacggccaatcttttatgctattcgctaccaatgacagcacaattcaagttgtgagtgctaacccttttttacagcacctgcctgctgtcagtacccaacgcctctatgcgatggggccggatacttttcgcttagactattacagtgcaaacaatatgcttgatcgcattgaacactatttctcaaatcaagaattaaaaaattagtcggttcaaaaaataaatattgctgcatcatactcacttttcagaggcaccgccctctaatgatgcggcattattatgcagagtagaatggcgcagaggttttaccagtgctgcaagcaatagacaggtaattgccgcaaaagaaccaaacgaaagcgccgttatgagaggagataacagacgtcccatgacgcccaatcccaacgctcccaaggaatcaccagtaacatcctgtgctgtgacaaaactattcacccgccccaataggtgatcaggtgtatgactctggatgagtgtaaactgtaataaggaagcaaaagcattcaggtagccataacacaccaatgcgagtaatgccgggacaatatgcgtcatgagaccgagcagggataatgcaaggaaagagcccaacgcaaaaataatgagcagaagaccgggccgggcgctccgtcctatccagccactggtaaatgctcctagcatggcacccagaggaacggctgaatacattaaacctgtcgcggaaggaccttggtgataaacctcttgagataatgcagggaaaaggatgcgaactgcccccgccatgctgatcaacataccgactaatatcacactgcctacgattttatgctgacagacaaattgtacaccactcactaacgctcggagtggatgctcttgccgggttgactgtggcttcatctttggcaacctcaccagcgggatcagtgtagccaaagtccctgctgcggcaatggcaaagttccagccaggtccgctggcaacgataataagcccacctagtgcgggagaaagaatggcaccaatacgaaccgtgatcatactcaaggcacccgccgccgccagattttcccggccgactaagtttgggatcgccgccattaaagcggtcatgcctaaagcgccaaagaacccatcccagacggaaaggaaatagaggacaaacagtgaaggggaatccaaaaacgcattaaaactcaatgcaacaaaacccaagccacaagtgccacgggcaaacagaatcaatttacgcctgtcatagcggtcggccagtattccgcccagcatcaatccgataaacatgccgatcccatccaatgccaccacgatccccacctgcaaggtagaaccggtcagaaactgcatttgaactgggacgcccactgtcagcattcctaatgcaaaaacagatagcatacgggcgataaagatagcgcggaaatgtgcattatttttaagtaaactgaagtccagcaggattgatgacttagccatgatgctccatgcaatacgtaaacaggaattgaaataagtgatcttcgcagcttaattgccgcaatataaatatgtttccagaaaaagctgtgctagcatatcgaccgttaatgataatggcaatacaaatgattatcacaatcaataacgaatggagcctttccggttatgcctgctgccccaatgcatcgtgagataacctcttcaaaacccttgtctcaatttcatacttatcgcacccgtcggttaacaggtcccataatctgtttattactcctcattattttttctatagcgagtctgttattaggcagtaaatatattgcccctgagaccgtctggcatagtttaaccggtgagctgcataacaatgagagcatcattattctcgaatcgcgcctgcctcgtacccttgtcggtattttggtcggcatggcattaggtggtgcgggggcattaattcaggcattgacacgtaaccctctggcagacccgggtatattgggcgtcaacgcaggagccagctttgccatcgtagtggcaatcacattatttggcttaagcagtgttatggcaaaagttagcgtggcctgtctgggcgcttttcttgccagcctggcggtatggttaatcagtatgcagtctggtgataaatccaatcctgttcgtttaacactgtcaggagtcgcgattagcgccctgttaaccggaataactaccaatattgccctgctcaatccttcaactttcgatcaattacgcatctggcaggcgggtacgctggatatccgatccttacaggtcactctccttgttgctccgttcattcttatcggctgtgcgctcaccttattgatttcaaggccactcaatacgttgagtatgggggaagaaatcgcaataacgttaggcgtaaaaattctctgggtaaaagtttcagccatcatagccattatgctgttatgtggaacggcaactgcattggctggcccgatcgggtttgtcggattgatgatcccacatatcgcgcgttggtggtgtggcccagaccaacgctggatcattctgcattcattactcatggctccggtgttattgcttagtgcagatatcgtcgggcgtttactggttgccggtgagttgcgcgtatcaatcgtcacggcctttattggcgcgcccgtgctgatctggcaggtacgcaagcgtaaatactgagcaggagacagatttcatgtcgaaaatgttgcaagtcgggcatccagaagggtggataaatggccgaatttcccttcgggttttactggtgaatactttccagctatttttaattatgttattagcgctgttcgctgtttattacggaacgctgaaactttccttctggcaaatctgtcaggcttttcaaggtgaaggtgatcccggcattattgctgtcgtcacgcaatggcgagcgcctcgtgttgctattgcgctggtggtcggagccgcactggcgataagtggcgctatctttcagtctgtcatccgcaatcctttgggcagccccgatattatgggattcagtaccggcgcatggactggcgtactgattactctgatttttctaaatggcggttattatcaaatgactctgggtgcgctgatcggcggctcattaaccgctgtcttaatttatttactcgcctggcgtcagggtatccacggttttcgcctgattattgtggggattgctatcagtgccatgctgacagcggtcaatacttggcttatcgtaacgggttcgctggaacatgttatgagtgcggcactttggggtaacggttcgcttaacggcattacctggcaaaaagcggcctcagctctgtttgtcattcctttgcttactttcggcgcttttgctttggcaaagtcgctgaaaataatggaaatgggggatgataaagccagcgccttgggctgtaatgttgaaactaaccgtatgcagcttattctctatggcatactgctgactgctgtcgtgacggcaacgacaggcccgatatcctttatttcccttgctgcaccgcaaattgcccgaagattaacaggtacaagctatgttcccctgttttctgctgccatgacaggtgccttgctattgttaactgctgatttagttgcgcagcatactttttcaaatgtgcagctacctgtgggtgctgtcaccgtcagtattggtggtatctaccttatttggcttcttattcgggaagctcgccaataatgccaatcatacagtaaacagaaagagtaattatcgatgacatatcgcctcagcgcttcacatttgacattaggctatgaacgaaaaattattgctgaagatttaagtatcagtattccggataaacagttcagcgtaattattggcccgaatgcctgcggtaaatctacgttactgcgtgcgctttgtcgtttactgaagccccatcacggtcatattttgctggatggaaaagatattcaacaaataccgactaaggcattggcacgtcagttaggtttactgccccagcaagcgatagtgccggaaaatatcacggtttccgaactagtcgcccgtggccgctatccccatcaaagcctgctgcgccaatggagtctggatgataaaactgctgtggctcaggcgatgaaagccacagggattgcaccattagctgaacgctatgttgatgagttatccggagggcagaagcagcgtgcctgggtagctatggtattagcccagcaaactcccttgctgtttcttgatgaacccacaacatggctcgatattgctcatcaaattgacctgctggatcttttcctgcaacttaatcaggaaagcagccacacccttgttgcagtgctgcatgatattaatcaggcatgccgctatgcggatcatttaatcgtcatgcaggcagggcagattgttacacagggtaagcctcaggatattatcagcacagaactgatcaaatcggtgtttggcttatcttgtgttgttattgaagatccggtttcccatacccccctgattattccctgcggccgctaccactcggtaaaaggcatttaaaaaccattaaaaagagaaaatcccatcaccaatgaatgatgacgggatttttaagtaaagtttcaagctgggtattttttcaatcgcgatgcgttttcaacaacgtattgagcaatggccctaactgtttcagtgatgctggagaaagaatatcagcatgttcacaatcttgccgatagatgcttaattgtcgtatccaaggcgcccatgtcgcagcaacatccatatcagcaggcaatgtgcgggttgctgaaaacagaatggcttcgccatcatatttttgattggaagctgatgaaaggatacgaacagaatccttatagttagccacaatatcggcgaacatagcctgcttttcagcacgtaacagcggatcacgttcatcttctgtggcggccataaattcggcctgttcacgcgcagcttcttctttggcttcttcttcacttaagaccgtccagtcttggccttccggtggataagtatccaataatccgaggaaagcaactttctctccctcttggcgcaagcgtgcagccatgccttgagccagcattccgcctaacgaataaccgagtaggtaataagggccatgtggctggatctgccgtaatgtcgctaaatggtgtgtacacatatcttcaaggttatcagagtcggcaatcactcccagcgggcgaggtgactgtagtccaatgatcggccagtcgccttttaaataacgcagcagcccactatattgccaggcaaagccagatgcagggtgcaggcagaatagcgcggaaccgtgtccgtctctcagcgggaacacttctcccagaccccggttttctgcggaatcttgctcattctcatcagacagtaatgcactcagtttctcgacgctgcgagcaaccatgatgtgaccaatagaaatagaccgattaaaacggcggcgtatttctgcggccaagcgcatagctaatagtgagtgaccacccagcgcaaagaaatcatcatcagcccaaacggtgtcgcaatccagaatttcagcaaaaagggctgccatttggctttccatacctgccacaggcaagcgtccggtagtgagtttctgtggcataggaagtgccttgcgattcaatttcccattggcgcttaatgggaaactatcctgaagcacataactgaccggcagcatataagcaggcaatcgccgggtaagggcttgatgtaacgcctctgtatccagtgaaacatcgggttgaggaattaaccaggcaactaactgacgggcatctgcatcactaacggtgttggctgttttgcctaattcacacgcagcaaccgcagcctgagcgatgccggactgttccagtagaacctgttcaatttctcccagctcaatacgctgaccccgtatttttaactgatcgtcactgcgtccaagatattccacttcaccattcggcaaccagcaggcaatatcgccagttcgatacatgcgctcgccacaggcgaaaggatcagccacaaaacggctggccgtcaaatcagcccggttcaggtagccggtcgccaattgaataccgcagagatagagatcacccgctacaccaacaggaaccggacgcagccaagcgtccaaaatacgcaattgggtattccataccggtcggccaataggcacgcctgagcctgtacagtgatctaatgcctcaccataagccggctgccatgtgacatcgactgccgcttccgttggaccatagagattatgtaaaggtgccgagatgaatgtctgatagcggcgagccagttcacaggataacgcttcaccactgcaaaacacctgacgcaggctatgacagaataaagcactttgctgacgtgatgccaatgagtcaatcaacgtcgccaacatggatggaacaaagtgcagcgtagttactgcatagtcatcaataagctgcattagcgcttctggatcgcgatgcacttcaggcggtgccatcacgagtttagcaccggtcatcagtggccagaaaaactcccagacagaaacatcgaagctgcatggtgttttctgcaaaaccacatcatcctgcgtaagcgggtaagcatcctgcatccataacaggcggttcacaatggattgatggctgaccatcacaccttttggccgtccggttgaacccgaggtgtaaatgatataagccgtgtgctgtggcgtcacccacgctgcgggatgcaccggctgctgattttcatccgccaattgatcgaataccagcaaaggagcctgatgagcaaaacgcgcttgaagtttactttctgtaatgactaaccgtggttgagcatcctccagcatcatcgccaaacgatcatcaggataaccggtatcgaggggtaaccaggccgctcctgcttccagtatcgcctgtaatgccaggctgagtcttactgaacggggtaaagcaaccccaacaatatcaccgggctgaactccggcttcaattaaacgatcaactaatagacgggtctgagcacgcatttgccgataagtcagatgatgctggttatccagtaacgctaaatcatcaggcgttttttcagcctgttcaatcacaaactgatggagtgtaccagaagggatttcatggtgcgtccgattcactttggtaatcaatgcagcctcgtcaggtgattgtaaaacccaatcttgcagagccgtatcgggttgctcaagcagttgctgaatcaggagaagaatgcgttgagccaataattcaggttgtttgacacactcccggtattccattaataagcgtagccgcttacccggcagaaccagcaaggttaagggatagtgcgtgtaaccacggttattaatccgctgacaaatgatcgtttgagtgcaatctgattcagtatcggtttctggataattttccactaccaataaggtatcaaaaagcgtacttgtccccgcaatatgttgaatttcacccagaccgatattgtcgtgttcaatcaattggatctgttgtgcctgcaattgttctaactgaggcaagagaggtaacgtgatatccagcgtcattcgaaccggcagcgtgttgctgaacagcccaacatgctggtctaacccttcaatctggccaaatcgcccagacacgggggaaccgaaaaccacatcggatgaaccactgtgtatactgagcagcacagaccagatcccctgcatcagcgtattgagtgtcaaaccacgttgctgacataagctgaagagtgcctgttccatttcaggttcgagcgcgatatcaagctctttcactttgccgttatggggttgatcactgaacagtttggtcggttgaacgcccttcaacacatcttgccagcattggcgtgccactgccgtttcttgtgccgccaattgatgtacgatctcttgataactgactctgggcacagataacgcctgttcaccttgattcagcaaggttaaaagatcttgtatcaagataggtgttgaccagccatctacgacaagatggtgaatattcaacaataatgtataacgtgaaccttcaccgtggcataccagtaaagcatgtagcatggcttgaggctggtggaaaagatcgcgcgccagttccgtcctttccagttctaataatgctgcttcttcttcctgctcaggtaattcagggagctgataaaaatcaagcggccaaatatcgctatcctctgataaaagggggatcagttgtagaggagaagcactttgctcagtatcaaaacgtgcggcaagctgaggatggtggcggatcagggcagatagtgcccggtgtagtttaacccgatctaatgacccatgcagggaaaggcgggtgagtgaattataattacccttatctgttgctgtctgagcgtgaaagagtagcccctgttgcaatggtaacagcggtaacaccgtagccaaaggcccataacgttcagtcagttgcgtcagatcactttcttcaagtctcggtaaaacaatttctgcggcaaccagcgtcgcagccgcctgccgtggctgctgtcgggcaaaattgattaggcagtcggtagcccattccatgccgcgctgtaattcagagatgtcttgttcgctgaagataccatctacccattgccagttaatcgctaactgcggaatgcttccctgttcatcaacaaacaggttgatttccaagctatgattgggggacatttgcggatcttgataaacagcaaaagtatcacggaacaggttttcagtgcgctgtggcgcccataagttatcagtcgcagcaaagcgccccaaatagttaaataagatctccggcgtatcctgttgggctaatacttgtcggccagtttgatccagataacgcagcaggccataacctatgccacgatcgggtattgtacgcagagcgcttttcactgcccgtacgatttttgaagggttttcgtcagcgatttttgtggattggtgttctgcctgtggcaacgccagcaccacgggatattccgccgttaaccagcccacggttcgggctaaatcaacgtcatcctctaactccatacgaccatgcgactctaattggaaacggaatttgctgacaccaaagtgccggttacaggccatagccaatatcgttaacaacatctcttcgatgttggcatggtactgctgcggcaacactcccagtaatgccgtggtctgtttgccggttaatagtgtgcgttgctcacggacagcgacttgccgatcccgatgcgcatccaacgggcgttttcctaacaggggaattttttcgtcaagcatggcctgccagaaagacagctctccggcacggtttactaaattttggcctagctgaaggttccagtcatacaatgtgtactcttccggtggcaaagtgattgctttacccgctatggcagtctctatcgcctgttgcagttcatccagtagtacccgccatgacacaccatccgttgccagatgatgaataacccatactaatccctgagtctcttcatcttgttgcagtaaacaggcatggaataaatgacccgtggccggattcaggcgcatcaccgcctcgtggaaagcctgttctgcactcgtttctatatgaccactattttgtataacgctgtaatacgatccgtctgccagtacaggtttttcaccgatgataaggcgattattgcgggtaacagcatgaagtaccgggtgggtctggctcaacgcgagaagggcagatgataaatgttctggccgtaattcagccggtacgcggatgaatacaccgtgggcgaaacgggtattgatgccatgagattctgcaaaccaatgcaaaataggtaagtgatcgatctcgccgatttgtactggcttagatatcttattggcgctagaggttcttttgccaatagcgaccggagacattttcagcgccatacgcgccggtgtccgttcactgaaaatatcgcgcggacgaagctgccagccaacacgacgcaattgtgttcccagtgccattgcagagatactgtcgcctccgagcacaaagaaatcatcatctgcactgacctgaactattcctaataaggttgcaaacgcctcacaaatatatttttccttttcattttcagcttgccgccctatagaaaaatgctgttgctgcggtttgggcagtgccttgcgatccaccttgccattgactgttaatggcaactcttccaaaatcaccaataaagcaggcaccatataatcaggtagctgttttgccagttcagccagcaatcgtgcagaaatatccgctaaggctcgcagtttattatcaggaaccgagcaatagccaatcagccgatatgtgactcccatgggttctgcaatgactacggccgagctgacttcaggtaaagcagctaatgcattctctacctctcctaactcaacgcgaaaaccacgtactttaatttggtgatccactcggccaacaaatgagagctgcccatcaggccgccaacgcatcagatcgccactacgatacatcacctcaccattcttgaaggggttggcgacaaaacgcgccgcggttaaatcaggacggcgcagataaccgcgggcaatgcctggcccggaaaggtaaagttcccccacggcaccaaccggcacaggttgcagatggctatccagaagccaaacatcagtattggcaacgggccgcccaataacaggctgatcagcgacctgaatatcggctcccagcgtgtcgatggtatattctgatgggccatagtaattatggatattcatttgcgggtattgcttcaacagctcccacaatcgcggcgtcgccgcttcaccaccaatcataataaacgctggctggtggttgccttcttccagcaaaccgctgtcaataagctgagtcaaaaacgatggggtaatatccatgaggtcaacaggcagttgattcatttgctgtaccacaccccacgcatctcgccgtaactcttcatcaaagatataaagctcgctgcctaacatcatgcagaacagcggctcccaggacgaatcaaatgagaaagaggctgtgtgaccggcgcgcatacgccgttgatgctgaagatgaaaattgtcaatcactggcccaaacagccgtgcagcatgggaagccagcaaattcaacaacccgccatgtgtactcatcacccctttgggtttgcccgtggaaccagaggtatagatgatgtaagcaaggtgctcgccccgcagcgtttcacgcctttcttcatctgtgacaggaagggaagacagactggtacaccgctcctgtatctgatgatcatccagacatattaccttcggtatatcaggcatttgtggcagtgtattaatgcaggttatcaacagtaccggctgagcatcatcgctcattaattgtaagcgttcccgcggataatcgagatccagtggcatgtaagccgcgccactggctaatacccccagaatcgcgacaaccgaatctattgagcggggtacacctatcgcgaccacatcctcggcaccaataccttgcgccagcaatagacgcgcaagctgcatgctttttgccattaattgatgatagctaagttgttgatcaccacaacggacagctaaggtatctggttgctgtttcacttgagataagaagaaatcaagcacagaaaccctatctgatggcggtgttacgcatggcccgcgggaccattcatcaagacgctgttgttcctgtgggggaatcatcggtataaaagcaatcggttgtttcggctgaatgagcagttgatctaatagataacggatgcgctcactgtgccagtgtaaagtctgttcgctatattttgtccgattggcaatgaaggtcagatgaagaacgtcatcctgaaaattcaattcaaattccagatcatccactggccccgtggcgagtgtatgagtcgtaattggtttgccgtctaatttcagcgtctcgttatatattttatagttaaaaacagggccatagagcagattgctgcttcccgataaccccaaatggcagcgtagctgttcggcatcataacgctggtggcggcggacttgttttatttctgctacaaaagccttcacgacatcggccagtgtcatgctgtcttgcagtttgatttgtaacggtagcaggttaaccacagggccggtagagcaaagcgcggctgatcccaaacgccgcataaacggaaaaccaatagagagatgcttttctccgcacatgcggtagaagtagatgccgagtgcagccatagcaatttcagcaggttgaaattggcgtagtgaatcctctgccattaatgaagtcagctgagttgccggaaaatggcagtgataatataaaggcgaggtgttctccgaagcggcaatatcttcaactgaaagagagacacaggcacccggctcacgggtatattcttgccagaatgccgcagcctttgcttttgccggtgaactttgccaatcctgatattcctccaccacctgagtaaaggaacagaaaggggtctcagcgggcggatgctcagctttcagggcgttataaatctgaataatccgacgagtcagtgcatcaaaactgaaaccatccagcatgagatgatgaaagcgttgataccagaaccagcgttcaggttgcttatcaatcttcatcaccacctgtcggtacagcgcacgttctccatctgccggtaattcagccgagagatcctcctgcatcaatgtctgtgatgctatttcggcctgtccggccggctctctggaaaaatcaatccattcaggggcaatgacctgctgtgggtcacagcaaagcgggatctgttgtactggtattccatcttcattcaggaaataccgggcatggatcgtatccgcttcagacaatccctgacaaatagcggcatcaaataatggctggtctaatgcccctttaatttcaatataatgtgcaatggtgaatatgttgcgtgggtcagcgagttgatcggctatccaaatccctggctgggcagcaaccagtggtagcgtcaaatttattgtttcaaccccaacctcttgtaatctactagacacgtgtacttcctttaactaataagtcacgcaaccgggcagggcgcatatctacccaatgttcttctatgtatgtaatacatgttgaccgcgaatctggcccggcaacctgttcccagccagccggctgttccgcaaaagcaggccagaggctgtattgctgttgagcgttgatcagcacaaagaaagtcgcgttatcatcatcaaaagggtttttttgttcctgagacatctttagctctcgttatatttagagtttcagtcattgttttatgcgttttcagacagtaaccagctaaggccgtcaatcaacccgccacgccagcacaaagaatcatgtccgccattaaaaacacgataactcacgtgatatccggcatttttcaatgcttcatacatttgctggttaacaccttcgatatcatcttcgcgggaacccgcctcctgaaagattttcaatgaggatggggtaactttttgctcaataacctgctgtgtcagccaaccggtttgacgctcagatgacttcatcattttgctgtaaggccaccagaaagaaccggattgagtgagtacacagccaaagcgttgcggccaatgcagtgctgcataaagtgcggccagcccaccataactttggccggcgacaaccgtattgtcgggggaatcgctgaacgtggcatgctgtgcggcaagcggtaaaagttcatcctgaaccgccagccagaaatctcggttgcagggtaattcctgttcccgtcgggacatatcaatcacatcaatgagtagccagacagctcccggtatgtgttgctgttcggtagcggcttctaaggcagaaaaaacaggggttctttctgcccagttttgcccatccagaagaatgaccagcgggcgtggtctctccgtttcctctcccgtagcgtaaagccagatacgccgctgattaccaaggcgatgactctgccaattcaacagaacaggttgttgtgtatccggctgagcgagactatttctcccgattgatgcccaggctgattgctcaggagcatggggcatatgagcggccgataaagacattccgagcccattacgatgacagccttgtaaattcagaggatcgggaatagacagaggaaagagtgaacaccaccattcgcgttgctgttggttacgctgctgggtgtcgccgtaaaaatcagggggcagatgggcatgagtgacagggatcaggctgtaacttcctctccagtcatcatcaatagtgacagaccaataccaaatgtcactttcgggcaatcgttgcagactttgtggctgtggactgtggtgatcggtgatgccgttgatatcaataaaaactcggcgaatatctgaattccgttcatttccggccggatctcgccagaaaaacgtgagttgaacctgatgatccggccttgcttccactaacggagtccctaaagctgcaatatgctcccaccataattcactgccagaataagatgctgataataaattacttatcgtaccggatggctgaaatgctaatttcattcccttatcctcttcaaaataattgccccatcgagttgttccattaatgcccctatctggcataacaattgataactactcacccaaagataaatagttatcattcactaaacaatattgattatcatttttatttgcaatagcattaggcgtcttttatgaatgaagtttatcggtttatggaattaataagatcgtcgcagaggaaaataggactggaatcctcttatagaaacttagggaaaataagagacatatgaatctgattataaagtaattatttccaagaaatcctattttaagagatgaaatctatggtaatgcccacgaaaaaaacgctaaaaaataaaacaaccaaaaatcacaataataaagtaccgttaatattaacttctgtattatttttatctcctcactccgcaatagccgttgaaacggctaatgagaaagacaccatcatagtcaccgcatcaacacagggtggctccagcggcttcgttgaatcagaaagttctgcgggtacgaaaagcactgcaccactgataaaaacacctcaggcgattacggtagtgaaccgtgctcaaatagaggctcagggcgcaacaacagtggctgatgccctgaattattccagtggtgtggtcactaactatcgtggtgcttccaaccgtagtgatgaagtcattacacgtggtttccgttacgcgcccaaatttcttgatggactgagctatggtttaaacggccagggggctacggcaggtcagatcgatccttggcttttggagcgtgtggaactcgttcatgggccagcatccgtgctatacggccaggtcagccccggtgggttggttagcatgaccagcaaaaggccgactgcacaacctatacataaagtgcagatgaaagccggtaatcagcgtcttggtgagtttgcctttgattttggcggggcagtacatgacgacattccccttttctatcgcttgaatggaattctcagtactcaacagcaattcgtcaaagactataaaaaggaacgtattgcaattgctccggcgctgacatggataccgaacagtgacacgacctttacgctgctgactagttatcaatacgatcctaaaatgggattccgtaacttctaccctaaagtcgggactgtcacgcctatccccaatgtgggctatatgccctatgatatgaatctcagtgagccttcttttaatcaggccagacgggagcagacttctatcggctatattcttgagcacgatattaatgatattttctccttccaacaaaccttacgttactcaagctcagatgaacgcactaaactgtttgtttatacaaaagatgtcaccagttccatcattgggcgtcgcccgcagcgtgaacacaataaagcgcaggaatttggcatagataatcaactgaaagctctgttttcaacggctaacattgagcataacattatcagtggaatagattacaagtggggagacaggcacaataaaacatggaatgataaaaacccgggcagagaaccccaatatcgttttgactggtcaaatcccactaggaacattcacattgatgagaaaaacctctcacttgactcaaatgataaaaagaaacttcatcagttaggtatctatttacaggatcaactcaattgggaaaactggaatttagttctttcagggcgttatgactggactgaagtcaagcagcaagatctcatcaagcacacattaaaaaaacagaatgacagtgcgtttacaggacgagcgggtttactgtatgcctttgataacggtatttcgccttatatcagctacagcacctcttttgaacccaatctggatacaggtgcaccaggtgcaccggaattcaaaccaacaatgggtgaacagaccgaaataggcattaaattccagcccaaagaccatgataccttgctgacgctttctctgtttgatatcacgcagaaaaacgtgacaacccgtgatccggttacccgcattagcgagcagattggcaagattggttcaaaaggcgcggaagccgaaattcattctaaaattaccccagaaatcaatctgatggcgtcgtatacctataccgataccaagacgaaaagtgatagaaaccctgctcgtgtcggtaaaagagtgccagcggttcctgaacatgcggcttctgtatggggtagctatagtttcaaacaatccgtactggaagggcttacgctgggtactggcgtgcgttacctcggtaccacttccggtgattttacagaaaaattcaatgtaccgtcctacactctctacgatctgatggcaaaatatgatcttggtgaagcgtcacctcagctaaaaggtgccagtgtacaactgaacgtgaataacctgaccgacaaacgttatgtcgcttcgtgctcgaatgacggagcctgcttctatggcagcggtcgcagcattttcgccactgtagcgtatagctggtaagcggaaatgcatttatctcaggggcattgataaagcaatgctgacacagactgctttttaccttactgatgtcccctgagaaataacttttatacaacacaggtgtaatacgtttttctaattcgaaccgtaacaggcagaaaaaataaaataacagtcaataaaatataggaaaaaaccgtgcctaatttagcaactgaattccgcatatcccaattgcaggatttttgttgtgatgattttgtgttcctgtcatctaataaaagtctacatgcacacggatgctttaccaaaataaccacgccagtcggtgataatacagatactgactgccaattacatcgcgatatacctgagcttttccgtcaggctaaaaataaaggtattgaaaaccccattatagtgggtgcgattccatttgataaacgccagccttctgctctgtttattccggaagattactcttggctagagcgtgaggcattatctttttcatctgtttcttccggccccaaattacagcagataaattcattgccggataaagacgaattctgccagatggtgactcatggcgttgatgcaattcatcatggtttgctcgataaagttgtcctttcccgcctgctgaacatcaaatttgaccaacagcctgatgctacgcagttatttatgcggttgaatcaacaaaacccttatagctataacttccatgttccacttggcaacagcacccttatcggtgccagcccggagttactactgtgtaaacaggggagtaccattatctctcagcctctggcgggttcttcacgcagaggcagcaacgtcatgcaagacaatgagttgcgtcaatcgctattgcgttcagcgaaagatcagcatgaacatcaattagtgattaccgcaatgagaaaagcattagctgaacgttgtacagaattagctattcctgagataccttcgttactcagcacccccttgctttggcatctcgcgacagaaattcgtggtgaattagccgataaacagatagatgccctctcgatcgcttgcttgctgcatccaactccggcgctgtgtggtgctcccagacagcaggccgcgacgctgatttctgaattggaaccgttcaaacgcgactattttggcggtattgtcggttggtgtgatgccagaggtaatggcgaatgggtcgtgacgattcgctgtggtgaagtgtttgaaaaccatattcggctctttgcaggagcagggattgtcgctgactcgaaacccagtgccgaatggcatgaaacagatgtgaaatttggcacgatgctacaggcgctgggattgtcttacgataaggaacgttgtttatgaatattgaattcactcactggcctgagaaattagcgcaacactatcgccaatgtggttattggcttgacttaccgctgagcgacatactcagccgccaagtcgccaatgaaaatatcgcccttattgctgacaaacatcagtatagttaccaccagctcaagagtctggaattattacaattacaggtggggggtgcacggttgagtgaatcatcagccagaagaataccttccgagcttggctgccgcttacagcaggtatttggcatggcagaagggctggtgaactacacacggctggatgacgatgaacaaaccattttcacgacccaaggccgcccaatcagcgcagatgatgaagtatggatagcggataaacaaggcaactctctgccacacggtgtcaccggcaggttaatgacccgtggcccattacacagcacaccctatttcaagtcggagaaacccaatgagcatccccaaactaaacgattatcttctgcctgctgttcaggaattacctgttaataaggtgaattgggcatttgatagcaaacgggcggctttgctcatccatgacatgcagaattattttctcaatttttggcaacctgatagtcagctagtgacgcaagtcatcgataatattgcccgcctgaaaatacagtgtcagaaacttggcatacctgttttttataccgcgcagcccgaccaccagagcgatgctgaccggggcttgcttaatgatatgtggggggcagggctgaataaacatcctgaacagcaaagtatcactgacgcattaacacccgaaagtgatgacacgttattagtcaagtggcgctatagtgcttttcaacgttctgatttggaacagttactgaaaaatagcgaacgggaccaattaattatttgtggtatttatgctcatatcggctgtatgacaaccgccactgatgcctttatgcgtgatataaaacctttcttcgttgcagacgcactggcagatttcagccgcgaagaacatatgatgtctctgcgttatgtcgcaggacgtagtggccgtgtactgacgacggcaacattgctcaatgaaatgtcactttcttctctaggggagaagaaatgggatcgggaacaccttcgtgctgaaattttaccgttattagacgatgactgtggcgacattgatgatcatgaaaatttacttgattacggcctcgattcggtacgaatcatgtcgttgataacgcgctggaataatcagggtcatcagctagatttcatcacgctggttaaaacaccaaccttatcgaactggcttacgctgttgactgataaacgggaggtcaaataatgagcgctttttcttgatttcagcggtaaaaatgtctggatcacgggggctgggcgtggaataggttatcaaattgccagccacatcactttacaggatatcgtcatcgatggaggcgctacgctaggagccggagtacttagccaaaaaatcccgtaagtatgtctggttaaacgcgtttaattccaccgtatgacaacagtcggtgattaatcttcatacggcatttgattattttttcaatcctaagcgggcagcccagcccgctcccccatatttaaattcaagcatgggaagcgatccagttacctaggttaacccgtgagatcgcccagcgatacaccgataatcccaccgacagggaaacttgatcaggttcccaataattcagaaaagttaaagaaaaaatagctggttctgaaataaaatatgatatttagaaaactgtgtcttatcacccagttctaaatggatagactttacgggtacagtggataatcatattctacagaaatttatggtttgacaggtagagcgaaaccgtacgtgagccgaaatttttatacagctcacctaataaatcacaggggttctaatgacaaaaagagctgatataaaaaatgaaagattggtttacacagaaaaattagggtggttagacttagggcatgctaacggtgatgatgctaggaagctaatgatttctctttatttgggggataatactactgaggaatcgcattttattgttagatatgtccaatatatggggaggggacgaaactatgggacatctataaaaacaagatggagagttaagagaggtttatctttgcatgatacgaagagagttgctcttactatcatgatgtatacaactcattcatttgaatcgtaccaagattcctttccttttacttggttttcggatagtggttatagcggtgaggatttaatttctaatttatttggtttttatcaggctgttaatgatattaattatttgcctcaagtaggggtagtaagtaaggatgaggcatttaaacggtgggattactatgggcctataggaaaatataaaaataaaacttttaaaccgctcttatttcctgatcctgaaaaatacccaaacaatgcaagaccttatcatgcttcactacctagttttttaaacactataatacctataagtgacataaaaactagtcaagatgtaatgcttattgaagatgcaagctggattaatgtaggtaaagaatatgctgggatttcggttgagtaattttatacgtatatgtatcgttatatctgttttaattgtgggtgttcttttttttattgcttcattagcaaatgtaaatttgtcatatacaaaaagaaacttcatttactatcatacatttacctttgatgaaattaaaaatataccattagtttcaaatgattacatcatatactatgactctcctgatggctcacaaataatgactaatgaaattgttttttcaaatgtaaacttgattcgtaaaaaggagctaatagaatatgttgagaatatgggatttaaaaaatattttgataaatattggaatgaagatagttggcgaaaagataatgtacgaataagtataaaacaaaatgataccgaacgtaccattttgtttttagttgagataagttaaaatacattatcttctcttatgctgtaaccagatgttccagcagtatggtgtgtccaagttatgctatcatatgaaattgttatacattcatatggttgcatatcattgtgatttagcgagttagggtaatgtatagatatgttttttatggttgcgtttgttaacttcattgaataaaatttttctagcccacctgatgaactgtttctatatatatcaatttcacaatttaaactctcattgcttgatattgcaactcctaatagtggagatgatttatcaattggttttgttattacaataggctggtgatttacattttgctctctacttatatcatggtctacagcataaataagtattttatctttgtgctcttcttgatatttatttcctatggaatcataagttgagcatccggcagatataagaccttgctttttaccatttatagtcatgtaaataatattggccactctgtttttccttagtatgttttttgggcaaaataaacatacataataactcattattttgtcaatagtattttttaaatttaaaagacttattcattaactttagtaaaaatctgctttcatagaaggcggcattaatttcaccccataggggcgtactaaaagccctaaatgcaagcctctgccttcaaacccaaaggccaataaaaccctgttgtgcaagcattgaattgatatggtttgcggctatatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtatatttagtgataatattggtcgtgttggtattgtaatttcttcaggatggagagcagtctttaatgccatatttatggcttcatccttgttatacgcttcttgttgctcttttctgcgctcatgccttctttttcttgcattgttgtagccatgaaagttgtgcatatcatctccctttagttgatttgtgattgagtagttttcacgtctcagtcagtaatcaactggttagaatggtgcactttttcagcgctgtctgttaaagagcgtactgatataacttggtattgttaattatcgaatcatccagatcttcttacgccactggcggctacttcgtgggcgtcctgcctgttcgatgattagaatatacaattaaaattgtttaatgacaacaaccaaagctgtatttattgttatttttttgtacctttttgtatttgtaagaatttttaataaaaaaacccgcgcggggcgggttgaaaaaagaggagggctaataaaaattatcgttttctacggtaaattcgatgttcaaccattgttcctataatggtgatttttatccgctgattatctaaaataggataatcattatttaatgggatgagttcaaagtgctgtgttccatcaatatttatagttattggcctgtattttttaaatgttgcctcccgttcatagcttgctgctactacgaactctccgggattgggagtaacttctggatcgataacaacaatatcaccagccttaaaatcgggttccattgagtccccgtctatacgcaatgcaaatgcgcgttctgaccaattcatatcggttataatgtgttttaagtcatcgtagccgcgcataggaaagcctctcgctatcttccctgcctgtacgtaacttattaacggcacttttcgaatgtttacatcacaaaggggctggaaatcaccacctgtcattagccattcagcatcgcatttcagggccttggctatgcttattatattccgtggcctcagagttttcccatcttcaatgacggcccaagattgctgactaatgccagcaatcatagccgcctccgcttgagttaactttaactcaaaccttctgttcttgactctatctgcaagactcataacctctcctttaattaaagtaggattcttacaacaaaaactgtatttgacaaacagtataatgtgttattaaatacaatcaaatttgtataaaggagatttgcaaggatggaaactatatccaagcgattaaaaaccaaacgacatgagctgaatatgactcaagctcaattagctgaactatctggaacaaggcaacaatcaattcagcgaattgaagctgggatcactaaacgccctagatttattttagaaatttctaaagccttagattgcgatccattatggcttcaatacggctcaaaataatcgttattgctctttaacatctctgtgctgaaaaagcacgtctacaaaatcacctatcttaggatagatgacaattctgtatttttgtcaaacaaaatttaacttcgtaatttttgcgtatcgaacacgtccgttcggcacgtagaaaggccaattccaatcgtgaatatacatccaatccacaacgtaataatgcccgacgtttaccagtcgggtgatgccgaatttattcaaaagattctatccgcgatgaaaccaaccatgcgggagtatgcgagagataaatacgcctacgtctacaaactgcggcgggatgaagatccagtgtcatttcgccgggataacaccggggctaaggccgctaacacatggctcaggctgtatttcaaaaagcattacagatcgatgcaaggttatacagaagcgccgttgttagccccgaaagcacagccagaggacaagcccaattcaggagttgtttcagggcaaggagccagccagtagcaccgaaaatggctgtgtcttctggctgtggaacggagcttaggggatcactagggctgagtatgaaaaaacagccaagtgagaatgattatcaaagtggggaaaagccaaaaaactggcagtcacgaaaagtactaaatatgtacccccctattttttttggataaataagaatgaatctcattaaaaaagcagaaaaaattattgcaagacgcaagcaattgatcgcttggaaaccagcaaaagccgttgccgcactggtgaaaatcggaatgagcgagagcgaagcaaaggagtttgtgaataaaaactcaccggaaaggaagccacacaagccacacaaaccacacaacagccacgcaaaacccgtgaatctggaagcattgagcactcactacatcgtggttggtgattacgatttgctaggcctgaaacatcaggatgcactgattgccgctatccgaaacggcaaagggaagagttcatggcgtgatgaatcaatggcggtaaccctgttcggattagtcaaagcgtatccgatcatcaccacagccgaagtaaacaaattcctcaaccgtggcgcattcatcgacagcattccactgttcattgacggggagatgataggaggtgaagcgatgccgtcagcagataacgacagcgtgaaagacgtttttcgtgcggttaagcaactgaaaaaaatcactgaacacttagcggatactggcgcattaactctcaataaataccttgatcgcgtaccgactgacgaagacgtcaagcgcgccgttggcattgtcgcaccggcaataacaaacccgcacttccataaaatcgattatgcgcgccagtacagcaatatgcctgcacacgagcacgccgaagacagcaagcggattatcaatgagtggaaaaacgaactgaaaatcaaaggaggcaagaaaccgaacagcaaaactttggcgagtacgactgattcggatcttgcggaggaggcgaaataatgaacacttcatctcaaaaagattatggcactaataccgacttattcgcaactttatgtggatctcagcaacttgttgatgttgccatcaccctgattcgggaaggccggaatcttgaagcagagagcatattgcgcagagcgaatgttgtttctgtatccgccatcgagaatcataaagccgctttattgggcaaataaggggcgactgaatgctaaccattacccccaactttgcacaggaacgcgctttaaacatgctgcgtcaggactggaagcgcttcaattcttttatggtgtatgccccgacaggcgcaggtaaaaccggattatctgccttcatcacagacggttttatatccaaggggatgaaggtcatgatgatctgcccgttcaccgtcctgatcaaccagactgcccagcgctttattgagtatggcttgccggaggatgaaatcgcctatatctggcgtgaccaccccaatcaagacccgtcaaagctgattcagattgcgtcggctgacacgctgatccgccgtgactttcccgaagacattaacttgctggtgattgatgaagcgcacctgaaacgcaaaaagatactgacagagattacgcggttgacctctgaaacagattgcaaggttatcggattatccggcacacctttctcgccgttcctcggtcactattatcagaagctgataaagcccaccacgataaaagagttaatccagcgtggcgacctgagtccttacgagttttacgctcccaccaagcccgatttaagcaaggtgaagtctgcccgcaatgacgactacggcagcgattacaaggaagacgagatagccgaaatcatgtgcggggctgatctggtcggggatgtggtcagtagctggctcaagctgggcgaaaatcagcctactatctgcttctgtgtcaatgtcagccacgccaactttatcacggtcgaattcaatcgcgccggggtgaatgctgaaatcatgacggccaacacgccccacgatgaacgggatttgatcatccatcggtttgagcagggtgcaacaaaaatcatcgtcaatattggcgttctcgtggcaggttttgacagtgatgtccgctgcattatctacgcccgtcccaccaagtcggaaatccgttggttgcagtcaatcggcagatcgctgcgtccagtcgataacttttcaaaactgtataccgaatacctttccaaaagaagcagcttacttgcaggcagggaaatcaaggaggctaatcatggaatttaaaaaagccttctcgtggcgttctgatgacatgcccgaaaccactgaggccgttgtgtatgtatccagatgcggctcggtggttaaagcgggtagttatcgtctttggaacaaaaagaatcagtcctattcagttcggaaggagcggatataccgacaatcaaccaacagaggcaaggatgcgaaatcaaaaaacacccgttacggtaaatatcagcatgtttgcattagggatcgctcgtatcaggtacatcgcttagttgcattggcttggataccgaaccccgacaataaacctcaggttaatcataccaatggaatgaagtcggacaatcgtgtcgaaaatcttgagtgggtcactaatttagaaaacaggcgtcactcaggagagaagttattcagaaatatacctcatggtgagcaggtaggaacagccaagttaactgctaaagacgtcattgaaataagagaaaggttaaaaactccctataaggggctttgccgtgacttagccgctgagtttggtgttgtcgcatcaactattacatggattaaacaaggtgaggtctggaaacatgtttagagtcttgttcaaaacggcctgtaaagatgatatcgagcatgtacgcgacatcatcatgaaccttcaccaagataatggtgacactattattgtttctgacaatgacttaccagcagacattgttatcaatgtacccaaagttcagaagaaagcggccatcattctggatcactccggctctgtgcaccgtctcggctaccccgatgatatcgaatacgacgaactgcccagcaagaatgacggcatgaaatccagttccagctaccgtgagcaggagaagcgggagaagttaccgaaagaatgctcctcctgtcattacatgaagccagcaggggtctatgtctgccccaagtgtggctttaagccattggtgggtgaaaacattgatgtcgataccagccgcaccatccagaaactcagtaagaaagagcgtatctacacccaagccgaaaagcaaagtttctactcgcagttgaagtattaccagaaccagcgcgcctcacagggtaagaccatcagtgacggttgggtatccaacacctttaaagacaagttcgacgtttggcctcgcggtctccatgacaccccacaagagatgacccccgaagtcagtaatttcatcaagcacaaacaaattgccttcgcgaaatcccgcaagaaagcggaacaggtgcaaccgcccagcaacgagcagcaggaaatgcgtcttgaggttgctcaccaaaaagtgcgcgatatccgtgaaaaattaggcagatcatcacatcagggagacaggctgtgaacagaataaatacgaccgatgccgttattggccactggcctaaagttttcgaatactacggtttaccgcccgtgacaggcaagaagcactttaaaggaaagtgtccgatatgtaagcagataggcaagtttcgcattgatgatcgtgacggacgcggaacattcatctgtacctgcaatgccggggacggctgggcactgctcaggttgacgcagaaaaaagaatttaaggtgctggcggatgagattgatcagctattgggtattcagcgcgataaggtcacacccaaacctaaagcaagcacggttgcagataaccgccaaaagataatcaccctttactcacgcatgccggaactgaaaggcacctcagcggaaaaataccttcaaagccgggagatttacagccatcaccccattgagcaaatccgcttctgtgaaaagcagccgacctataaaggggattatcaggcgatgtgggcattagcgacagactcacgcggtcaattgtgttacctgcaccgaacctatctggacggggatcggaaagcgcctttagatgtgaccaagaagatgatgtcgctacaggaagccagttatctggcgcacgccgaatcggtggctatcaggatgtcgcctgtggattcaacgctgggcatcgctgagggcatcgagacggcactgtcctgcaagcaactttatggtgtgaatacgtgggcagtgctgaatacggcattaatgaagcgctttaaggctccccgtggcgttaagcatttaatcatttttacagatatggactggaacgccgcaggccatgctgccgcgatggagtgcgcacataaaaatttattgagtcataacgaggtagaaaaggtcagtgttcgctggcctgaccgtgacgattttaacgacatgctccagaacgcggacgaagtccggcagttggtatttatgaaaaaacagcgggagacagcataatgcgtgatattcagatggtattagagcgctggggggcgtgggcggctgataacagagaggatgttaactggccgtctattgcggcggggtttaaagggctgatccccagtaaaatcaaatctcgggtgcagtgttgcgatgatgacgcaatcattatttccaactgcatggcaaagttgaaccaaaaaaatagcgatgcgcatgatttactgttcgactattacgtattcggtaaaacgttcatgcaattagcacgtgatcataattgttctgatgggcacatcgggaagaagttacaaaaatctgaggggatgattgagggaatgctgatgatgttagatattccattggagatggataaatgcgtccaaaaagaaccaataaatattaaccagcatcagttgtgtagtattttctgaaaataactttacgtacgtaaaaatagtgttattgtgataagagtgaaagcaatgtcacacagcttatagaatcaacaagcctcgcccagtgcggggctttttgctatctactcgtagtcaattttcatttttattcatcagtaatttcagcgcgtcattgaatgtttcgcatcgttcatcatagacgccgcgatattcggcgttaaaaatatccgacatcgcctcgccgatagtcgttttataaatcggtgtgttgtcatccaataactgacagatagcgcgtccaatcagggtgtatgcgttcgtgttcatgataaacctcggtgattaaaaattaacctcactaatttgatcctcgatgattaatttatcaataccggataattgatcggggtcggacagcaccttatatcactgtaaaatcaattggttaaatattatttcgggtgatatgagcagcaccttgatccccatggataactcaacctgtcggtgagactgactagttcaaattcagggctgcgctccggtgtggccttttttgtatctggaactttggcgtagagggttcgcgcggatgcctgaagagcatcaggactcggttcgattccgagaggttccaccaaattatcgaaggtcacttaggtggccttttttgttacctacgcaatgaggaaattaaccatgtacgcattaaagctaatcacagaaagaaacggtcgttcagtagaagagtcatggatcttgggagacatgtatcgtctggagtttttcccgaaagatgtcgctgataatgttattgcccgtgtcgagcatagccagaacggcaatctgattaatcacgacatcaaaaaaacagaccaagcctacattaccactctgacgggtgacactgttcgcacggtctgtcgaggccgaagtggacttgtagctggttccatacagtaaccaatacagagcgtctatatttgggcgctcgatattgcttattatctaatttgccgccgcaatcactcccagtacctccgtacctccgtatctcctattgcggtcggcatcctattaactcactcgtgaggtgaatgatggaaaatcgtattgaagaactggaaagaaaggttgttgggttggaaaaacagctcgttgaaaaaaataaatctgcgagctgtataattgaaaatgatatggctattctgcgtaaatgtgatggaaggattatttttcgcttagggaaaatttagttatttgtccaactaaggctattgactctcgacttgttccatcttcattgttttctaaaaccttatcgaacaatttatagagctgatccaatttttcaggctctttgtttgtgaccatcccggccaaaatagtgaacagtactggaactgcataagtcatatcttctagattaatttcgtcaactttgattttttcaaattcgtagctcattttttatccttcacagaggtaatcagccatccctctattgattagttaatgtttggctgatctaacaacataccttaagtatcaacttattacttttaactaactcacaggggcgaccatagctcaccccacggacgcccattgttcaaatggggtggaatatgaagatgaaagaaaatcctgatgtatgggctgagctgctcaatggcctgcaaaattcgtggccgcagatatccggctctgttttggcaatagctatctgttatggccgcctgatttatgacggcgtggaacgcaagaaccgttgggtcgaagcgctgctctgtggtgccttgtcatggagcgtgtccagtggcttagagatgtttggcgttcccagtagtttcgcgccggcaatcgggggtgtcattggttttattggcgttgaaaaaatacgtgagtttgctatccgtgccatcaataaacggttgggagataaataatgaccagaggcattcgtaataacaatcccggcaacattgaccacaactcagcgaataagtggcagggtcaattgcctcacgacccgaagattgaatctcggttttgtcggtttgaatcaccagagtatggtattcgggcactgatgaagctgttgtgcaattaccacaaaaaaggctatcagaccgtcgcgaagatgatagaccgctgggcacccactaacgaaaataacacttcggcttatatcaatggtgtggccaaggcgttaggtgtcgatcctcatcaggtgatgactgtcgataaagtgacgttgattggattggccaagtccatcatccggcacgagaacggcaagcaaccgtattcagaggcaacgtttgagaaagcgtttgagcttttatgaagtggaaagttaaagctgtttcagtggtagtcggtatcgttctgattggttcggctgcatattccatctattcagtgtatgtggaaaatggacggctcacagatgagaaaaagtcactgactactcagctatcagagaaaaacgccatcatcaccaaccagcaagcacgaatccaaaaccttgcagagctggagaccaaacacattcaggaactcgacaatgccaaatctgaaattgatactcttcgggctgatgttgccgctggccgtcgcaagttgcgcatcaaagccatctgtccctccgtgcctaacaccgttgcctccagcagcatgggcgatgcaaccaccgtcgaactctctggagaaactggatcaactgttctcgatatccgagaaagcatcatcaacgacctcgcaaaattaagatatttgcaggattacataaaaacggagtgttcccgatgagtatgacattaggacaaaaattggtaggtattagctttaacccaggcggtaatattctggttgatgcggtaaaacagaatgccgctgacacaattgatttaattcaagacagcatgcagaaagcgacatcagaagaagcgctgatgattcacaacgaagcggtgcgtcgcattatggacgcccagatgtgggcagtaaaagcgatcacgtggaaagactgacataaataaacagccaccccagagcaaatgagactggggtgatgtggtatgattttgtccagaaggcgaaggggcagattcagataagtattaaagaaaatcatcatcatctatatctaaccggggtaatgcctcagacgaagaatttcttctcaggaattctgcggtagggctaaccgatcgcgatcgaactggatgccctattggtgaagttgtgcgcactgaaggtggtgacagtggagtttgtggcctcggagcacccggtggttgtatagatagtggcgctcgttcataaggataaggagatacacttctttgtcgtacattcaaaccagatggttcgggcggggaagggctattttctaatagagagcgtaatgttgaaaatctttcttgagtagccggttgctgatatggggtaggatgttgtgatgtcgaaggagttagctccctaacaggaccaccagattgtgcagcaggtatgaggtgcggggctctttgtcgtctatctggttcttgcatactttgacgcatacgagcaaaagttgcgctgttatcgacattagatggtgatgcacctctttgttttagcgaagatgtgaatgtgttagggggctgcgtattcaaaccagaagtgctgggttgatagttttggacaggaatcggagtattatactcgcggttcatattatgcatgcggctcagatgactttttaagttgtccttccgagtactcgtgtattcgcaaatatcacactgaaaaggcttctctcctatatgggctcgcatatgcctttttaagttgtcctcccgaggactcgtgtattcgcaaatatcacactgaaaaggcttctctcctgtatgggctcgcatatgcctctctaacttagctggcttccaaaacttttgaaggcaaatggggcaggtatacataagaacctccaataaataatatatttgcaataatccatacccccatctttcctcaataacaaacgaataataattaacagttagttactctctgaaactaaagccaatattcctttacccattcccttgagtggttaaaggaataccccatgccatcagttaacgctggtggtttttctttttggagaacagaacatgacacagagtaccctaacacataccttcatcattgatttcaagtgtgacactgacacactgaaccaacttaaatcacagttgaaaaatattgctgaacaagtgggtcgcattaacggtcgtcgctatgacgcaggtataacactggcagtagatacaggtgctaaggctcgaattgctgccgatagcttcaaggtcttcgatgtaaccggaaaggtttacatgaaagaggcggtcataccccaagcggtaataaaggataacgacgatcacctccgtcagataatccgtgaagagatacgccagttcgtcacccgtgagagacgaggcggcggtctgttctacaagaggtaatgccatgtcccaaatctacaacagcaaatggagtaaggcacggctggcgttcttgcaacaacatcccttatgtgtgatgtgccgtcagcagggcaagttagccccggctactgtggtcgatcatatcgtcccgcataaacttaaggatgcgattaatgccaatgatagcgaggccattaaaatcgcacggcgtttgttctggggtaaggcgaactggcagtcactgtgcgcctcacatcacaactcgactaagcaacgtattgagaagtgcaatcgagagattggctgcgatatcaacggcatcccgatagatgatcattcacactggaataaatgacggaataaaatttatatcaaccggaatgaaaacaaatgcaatgactttatgcgtaatgataactagggtgattataaagttccatccagaaagtattagaccgccgctatccctcaacgatatcgctaacgcagttttttaacaaaaaaggtcaaaaaaggccacaaacagcttgacattaacaggaggctgtaaatgacaaaacgcacgcgttcagacagcctcaaaggcaagatgcaggcgattgtcaacgcatttcaggacaccctcgaaccgccggcgcacgcaggcttaatgccggaagccatcgacttttacaatgacaacattcgcacaaaagcgctcaatctctggacaccttccgacctgattgaagtggtcagtctggcgaataaccaatatgccctgatggaagtcagtcactacctgcgcaagctggagtcggattactccgagacccgtgacgaaaaggcgatcaaggaaaaccgcaagtacaaactcgaattaacccgcgtgattattgcccagcgctccggtctgcaaatccattcacgcgccaccaatggcgaaagccgtgaccagcgcaacaagaatcaaaacgatgccgacgcccgcgccttgctgggcgaagttgaggacgatggcttgctggcgtcgccctggcactaaggagaaaggatggtcagtcaattatcgcgcggtgagaaggtcatcgcgtttatcgagcgttattgcattgtgccagaaggggtgctgctggggcagcccatgcggttagaggcgttccagaaacaatttatccgggatatctacgacaatccccacggcacgcgcaccgcgtacttatcgattgcccgcaagaatggcaaaacgggattgattgccggcattctgttggcccatctggtcggcactgaggcggtgcagaattcccaaatcgtaagcggtgccatgagccgggaacaggcggccattgtgtttaatctggcggtgaagatgattaacctgaacccccggttgcagcagcttattcacattatccccagcagcaagcggctgatcggcaaaccctgcaatgttgaatacaaggcactgtccgccgatggtaaaacgacacacgggctgtcaccggtgctggcgatactggatgaagtcgggcaggtgaaaggggcgcaaaacgattttatcgacgctatcacgacctcgcagggggcgcatgaaaacccgctgttggtcgctatcagtacgcaggcacccacggatgccgatttactcagtatctggctggatgatgcggcaaactccaacgaccccaaaatcgtttcacacgtttacacggcaccgatggatttagccattaccgatccggcggcatggcgggcggctaacccggcgctggataccttccgatcactgaaagatattgaggaacacgccaaacgtgccgcgcggatgccgtcacaagaaaacagcttccgtaacctgatgctgaatcagcgggtatcactggtgtcgccgttcatttcccgcaatacatggatggaatgcgccggggaactggagcctatcgtcggcaaatgttacgccgggctggatttgtcggcagccaaagatctcacggcactggtgattatcggcaaatcggcgtcgggtaaatggaatgttcacccgttcttctggacaccggacaagacgctgctggatcgggcgaaaactgaccgcgtgccttacgacgtatggaaaaaacaaggctttttgcgcaccacgccgggggcgaccgtggactatgagtatattgcaaaagaactcgctgacattgtggaaaacttcgacattgaaatactccactttgatcgttggcggatagagatatttaagaaggaagtcaggcgggctggcttgtccctgaaaatggccgaatttggacagggctataaggacatgtcccccgccatggataaaacagaacagctattactggaagggcaggtaaaccacgctaatcatcccgtgttaaccatgtgtgccgcgaatgcggtggttgagcgggatgcggccggcaaccggaaactcgcgaaagacaaatccacggggcgcatggatggcatggtggcgctggtgatggcagcaggtgcattaaacaatgcgaaaggttcatcggggctggatgcgttcctccagaacccaatcatggtgggggtataagtggcgaaaaagataggcagaattaaaggtaccctcctgagctggatgggggttcccattggtttactggatgggagtttctggcaggaatggacagggatgagcagcagcggcaaaacggtcagtgcggacagcgccctgcaattatccacggtgtgggcctgcgtccggttgctgagtgaaaccgtatcaacgctgccgctcaagctgtacaaatcccatgatgacggctcccgtgaactggcgaaaaaccatccggtttaccccattctgtgcaaccgccctaatctggagatgacccaatcccggtttatgttaacggtggtcgccagtctctgtttgcgcggcaacgcctttatcgaaaagaagttcatcggtcataaactggtggcgctgatcccactgctgccgcaaaacatgaacattaaacgcttgccgggcggtgatattgaatacacctacgccgacaatagcggggaacatcagggcaggcgtcgggttatccccgtcaaaaacatgatgcacattcgtgggttcggtatcgacgggttgagcggattgatcccggtgaaaaccgggcgtgatgtgattggcgcggcgttatccacagatgaggcggcggccaaagttttcgaaaacggactgcaaagctctggctttatttctgcgtctgcaaataccgatttaaccgaagagcaaattaacggcattcggcaacacattcaggcgttcgtggggtcaaaaaacgccgggaaaatgatggtgctgccgggggatttgacgtaccagaacatcacgatgaacccggaggcggcacagttgttacaaagtcgcgcctacaatgtggaagaaatttgccgctggtttcgggtgccaccggtgatggtgggacacgccacaaaacaatccagctgggcatcgtcactggaggggatgaacatgcagttcctgacccacacgctcaggccgttgctggtcaatatcgagcaggaaatcgcgcggtgtctgctggattctgacagcgattattacgctgaattcaacgtggaggggctgctgcgtgcagacagcagagggcgggcttcgtactacgccacggcattacaaaatgcatggatgagccgcaacgaggtcaggcgcaaagagaatttaccgccaattgagggcggggacgttttcaccgtacagctgaacctgacaccgatagatctgttaggggaggaggtggagaaaaaattaccgccagaggataacaaccatgaagattaaacacatgcctgtcgcaccggagggcaggccatttaacgcgaccgttaacgatatccgaccgctggcgctcgacaaatggaatggggggatcagagcgacgagtacggataacaccctctctattctcgatgtgattggtgagagtttttgggacgagggcgtcacggccaaacggatagcgggcgcattacgggcaatgggtgatcaggacgtcattgtcaatattaacagtccgggtggggatgtgtttgagggtatcgccatttacaacctgttgcgcaaccatagcgggcaggtcacggttaacgtgctggggctggccgcatccgccgcctcagtgattgcgatggccggggatgaaattaacatgggacgcggggcgttcctgatgatccataacgcctggacctgttgttgcggcaataaaaatgaactggttgcggtcgctgaggcactcaggccgtttgatgattcattgattgatatctatgccgcacgcaccggtatcgacaaggccagtattgcccaaatgatggacgatgaaacgtttatcaaccacaccgaggccatcgcgcagggatttgctgacgggttgttaaccgccgacgtgattgacgacggcaacgacagcccgcaagccgccttgcgcaaactggatgccctgctggctaaatcccatgtcccccgcgcagagcgcagaaaactgttcaatgcgttaaacgggcgcacgccgggcgctgcgtctcacaatcacggtatgccgggcgctaccgatatcaatattgacactttagccgaactggaaaagacgataaacgcctttgcaccggcacacccataatctggagaatgtatgtctgataccaatgaattactgaaaaacctgtctgccaaaatcgaagcggctaacagccagttcaatgccaaagccgaagaagccctgaatgaagcgaagaaagtcggcggactgtccacggaaaccaaggcggcggtggacaagatggcggcggaactgaatacgctgcgtgaagcggagaaatccatcaaggcggaattaggcgagctgcaacagcatgttgcacaaatgcccctgcacaatgcagtgcaggttgtgcagacgctgggccagcaggtgatttctgctgaactgatgaaagaggtgagcggcaatatttctgccaaccgccgcatttccgtgccggtacaagcggccttgacaaccccgcaagtgcctgaccgggtgatcgagccgcaccgtctgccggaaattgacgtgaaacccaaacatcgcctgtttatccgcgatttgattgccggcgggacaaccacgtctaacgcgattttctgggtgcagcaaactgggtttaccaataaagccgctgccgtaccggaaggtaccgcgaagccctacagtgatattcagtttgcgacgcaaatcactccggtagccacgctggcgcacatgttcaaggcctccaagcaggtactggacgatttcggacagttgaaatccctgattgacagcgaaatgcgctacggcttgaaatttgttgaagaacaacaaatcctgttcggtgacggggcgaacggcaatatcaagggcattgtgccgcaggccagcaagtacaaagcggaaatcaaggtcgacaaggcgaccgcgattgacgatatccgtctggcgatgttgcaggcgcagttagccctgctgccgccgtcggccatcgtgacccactttgtggactgggcgacggtggaattaatcaaggacagtctcggccgttacctgctatccaacccccaaggctatacctcgccgacgttgtggggactgccggttattgccacggatgtggcggcgttccgcggtaagtttctggtgggcgcgttcgattctgctgcccagatttttgaccgtgaacaggtgaacgtcgtgatttccagcgaaaacgaggacgatttcggcaaaaacatgatctccattcgttgtgaagagcgtctggcgctggcagtcaaacgcccggaagctttcatttacggtgacttcaccgcaacggccaaaggttaatcatattcagcggctgtcacaggccgcttttttgataacaggtgacgcatgatacctctcccaacaatcaaagatcattgccggatagactcaccccatgatgatgacctgctccggcaatatgaaaacgccgccctgcaatatgccctgaattataccgacagaaaaaccctgcatgtgccggaagccggggtgatcccgccggagtctcaggcgctgatattggatgaggcggttattcaggccattttactgctgatcggtcactggtatgagaaccgcacggccgtggttgtggggcagtcagtggccaccctgccatttgccgtgaaagccctgctgcaaccctataaacgctactgtctgtgaggtgaactatgaatattggccgattgcgtcaccgcatcgacattcagggtatccgcacccgccgaagtccatctggtggcgttgtcaacgaacgctacaccgtggcgacggtctgggcggaagcgaaatttatcagcggccgcgagttggtggcggccaagacggtgctgtctgaaagcctcgtccggttctggatacgttaccgtgctgatatcgataccaccatggctgttgtctttcagggcaaaacctacgcgattcaggcggcgatgccggacaacaaattaaccttgttggaattactctgtcaggagggtgtaaagcaatgacgaccgtggatttttcagcacttaaagacctgtcgcaggatttggcgttactcagcaaagccgagagcgacaaggtgttacgccgtggcacctatgccggggcgaaagtcctgcgcgatgagacccgcagccgcgcccccaaacgcaccggtaagctcaaaaagaacattatggcgactaaccgtaaaaagcagcgtgacggctcagtgtcttcaggtgtttatgtgcggggatcgaatcaatccggcaccaacagcgaccccaaaatgaagaaaaacgacccccgcaacgcctactactggcgctttctggaaaaaggcacctcaaagatggccccgaagccgttcattgatccggcctttgaatccaaatcagatgccgccgccgatgcggtatttaatgcggcgttgaaagccattgatgaggtactggcaaaatgacagacggcgatttgtttacattgttagatccggtactgcccggtcgggtgtttccctatttaatcccgcaaaccgaaagaaaaaccgcggcgccgtggtgcgtattttccacctacagtatctacaccgatgtactgagcggccagtcggtcaaaatgacgcgggttcagattgatgcctacgcgcccgggctggacgacgccgaccggatttgtggcgacgccttcagtgccatcaaaacattgcaaccttttgaagtagaacgtgagaacagttacgaaaatgacacggggctgtatcgcgcgaccgtcgaatttaaaatctattcctaatcccggagataataggctaagtataaaaaacatgggtaagagtgcgaatngccccagtgcnnccaaacactacnntgccccccct

SEQ ID NO: 14974 - DNA, 111286 bp, Xenorhabdus bovienii
  Genomic contig Name=Xb4151_4152.C433
agcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacctgacaacaccgaaggtgttttggtgagagagagacgcagtttcaaatgaaaaacagcagcttgttcgggattgaacacagaatttgtctggcggccatagcgcggtggtcccacctgatcccatgccgaactcagcagtgaaacgccgtagcgccgatggtagtgtggggtctccccatgtgagagtagggcactgccagacatctatttagccagagaagccaccccaccgggtggcttttttgcgtttgtatttttctattatttactcaatttctgctttattctttttcttattaccctttcttattcgatagaataaaatgaaataatttcaatttgagtacaataactcgacattgatcttgtcttttgatttaatttggctatctagaagtctaagtatacaagtgatttaacaatcgaggtttcagtaatgccaattcgtgtaccggatgaattacctgcggtgaatattctccgtaatgaaaacatctttgttatgacttcaacacgagcgaatattcaggatattcgccctttgaaagtgctgttacttaacctgatgccgaagaagatagaaacagaaaatcactttatcaggttattatctaattcaccgttacaggttgatattcaattgttgcgtattgatagtcgccaatgtaaaaatactccagaggaacatttggataacttttattgtgattttgagtctataaaagatcaaaatttcgatgggttaattgtaacaggcgctcctttggggttggttgaatttgaagatgtcacttattgggccgaaattgaaaaaattgttaattgggctaaaaatcacgttacttcaacgctctttgtttgttgggctgttcaagctgccttaaatattctttataacctgcctaaatatacgagaacgactaaattatccggtgtttactcccatataaccttagatccttttgcgttattgaccagagggtttgatgaatcctttttggcacctcactcacgttttgcggattttccagagacagtgatccgtgagcataccgacctagatattttggcttgttcagaagacgctggcgcttatttgtttgccagtaaagacaaaaggttggtatttgtgacaggtcaccctgaatatggagttgatacattagcgacagagtactggcgtgatctggctgcggggttagaacccgcgctaccggtcaattacttcctgaataatgatcctgaaaataaaccagttgcatcttggcgtagtcacggccacttattgtttttaaattggcttaattactatgtctaccaaattacgccatacgatctgacgtatatgaatcctactttagattgaatttgtaaaaaaataaaaataaaaatgagaattagctgaagcgagccatttctcatttttttaattttctatttttttagaatcatttaccttccccgattatttcttatatataacaaaaagttaacacttttattcctaattaattggaacttatttccctgtttttatttttaataaattcatttaatcatttgatttatttaaattaatttacttaagtttaaataatggaaatggtttttgatttatttttaatattgtttactcttattcaagtggacatgttaaagacgaggagtgggggatgacacagcaagcattaacaactgatttaacctttacaaagctttttggtgaagctgaaaatcagatattactacctgaatctataggttttatagaagatctagttgttgagttttctgacaggcgtaaaaaattattggaagagagaattcactggcagaaaaaaatagatgatggaatattacctgattttatttcggaaacaatttccattagggaaagtgactggaaagttcagggaattcctgacgatcttaaagatcgccgtgttgaaatcacgggtccagtagaacgtaagatggtgattaacgctttgaattcaaatgttaaagttttcatggcggattttgaagattcactgtctccttcatgggataaagtcattagtgggcaaattaatctaagggacgcagttaacggtacgatctcatataccagtgagcaaggtaagcgttatgaattgaaatctgaaccggcagttctggttgcacgggtcagagggctgcatctgtcagaaaaacacgttctttacaagaaggaaccgatctcgggtggtctatttgactttgcactttacttctatctaaatcataaaaatctgctggcaaatggcagcggcccctatttttatttgcctaaaattcagagctaccacgaagctcaatggtggagcgatgttttcagttttacggaagagcgcttcaacctaccaaaaggtacaatcaaagcgaccgttctgattgaaacactgtctgctgtattccagatggatgaaatcctctaccacctgcgtcaccacattgttgggctgaactgtgggcgctgggattacattttcagttatatcaagacactgaaaaaccattctgatcgtgttttgcctgatcgccagtcggtcacgatgacacaacctttcctgagtgcctattctcgcttgctgattaaaacttgccataaacgtggtgcatttgcgatggggggaatgtcggcattcataccaagcaaagatattgaacaaaaccagtggattatggacaaggtcagggctgacaaagaactggaagctaagaacggtcacgatggcacatggatagcgcatcctgggcttgcagatattgcgatgacagtcttcaacaccaccttaggagagcggccgaaccaattggcagtttcccgtgaagaagacgaaacgatcacagcggaacaattgcttgaaccttgcttgggagagagaacggaagaaggattgagagcgaatattcgtgtcgctgtgcagtatatagaagcatggatttcaggtaatgggtgtgtaccgatttatggtttgatggaagatgccgctactgcggaaatatctcgcacatctatttggcaatggatccgccatgaaaaattactttccaacggtaaaaaagtcacaaaagagctgttcaggcaaatgctgaaagaagaactgggcattattaaacaagaagttggagagatgaatttcaaccaagggcgatttatggaggcttctaatctaatggaacggattactacacaggatgagctaatcgatttcctgactttgccgggttatcaattactcgattaattcaaaaacgacaatatccgattaattaagaataggaagcagaagaaaatgaacaattcccgaacacaacagatcgctcaattggaacaagaatggaaacactcacgttgggaaggtattactcgcccatacagtgctgaagacgtggttaaattgcgtggttccgttaatccagaacacactttagcgcagatgggagcgaaaaagttgtgggaactgttacatggaaaatcaaagaaaggttatgtgaacgcacttggcgccctgactggcggtcaggcacttcagcaagcgaaggcgggcattgaagcagtttatctttctggttggcaggttgctgcggatgcaaatactgcctccagcatgtaccccgatcaatcactttatccagtggattctgtacctaatgtcattaaacgcatcaataacagtttccgccgtgcagatcagatccaatgggcaaatggtatcgacccggacagtcaggaatacaccgactatttcctgccgattgtcgcggatgctgaagcagggtttggtggtgtgctgaatgcatttgaactgatgaaagcgatgattgaggctggtgcagcggctgttcattttgaagatcaattggcggcggtgaaaaaatgtggtcacatggggggtaaggtactcgtaccgactcaagaagcgattcagaaactggtggctgctcgtctggctgctgatgtatccggagtttcaaccttgttagtcgcacgcactgatgccgacgcagcagacttgctgacttctgattgtgatccttatgacagcgaattcattactggcaagcgaactgctgaaggtttcttctgtacccgagctggtatcgatcaggctatcagccgtgggttggcttatgccccatatgccgacgttgtttggtgcgaaacttctacgccggatcttgaggctgctcgccgttttgcggaagccattcatgcggaatacccaggcaaattgctggcatacaactgctctccatccttcaactggaaaaagaatctggacgacaaaaccattgcgagctttcaagagcagctgtctgccatgggatataaattccaatttattacattggctggtatccacagcatgtggtttaacatgtttgatttggcttatgactacgcccgtggtgaaggtatgaaacattatgtcgaaaaagttcagggacctgaattcgcagctcttgagcgtggttatactttctcttcacatcaacaggaagttgggacagggtattttgataaagtgacaacgattattcagggaggaacgtcttctgttaccgcacttacgggctcgacagaagaacagcaattttagatttatcaggctcattgatattatcaggtgggggattctgtgaggaattcccctttacgcgtcggataaggtggcgatgatggaaatagatcttgcgcatttaattgcacaaaccattttgcagggattcgatgcgcaatatggtcgatttctggaagtgacttcaggcgcacagcaacgttttgagcaggcggattggcatgcagtacagcgagccatgaaaaagcgaatcaacctgtatgaccatcatgttggcttggtcgtggaacagctgaaatgcattcacggtacactgcaatatgacgaagattacatagctaaagctaaagccgtttatacccgtttgttgccggactatcctcgttttgagattgcggaaagtttttttaattcagtctattgccgtttgtttcaacacagtaacttaaagccagaaaatctatttattttttcttcccagcccgcctgtcgttttcgtcatatttcacgtccattgtcgcgggatttttcccctaacagtaatattgcgtcaatgttgcgaacgatattaaatgatgtgccattgcgtcttaaatgggaagatttggatcgagatattgattacatcatgcaatatttacagaaaacattttctgaatatgatttattacatgcgacatttcagattgctaatgaactattttaccgtaataaagcggcgtggctggtgggaaaaatcaggctgggcaccacggtttatccatttttattacccatccaccataacgaatccggcagcatctttattgatacctgcctgacgtgccgcaatgacgccagtattgtttttggtttcgcacgttcttactttatggtttacgcccctttgccggcagcattagttgagtggctgcgtgaaatcctgccgacaaaatcaacggccgaattatacatggcgattggttgccaaaaacatggcaagacagaatactatcgtgaatatctgatgtttattaacgcatctcaagaacagttctcgattgctccaggcgtgaaaggcatggtaatgcttgtcttcgcttctccttcatttgatcgtgtatttaaagtcatcaaagataaatttgctcctcagaaagaagtctctcaagaacgtgttcaggagtgttaccgtctggtcaaagagcatgatcgtgtgggaagaatggccgatacgcaggaatttgagaactttgtcattgagaagcgtcatatcagtcaggaattaatggaagaattgcaaaaagaaatcccggcaaaactcgaggatctgggtgataaggttctgataaaacacctctatatggaacggaaaatgatcccgttgaatatttatatggaacaggtagacgaagtgcagttgaaagatgtgatagaagaatacgggaacgctattaaacaattggccgcagcaaatatatttccgggtgatatgctgtttaaaaactttggtgttacgcgtcatgggcgggtgattttctacgactatgatgaaatctgttatatgactgaagtgaattttcggaatatccctccaccacgttatccggaagatgaactggcaagtgaaccttggtacagcgttgctgccaacgatgtttttccagaagagtttcggcattttttatgtggtgacaaccttgtccggcgttactttgcagaaagtcatagtgacttattcgaagcggattactggtcggcattacaagagcgcattaaaaatgggcatgtggaggatgtctttgcctatcgacgcaaacagaggttcagtcagcgtaattaaattcaggaaataaaaaatacaagtcgtgatatcacatttttcatggataaaaataatgtttcactgaacgataaaaattagagattgcatactattaattaaaaatgactggctattcatctattgtctttcaatgatatgatcctctttgtgattatgaaatctgttttaataaaattaattccgtaattaaataatcataatcacaaccattaaaagaatattcctattcattttaaacaatatttagggagagaataatggctaatgtcattttatacggcgatatccttcacattaaaaataggtacgccgatggtagttatcttgatgtttatgggcagtctacatcactgggagaaaaatataatgttgtcacttctgtttcaccgaatcgtgatacaggctcgggttcatggcagattttatctgcggaaagcaaaagtttaggaacggaaatttacagtggtgataccgtatttctagtgaatctctatcgaaacaatggaggatatttgagagtgagtggctatgcaccttctcctgaactctataatgtttataccgcagatagacccgtaaacgccctcgatacggcaatatggcatatttttacagatacggctaatgaatttgatggcaaaatccgtgagggaaatgtcattcgtctgcttaacaattttaataatgtacatggtggtttccttgatacctgttggttggcaaaccaatctggtgctgtttataaggtgtatacttcactgctgtcagatcgggggaatggcacgggtacatggatattatcaaaagcaatcaattaattacgctttggctccggcaattacagcatgtgccagctcggtaatctgggcataatcaccttttttcagtgcattgctaggcaccagccatgaaccaccaatactcagaacactatttagagccagataatcgcggtaattgtcggatgaaataccaccgcttgggtagaaacgaacttgagggaatgggcctgcaatggcttttagcgctttcacgccgccattcgcttctgctggaaaaaatttgaagcaatttatcccataactcataccaagcattaattctgaaaccgtagagatccccggaatcaatggaattgagcctgtagttgcggcttttaataacgggtcagttaatcctgggctgatggcaaactgagcgcctgcttcggtgaccgtagccaattgttcaggattaatgactgtacctgcgccaataattgcttcaggcacttctttggcaataagacggatggcctccagtgcgcattcggtccttaaggtgacttccagtacacgtatcccgccggcaatcagtgcttttgccaatggaaccgcgtgttcaatctcattgatcacaataatagggacgagagggccatcggtcaggatattttctgcggttgttttccaattattcattagcactttcctctcgccaaattagaatacagggaatttaaaatccctgtcattaaagtgtgatgcaactggcaccttattctgcacccgatagttgggctcgcagtgaaccaaacagttcaaatagaccttttaagggaaatttagacccaatttacttaataccgccatattctctactgatctcttttgcagcccgcatcacgagtgcgcctagttcagtgactcgatcgtcagagattcgtgaaattgaaccggaaatggaaatggcggcaaacgcttcatgatgttcatcgtaaatacaggcggcaatgcagcgtaacccaagagcatgttcttcatcatcgagcgaaaagccttgcttgcggatttgttcaagattttctttcagagccgctgcggtggtgtaagtatgctgggtataggtatgaagacctttcttatggagtaattggaggcgtttttgttcaggtagtgtagaaagcaacgctttgcctgcgccggaagcatgcatcggcagcttgccgccaatgggggcagacatccgcatcagcgcattacattgcacctgatcaacaataacggcttcatattcatcaagattcaggatggcaaggttgacggtttcaccggaatcttccattaattgacgtaatattgggtgaaccaacaccatcaaattacgactttgcagaaaactgctaccgacaacaaaggtatgtgaagcgataacccataatcctaaatcgcctacctgacggacaaaaccatgctgctgtaacgtagtcaaaaggcgatgagtggtggagttaggcaaaccagcttgtatagccagatcggttaaggcaacacccacttgtgaatcggaaatatattccaaaagtgtaagccctcggcttaaggactgaacctgaccgcttgtagcggtactatttgccgttattttggttcttttggtacgcttgttggcaacggctgtactcataaaataccctctgaaagtgtctgtgtagcaaccctgattttgctaaagcaaaaatggaatttattttcgttttcttattatggatgataacgagggggaaaacacatccgatgagtggaaccactctgagatatccaatttatctacatcaggctgaggacggatcatcttgattacgtcagctcacaccgcgaatatcacagtttcggaggaattagcggggtgtgaattggcgaaacattggtaagcagggttaaataccttctttgtcgaaatcagaaaaaaccgctttagcggttttttctgtcacaccttaaacaaattctgatgcagtttctgaatgactgattccgcatcttgaccgggaacgagcaaacatacattgtggctgcttgcgccatagctgatcatccggatattaaaagattccagtgtgccaaaaatttctttccccaaccctttagcctgtgaaagctcattaccgataattgccaccagcgccagatcttcttcaacttctacacgacataatgtagaaagttcggtcagcagagcattagtcagcagactgccattggtgctggtagagccagttgtatccagcgttagggcgacactgacttctgaggtggtaatcaaatctactgaaatgttatggcgtaaaagcagcgtaaaaacttccgccagaaagccccttgcatgtaacatttttaggctgtgcaaggttaataacgtctgtttgcggcgtaatgccagtgcacgaaacaggggcgggttttcggttttgtcacaaaccagtgtgccgccggcctgtggatctttacttgatccaacaaaaacaggaataccgcaacgaatggcaggtagcaacgtagctgggtggaggatcttagcaccaaatgtcgccatctctgctgcctcatcaaatgcaattttatcgatgcgcttggctgttggtgcaacacggggatcagtggtatagatgccgggaacatccgtccaaatatcaacacgctgtaaattcagcgcttcgccgagtaaggcggcggtataatcactgccaccacgtcccagtgtagttgtgcggcctttttcttctctgccgataaaaccttgtgtgataacaactgtattattcaaacgaggctgaaggagctcaaccgccgatatatggagttgaagggagtctggttctgctcgtccgaagtgatcattcgttcgcatgaccctgcggatatcaaaccactctgcatttacattgcgttgacgcagtaattctacgaatagcaatgtggacatcacttcaccgtggctgaccaattcatcagttaacgcctcagaggttgccaatgatgcggcttctgacaacatctcgatattttccagcaggcgatcaatttcttcacatatcacattcacgtcatttaatcggtcaataatcgcatattgaatgtcacggatctgtttcaggcactttttacgtttatcgttatcacagcccgtcgccaatgcgaccagcaaattagtcacccccgcagaagcggacaaaacgactacgcggacatctgcgtttgccagaataatatcggcacagtgattcatggcatcaaagtctgccacactggtaccgccgaattttgcgacaacatactgtgggtaagtagatgaaacagcacacatggatgataaccttctgttcgaggaataggcttttagaagtatcgggttagctacgctgagtcaacgtttaggcattgagcatcaatatctttcatgatggaactaaaattatcgtttttacctatatcagcaattaggggtggaaatcatggactattttgaccaatatcagtaattaaaaggaaagggagacgcatcacagagttaagtcgttacaatctgtgtattcctattatttatctatagttgatagagaccattattcatgaaaaacatcaaccctagccagaccgaagcttggaaagcattgcatcagcattttgagcaattgaaaaacgtccacttgcgggatttgtttgaacaggacaaagcgcggtttacggcattctccgctacgtttgacgagcagattttggtggattattccaaaaatcgtattaccgctgaaacactgacaaaattacagacactggcgaaagaaacggatctgtccggagctatccgcagtatgttctccggtgaaaaaatcaactgtactgaagatcgtgctgtgctgcacattgccctgcgtaaccgcagcaataccccgattaatgtggatggggaagatgtgatgccgcaagtcaatgcggtgctggcaaaaatgaagtcattcagtgaacgcatcatcagcggagaatggaaagggtataccggtcaagccattactgacgttgtcaatattggtattggtggttccgatctcggcccttatatggtctctgaagcactgaaagcgtataaaaatcacctcaatatgcactttgtttccaatgtggatggaacccatatcgcagaaacgttgcaaacattgaacccagaaacgacgctgttcctgattgcttccaagactttcaccacccaggaaactatgaccaatgcgtattctgcccgcaattggttcctgcaaaatgcggagattgaggctcatgttgccaagcattttgcggcactttcgaccaatgagcaggaagtcagtaaattcggtatcgatccactgaatatgtttgaattctgggattgggtcggtggccgttattcactgtggtctgcgattggtttatccattgcactttccattggctatgagaatttcgaacagttgctgagtggcgctcatgctatggataaacacttcgagcagacttctcctgatcagaacattccgatcctgctggcgctgatcggcatctggtacaacaatttctttggtgcagaaactgaagcgattctgccttatgatcaatatatgcatcgttttgccgcttattttcaacagggcaacatggaatcgaatggcaaatgtattgataggaatggcagcccggtagattaccaaactgggccgattatctggggcgagccgggcaccaatggtcagcatgctttttatcagcttatccatcagggaaccaaactgatcccatgtgattttattgcgcccgcaatcagccataatccgctcagtgatcatcacagcaaactactgtccaacttctttgcgcaaactgaagcactggcttttggtaaaaatcgcgaacaggtggaagcggaatttgttgcagccggaaaaaatgcacaggacgtggcgaatgtcgtgccattcaaagtttttgaaggcaaccgtccgactaactccattctattacgcgaaattacaccattcagtttgggcgcattgattgccatgtatgaacataaaatctttgcccaaggcgctattctgaatattttctcatttgatcaatggggcgtagaactcggtaaacagttggcgaaccgtatcctgccagaattgcacgatgatgaagcgataaatagccatgatagttcaaccaatggcctgattaatcgtttcaaaacatggcgctaatctgactttttatcgtacttaataaaattgcctcgcctccaataaacatggctattgaggtgaggcgcttatgattacgaacatcattctgcttgttctttactcattaatatttagataagcccattcaatcacgttgaaatatgcgataacaatgaagatttacataaattgttatcaactttttattttattcacttgcaacgtgatatcctcactccccattcgttgtgctgtcggggaaaatgatgtgccccgcaatgggaaaatgacatggcagatgacacaatattaactcctgcacctatccgctggttttcggcagatgattctaatattcctgaagatattttagattggcttatggaagtcggttcaatgacgcgccgttttgaagaacattgtcagcaggtatcagttgtaccttttcgggaatgctttattacagcagcagaattaggagatgaaagtgagcacttacctaaaagtgaaaggtattggttgcgtgaaattgtcttgtatggagataacattccgtggctgctgggacgtactgtgatccctgaggaaactctgactggcacggataagtggctggtcgatgtaggaacagttccacttggccgatatctttttaatggtaataatttgactcgggattatattcaaataggccagcaagggcagcactgggcgcggcgttctttattgagactatcaggcaaatccttgttactcacagaggtttttctgccggaatcacctgtatataagatgaataaaatcaaagggggaaaatagattggaggccagtatgacgcagaataaatggctcgcctattgccgtttaatgcgtatcaataaacccattggcgtattattattattatggccaacatattgggcattgtggatcgcagcaaaaggtatgccagatttgtacatcttgttagtttttactattggggtgtataccatgcgtgctgcgggatgttgcattaatgatttcgcagatagaaaatttgatgggcatgtagaacggacaaaatctcgtccacttcccagtggggatgttagcgaaaaagaaagcaagatcttgtttgttacactggggctgatctctttcgcactggttttgacgctgaacaaaatgacgattgccttatctttcattggattggcactggcatgggtttatccttttgtcaaacgagtcagtaacttgccacagattgtattgggggcagcctatggttggtcaattccaatggcttttgccgcagtaagtgagtccttaccattagaatgctggttgttatttttggttaacataatatggtcagtaatttatgacacacagtatgcgatggttgatcgtgatgatgacctgaaaatcggtgtaaagtcgacggccgtgctttttgggcgttttgataaactgattctgggtattttgcagtttattatgctcggtattctggtatcggttggttgcatagtgaatttaggtgggatgtactactggacgttattactagcgggttcgctcttcatttatcagcagaaattgatttctgggcgaaaaaaggctctctgctttcaagcatttatgaacaataactacgtcggttttatcttattcctcggtattcttttcagctatgtttaacataacgggcggataaacccgcccgttcagctttatctccagcgtaatgctttaatgttggtctttgtttgtctgttcagtatcattctgctctggtggcatactggcactttcaattgtcagacggatctcaggggacattaattcactcaacatttgatagagtttttgagcgctggtcgtgcttatatcactattatcatgaatataaccttcctcgcgcagcgtattgactgagctggcaaacacggccttgtcaaagaactctggggcattgattccatgcagtaccgacagacgctgtgccagcatccggctctctttttccagcacgccacggctgatttcaggagtggcattcaataaagaaagcgtaatggcatagcgttgcagagtttcacggatacctgctgccagcaattgcattggacgaatgcgctcagggttcagaacgagcatatcctgttctttgttgcagataaggcattgacgcaccaattcatcaatcagtgtgttgaccacttcaggtagagattccttactataccgcatgaaaagttcttgtttgagcagcgggtaaaccagctcaacctgactgagtagttcgctgcggctaatgcggcgatgatgcatcacaatactggtaatcaaagatggcaggatcagcaagtgctggatattgttgcgataataagtcatcaataccgcgctttcacgaggcaggataatgatatccccaagactgtctttttcgacctcaaacttattcatcagcaaggcatgatccagcaattcttcagctgttttgttcggcacagtcacatcgtcagcgtaaggaacattgcacagtaattgcagataacagttcaattgctcaatcagctgctcgcgagtaagtgctcgctgacgtgatgacaacaaggctgtagtgcataaattgatggcatttgctgctgcggcattattgatgttgaccataatattgccagcgagtttgctgacagtcggcgttaaccatgtcgggcgctgggcgtctatcggatcgatggaatcacgccagtcgggaacatgatggttaaggtattgtgtcagaggaatgggttcgccaaagtttacataaccttgtcccagattacgcagtttacgcagcccacggatcatctgaaaaaagccttctttttccttggttgcaccgcgtaactctttagcataagttgcgacttccattacatgttcataaccaacataaattggcacgatggtgattggacgggaatctccacgcagcatcgcctgtaatgtcatcgaaagggtgccggttttcggatcgagcagacggccggtacgggaacgcccaccttcgacgaagtactcaacagaataaccacgggaaaacaactcacccagatattcacggaatatcgtcgaatagagcttgtttcctttaaaagtccggcggataaagaatgcaccaaggcggcggaatatcgagcctgccggccagaaattaagattgatgccagcagcaatgtgtggtggaaccagcccttggtgataaagcacatatgagagcaggagataatccatatggctgcgatggcatgggacataaaccagttcatgaccatcctgcgccagttggcgaacccgctcggcgttatggacattaatgccctgatacaaacggttccacgtccatctcaagatacgatcggtcaaacgtacggtttcagaagagaaatctgctgcaatctcctccaacatattgatagcgttttgcttcgccttttcaggtgagatttttttgctacgtgtctcatcggcaatggctttctcaatggctttggatgccagcagcttgttgaacagatcctgcctggcgggcaaacgtggccctaccgcagccaaacgctgccgggaatagtgtatccgtgcaacgcgggcaagtttattggcaatgatatcatctgtgccatgatcattggccatgctgagtaatgaaacaggtgtggaaaaacgcacaaaactatcccgtcccagccacaaaattgcaaaaaacttttgcacaccgtttagtaaacgcagctgtggcgctgtatttccttcctgcccttcgcgtccaggggagcggccgaacatcacagaaacaggcaccatctgaatatccaaatcgggattattgcgatgcagatccagataagaatgaaaaatcttcacggattcatgtttaggtgcatagcaacggaacactcgtgggccgtcatcaataaagacatagcttggaagtagggtgtcacccatttccaaaggattcaatggatctggcagatcttgcgccaggcattgttgacgcagggtcaataagtctgtttttgagtgatacggcagcacatataaaataggccgtgtcgtatcaaggatcagttctgcaatgggatccgtggggataagcttactttttactaagaatttcagtggaaaattcaataatttataatatattttacgccaacttgacataacaactttaagcctcttgttagcaacgcgccgcaagcataccagaaacggattttgagatctgtggaaataagacaataataggagctaaaagttatatgaccttacaaatattatgctaattgaagaaaattttttatggaaaatcaatcaacaggtttgattcgtatcattaaagcggcagggtactcggcgaaaggtattagggctgcgtggcaaaatgaagcggcatttcggcaggaagtcattgtcgccatattagcaattatccttgcattttcccttgattttggcatgtccgagaggcttttgctcatcggttcagtcatgctggtggtcattgtggaaatccttaacagcgccattgaggcggtagttgatcgcattggcagtgaatatcatgaattatcgggcagggcgaaagacatgggatcagctgcagtatttctgacaataattctggcgttgtttatctggggaatgatcctttggtcgtattttatgcactgatatgacatgattttcgtcaatacacgttatttagcggcttttatgggctggcaggttcccaattcgaatttacctgtatatactcacaggcggactgtataaacaaacagggggcgaaatgaaagcattaactgccagacagcagcaagtttataacttggtgcgtgaccatatttcgcaaacgggtatgccaccaacacgtgctgaaatcgcagcacgtcttggttttcgttcacctaacgcggcagaagagcatttaaaagcattggcgcgtaaaggggtgatagagattatctctggtgcatccagaggtctccgtttgcttcttgaagaagaaggggcagcgggattaccgctgatcggtcgtgttgctgctggcgaaccattgctggctcaggaacatatcgagagtcattacaaagttgatcctgcattattcaaaccaaatgctgattttctgttgcgtgtcagcggaatgtccatgaaggacatcggcattatggatggggatttacttgctgtgcataaaacacaggatgttcataatggccaaatcattgtggcgcgaattgaagatgaagtgacagtcaaacgtttcaaacaagtaggaaacaaaattgagctgattgctgaaaacccagaattcgagcctatcgttgtggatttatgtgagcagagttttaccattgaaggattggcagttggtattattcgtaacggggattggatctgattgtaaaagcggataattgcactttgccattctggggcggtcatttttttcgtagtacccgttcaataaaagttttacggaagcttgaaaataaatgtgtttatcggccatgaccgcctcaatcaaacttaaggttattttgccttatttctttttattctcttcagttttgtgattatgctgacatgtatcgcgttctgtacaggaatcgatttcatggcaaggggaacacaaaccgtggacttcaatcacgctgtgacgtaaatgaaaccccactccttgaactaactgctgaatagcggattcaatattcttggcatcccgttcggtaacggaaccacaattctcacagataaacatggctgacgtatggctgggttcctcaaaatgatggcaaatcacataactatttgtggattctattttgtggacaaaaccctgttcaagcaaaaattccagcccacgatagaccgttggcggttttgcctgtggctcgacttcacgtagcagatccaataaatcataagcgcttattgcgcttggctgcgttgaaattaaacgcagaatttcaagtcgttgaggtgttaaacgaactcctcgtgacaggcagattgtctcagcctgtgtcagtaacttttttggattgatagttttcattacacctttcacactcagcatgatgccaatagttgtaatattatcatgtttttcagtctggaagtgggatccaagcagacggttacggtgctgatggctaaacgagtcggtgaaaaggtgattaactatcctgatgttatgtcatactttgtttaatggtggtggctattcaggataaaaataaaaattaatccgttgataagaacgataaaatatgctgaaaacaaaattttaattctttggcggtagaaaaaaggcatgtatggagataatagcagtttcttaaaagaaaccgctattttgtaagggaaattaaggcaattgttatttagtgaaaatgcctttaaagggattccagccatcatcgccttttatttcttttagataataagcataatttgctagatacccatttaagagagaaaaagctcctcccattacatttaaaatactatctgatatatcaatacctgatattattgagaaaattactatgattgaaaatacagcaatgttaaggcctaataaagttaatccttttttccataatccaatgattaggtaatagaaaattccgaaaaataatgcaataaagttcatgtttattttaatacgttttaaaaaaggtgtttttctaaatgcttctctatgctcttgtgtagatggagctcaatttttttcaaaaaacttaaaacgttcttgccatttttcagaatatttagatatgtccattgagttcccttatttattatcattatattttttaagtttaataactattttttaaaataatcacaaacggtaatttctatttttggatgttatttgtgaaaggtttacttttttcttctctttagagtaataaataatcttccctgtgcattaaagatgataatgataaagtataaggttaatcattatcaatactgtttttatttacagtatatcggattttattaattacataattgatattttctttgtgttattaactaattattgaccttaatcgctgtattcaattttggcggcataaactttatatgtcatgatattcatagagtactccttactgtttgaatgagtttttttgtttagcttgtatggattcctgtccgccctctggaacttctctgtgctatagtagaccataaatttccccctattctctgtatcagcttccttataaatgagggagcggcaagggattcagagaatgaaaatatcgccttgaaagtacaaaaatgcagcaaaataaaaaaattgaaaatactgatacaactaaacatgtgagcaaaaaagaggctgaattctctctcaaccgtttctccgttgcccccatgttagattggatttactaataatataaatcaactagttatgcggtttaggggtgctattggggtgccttgatagcagcacccggatagtttttgacgggttttgttagttcattttcttttaaactgtatcctctccagttcttttgaggcttgctctctttgtttatcaatgtatgcagcaagatcattcacatgaacgattctcggtgacttctggctgtcgtttaacttatatgtagggatacccagctttccttcgtttgccttgcgttcggctgttccgggactcatcttgaaatatctttccgctatatctgacagcggaatttgtgaagtctcaaactctgccattaacaaaaaggctgtattcatcttcactattcccctcctttctgatagccgttctccagaattattttagccactcccgcaggtgtcaccttatcactccatgtcgcatcaaatatgatgtcgttcagttcccaactaagaatgtcgtccaaattttttggtcttaagttgtagggcactatgtcgggcactccttccataatgtctatagtgagtgcggcaatttccttttctccccgttctggcttacggtatcctgcctgccagattgcatcggtgatatcagaaggatcgccccagaccgaggcgatgatttgagtcaggtggaatgagttattgatcatgactcttctccgctgttttcatcatcaaagatagccatttgtcccgcctctttcagtgcactaatcatcttatggcgcttacctttggtctttttgcgagcgttcatgatttggctgcacacagaaagcaactcagcttcgttcttctcatcttttgctagctggtggcgtaattcatcaaatcgtccaaccatgtgatcgagagacggcagggcattaatgccgatacctgaatttcccgatttgaaatcgataaatgcctggttcacatcaagctggaaatccggtcgaatccatcccgcgtaagaaaccgctatcaactcatgggcgtaagtgcccggcgatgtgccgccgtgagcagaatcgactgctttttgagcaagcgccaaatctggcgtttgaatacttttcagtaacttagcctccaattctgcaataagctcttttgcgtacttggttctcagccatctgtttggtgctttttcttcaccctctccactggccttatgtaatgtgttcaggttgtagcgcccgaattcatcaaggggaatttcaacaccaacaaccacaggaagtaatttgcctttcattattctttacctcgcttattacccgctttcttcaccggtgttaatttcacttctgccacttttggcgctggtggcaagggagggcaatcgccctcatgaatgtaaaagttctgtctgaggcggtggataatctgatccgtatgatccctgccgtcgtcgatgtggaacgtggccttaacaagcacatcgttaatgtctgccatctggcactgcttatctgtcactgtccgcctccttgcaaaggattttgtaagcgcgcatcatgtgattggatttgcctgtgataaccgttcttctgaaaaacacactggaagaagaagcccgaacaggtgtggctaacagggcagcatcaacacaacggttgtgttttcggcgttctgtaatgaaactggaaatgactatttgcgctgtgctgcccttgtcctgatattcgattttcatagcttcaactctcttaccctttgctcggcagcttcgaaagcgtctttataaagtggcagaacgataaaaacagggttgccgtaaagcttgtttgtgaaagcgccaaaccggaatcgacaagcggcttccatgcccgagggttccatgagtaccgcgcccctaccaaacatcaaatatgggtaggccagatacttagcaccaaagtacgggatcacattctgtttctcggtcgggatggctttgtctaaatcagggaagcgtccattaattatctccagacgagtaaggctaaaggccacttcatcttcccccaaatgaaaggcttttggttcgtcccctaactggatgtcggtaaagcaagcctgttctggaatgtcgccacagaaccggataatcagatcgacgtcagtatcatcatcaaagttaatgacgttctctgtgagttccatgcgtaccaatgcatgaccgttagttgcctcaagatgttttcgggtaatgtgcacccccgataactgggggcgtttttccgcatcttcgcctttggccacacagaccaaagcggcgcgcaacaaatcagaagcaatgatcatgatttcacctccgcgtttgggcacagatctatgccagcaatggtattttcattgaattcttccggcataacagagaagagggtatggttggttgatatcaggcgatcatcggtaaataccgcctgtgatttttcgatagcgtccaatgcatcatgagcctccgtataaattcgcagcgtgtggcgatgtccgcaggggtaatcacctaaataggtcacaatgtgttttgtctgttccattttcatcacctcacttcttgccaaacaattttttgagatcaataccgtatacagccagccatgattcggcaggccatgacttaacatgtccgtatcgggtgtcgggaaccttcacaacttcgatgtcgttttcacggcaccatttacggagtggggcatactggtattttttttctgtggcgttctgtaccgctgtaatcgttgcgtgcttggtgctttcgcccagacgttcttccagttctctgcatttgcgggtggcagcaccgagtttgccgagagcctgagcctcacgactgcgactgatctgtgatttggtgcggcgagcttcatcacgttcttgagtaatgacgaccttttctttttcagttgtcagcaatgcttccagagctgcaatgtaatcaccgggcaaggcagggggattggttgctggcttttgttggtgaaagtaagctgactccattttttcaaagaaagaccatgcttcatcggtatcaacgattttcgacatacgggcagcgcctttttcagtccatagaatctgctgacttgtatgtttactaaccaacccgatgttatcgggtaccttcttaaactgacgtaattcatccccttcaagcttgaaataatggacgccatcaataaaccgtgacttgttgttcaagagattgtcttgaatgttttttgtactagcaccatacccagccgctaatgtttcagtggtgacaacacgaacgccttgccattcgatcactggcagcttgtttgaatctatagtgactaattcgtttttcttgctcatgttctgtctcttaatgttcagttaatgatgccggttcagcgacgaataacttgatgccgttgataaatacgccatcgataaaatcacgcatccatgtggagttattttctttctcgctcttctcgatgttgaaatagaaactccacaaagcgatatatctctcatcgggtctgaaccccagaatcgttttttcgatttggtgaataagcagcgtttcaataacttcggcatctaattcaacgccgccgttttcgtgaataaatataaagttcccattggtgtttaaaccgaaccgttcgtagcatgaaactaaatattccttagcaataagggttctttgtcttttcaccatgtactctgcgcattccattttttccgcatcagttaatggcgggtagttggttatcgctctttcttcatctaaaagacaagctgggcaacctttgttattttcttttaaatattcgataacttcttttggtgtcatttctgcattgctcatcacaacccctccctaatagttatttttgcttctcgaacacatcgtaaattattcttgatacattcctgttcttgctttttattacgggataatgaaagtgcctcaccccatttatcagcagcacgacggaataagccttttagttctaaactctgcgctgattctgttgcctgttcatattcagtcattattcgccgcctgtttattcatgtacctgcttaatactgtgatgtgactgtgatgtaatagatgtctttcttcgttattttcttgattatattgagcccatagtcgatgcttaagatcagcggctaaatatttagctcttttccaatatgtggcggcaaggtcatacttttcttctttctctttctggatggctgtttcagcaaaatctaaataagtttcatttttcatttcatcagttccattttttgtgcaatgatttttagaagctctttcataaactcattaccctctgcggttagatctccgttcttggtataaaagctgtcatatgaatttacgagagcgtcctctgctataagtttgccttttaaacttaaaattacgtttttctcaaagagactaattaacgctatatttaatacatcttcgtctaaatccagtcggtaattaatttctgccactttgactattacagagtgagaactgtgcttcttttgtaatgtgtccaatttggcatgtataaatgcctttcgctttctttcaagcaacgttaattgtgtcattttatatttcctgaatttagcgtaaacgaatccccagcaatggcgctgtaattaaaacttgtttattgttttattatttttaatttttgtatttattttctgcgttttctaaatcatccaagactgttaggagtttctcttttgctttcttgcattcctttttaagtcgagcaatttctcttacctgtctaacatcagctttcagttcttccaatacctgagcatgtcgttccataaactcagggcgcatttcaccttgacgtaatgcagaagtaccgtcttcctgaatgacctcttgggcagggaagttacttggcctgtcttctgcattaaactgctcttgcgcccgaacataagccagtttattcagtgcacctttctcactcagataagccttgctagcaccgcaaacgacatagacttcacgcgtttcaatttggatatcttggttggttgcagtttcaatgggtttaagtattttcatggtaattccttattaattgaattaatttttatttactaaatttctttctctttcttatttcatcggttgcattgacgtgattttcatgctcagcttcgataataagagtcaatacagaaaacaatcgggataatctatcaaggtcagtcattgcatcatcttgggaatattcttcactattaacagccgcgttagctaaattagcaatagatttcattccacttgttatcgaataaatgacatcttcgcttgatgatgctaataactgtaaatcgctatcactcatcttttctaatcgttcattattgacacgggtatgatagaagatattattcatgagtattccactcctcgtactcgtgctatttctttacctatatgaaagatcgcaaccaatgcaatactaagtaattctgcaccggatagacttttatccgtatcaactaataaagaaatatatgttcttaggttttctatttcactcgcaacgccttccaattcatcgaatgcctgattacctgacatgatatattctttatttatatcccttaaccgttgggctaaatcacaagtttgacgatgtacaccacgacacattaaataagtatccggttcggcttcattttgaattgcagtcactacgggaaatattgaggcttcaatttcttctgcaatctcgacggctgcttgtagtttattgttcatcattgacctcggttgatttaattaagttatcaatgattttatttgtggtatctatggccatttcaattaaatgtactgtatctttatttttttctgatgctgaccaggtaaataaataagtttgtaaccgttctgcaagttttaatgagttttgagttgttaatgtttctgtgtgggttggcctatttatcatttttaattccttgttgatgtcctgagtgaaacttattgagatactttcaaataactttactggctctgactttatctaaaagataaaattttgtaaatagcaaattgataaaaaatttagcaatttgtttgtgtcatttgataaattattgatatatattgataaatttatttatcttttatgttttttaggcgtaaaaaaaccagctcgaaagctggttctgccgatctaactttttatttttgattaccccaagcgtgcataatccatcctccatttaccaacaacaaatccatgtatgtggaattttgattcattttcagaatcaatctcccatctgtcataaatttgattatcactaataacaactatcctgtctttcaaaagttggagtcgtttaatgtgcatcccatccccgtatgtaaatgcataaataccatcactcataaaacgactaaccgttatatctaagacgaccaattcaccgggattaatcgttcccagcatactgtcacctagagcagttgttagctttaatgatgttgatggtctacaaccaaacatccgttttgcatattcaggatcaacctcaattgagcgaactatatcgggataatcgctattcaatctaccacctccgcaactaaattccacatcgagctgttcaatcctgtatgaaagatcagtaactttatgtgaaatgttttgcaagtgatagttttcattgtttctttctttgtgactattatcacggttatcaatgagttgctgagggatatctaaccaaccaattggtagttctaaattcacctctatgcgcctagcaataatgtctcctatgtttcttaccgcgttatcgctcgttagctgactgagctgactgggtgggatccctatcaactctgcgaatgctgtttttgatgtcccttgacgcacatgttgtgtcatcagggtgcgcaaattattgcgtcttatgtctttagtttccatatcacgataatcacattaattagcaatttgataaatatgcatgatgataaaaaatcttgcaagtttttatcaaaaagataaagtatggtcttgaggttaacttaaaaggtaaaaaaaatgaaaaatgatctacatcgctggaaaaaggaagcggataaagatgattggaacaatctcgctcaagttgttgggacaagcgtcggttatctaaatttgattgcgggtggatttcgtagagcctcgccgagcatggctagccgtattgaggatggaactaagaaattcaatagattaagcccagtgaaaaaagaaaatttaatttttatggattcaccaaagaaaaatgtttcctgatttcaccaaggtcaccatgccatcgcatttctaccctgacgatggcacatggatacaagaaacactggcgaagctgagagccagcacccgagcaaagatcaccgcgaagtactcagaagtgtatcaagcagcatgggatgaggagtcagtgtcataccggaaggacaacgcagcacgacgggcagcaaatatcaggctcagagagtttgtcactaagtatgagagagccgctcaaggttacacagcacagccgttaacagtaaatcaataatcaaaaagttaaggggatgagatgtttagatgtttagatggctatatctgctttctggggaagaggggaaaactttctaggggggggttggggggggtgatctttgaaaggggtgttagggaaggcacagccaagaggaagaactcagatcttaatgtagatcactgtaggggttacaaaatgggacaggtggctagacgtctaaacgagaataagaaaagggcttgtcctctggcagtggaaattattcaagtgagggtatcaatgttgactgagaaggaaagtgtaagagggtgcaagaaaccgaacagagaaactttggcgagtagaactgattcggatcttgcagtcggcaacggagagttacctgtgcaaaagtattgcacggttactataaaaaataaacagggggtgacgtcatgctagaaatcacccctaacttcgcacaggaaagagggttaaatcttttaagggctgactggaaaaagtacagcagctttcttgtgtatgctcccacaggagcagggaaaaccgccctgtcagcattcattgttgacggttttgtctcaaaaaacaaaaaagtcatgatgatctgcccgttcaccgtcctgatcaaccagactgcccagcgctttattgagtatggcttgccggagaatgaaatcgcctatatctggcgtgaccaccccaatcaagacccgtcaaagctgattcagattgcgtcggctgacacgctgatccgccgtgactttcccgaagacattaacttgctggtgattgatgaagcgcacctgaaacgcaaaaagatactgacagagattacgcggttgacctctgaaacagattgtaaggtggtgggattatccggcacacctttctcgccgttcctcggtcactattatcagaagctgataaagcccaccacgataaaagagttaatccagcgtggcgacctgagtccttacgagttttacgcccccaccaagcccgatttaagcaaggtgaagtctgcccgcagtgacgactacggcagcgattacaaggaagacgagatagccgaaatcatgtgcggggctgatctggtcggggatgtggtcagtagctggctcaagctgggcgaaaatcagcctactatctgcttctgtgtcaatgtcagccacgccaactttatcacggtcgaattcaatcgcgctggagtgaatgctgagatcatgaccgccaacacgccccatgatgaacgggatttgatcatccatcggtttgagcagggtgcaacgaaaatcatcgtcaatatcggcgttctcgtggcaggttttgacagtgatgtccgctgcattatctacgcccgtcccaccaagtcggaaatccgttggttgcagtcaatcggcagaggcctgcgtactgccaggggtaaagaccgatgcatcattctggatcactccggctctgtccaccgtctcggctaccccgatgatatcgaatacgacgaactgcccagcaagaatgacggcatgaaatccagttccagctaccgggagcaggaaaagcgggagaagttaccgaaagaatgctcctcctgtcattacatgaagccagcaggggtctatgtctgccccaagtgtggctttaagccattggtgggtgaaaacattgatgtcgataccagtcgcaccatccagaaactcagcaagaaagagcgtatctacacacaggccgaaaagcaaagtttctactcgcagttgaagtattaccagaaccagcgcgcctcacagggtaagaccatcagtgacggttgggtatccaacacctttaaagacaagttcgacgtttggcctcgcggtctccatgacaccccacaagagatgacccccgaagtcagtaatttcatcaagcacaaacaaattgccttcgcgaagtcccgcaagaaagcggaacaggtgcaaccatccagcaacgagcagcaggaaatgcgtcttgaggttgcccgtcagaaggtcagtgatatccgtgaaaaattaggcagatcatcacatcagggagacaggctgtgaacagaataaatacgaccgatgccgttattggccactggcctaaagttttcgaatactacggtttaccgcccgtgacaggcaagaagcactttaaaggaaagtgtccgatatgtaagcagataggcaagtttcgcattgatgatcgtgacggacgcggaacattcatctgtacctgcaatgccggggacggctgggcactgctcaggttgacgcagaaaaaagaatttaaggtgctggcggatgagattgatcagctattgggtatccagcgcgataaggtcacacccaaacctaaagcaagcacggttgcagataaccgccaaaagataatcaccctttactcacgcatgccggaactgaaaggcacctcagcggaaaaataccttcaaagccgggagatttacagccatcacccccttgagcaaatccgcttctgtgaaaagcagccgacctgccaagggaattatcaggcgatgtgggcattggcgacagactcacgcggtcaattgtgttacctgcaccgaacctatctggacggggatcggaaagcgcctttagatgtgaccaagaagatgatgtctttacaggaagacaactatctcaaatatgctgaatcggtggccattcggatgttccctgtggcttccacgctgggcatcgctgagggcatcgagacggcactgtcctgtaagcaggtttatggggtgaatacgtggtcaacgatgaatgccggacacatggagaagtttctcactccccggggcgttaagcatttaatcatcttcactgacatggactggagcgccacaggtcatgccgctgcgatgaaatgcgcgcacaagaatttactggcgaataacgacttagacaaggtcagtgtccggtggcctgattttggggattttaacgacctgctccagaacggggatcaggccagagaattgacatttatgaaaaagcagcgggagacagcataatgatggacaacacagcacacaaaacccttttcactatccctgagcctcgttacagcacggcgctggcgaccgtaaaaccattacctgttcagcggaagatcaccggcaataaacaggtggatgcttacctgtgggtactggaggttatcaagaccaatgaacccgcccaccttgaggccgccgaggaaggcttgaagaagctgaaaatcacccccaaggcagcccagcagaaatattctgactacctgatgaaatcgggtgcacatccttttcagatagcctttggcaccctgagtatggataacccgcaaggttatataaacagcgcgaaggagcaaatcaaaaaggccagtcaggtgagggctgcttttgctagctatgaagccacactggaactgaccgaaccggagaaattaatgctggtgggggagctggcagacatttatgaacctttctactactggaatgaaacagaacgggcggaagggtgtatgcacggtgatcgcatttgtgaaacggataaattgcgtcaggcgacggcgaaagggtttgctgaacaactccccgaaccgcacaccttgtctgatgttgttcgtgagttcctttattgggactggttatatcagatgcgtaatgtcgcggccgaagaacttaatccgggcggatacggtgatagtgataggtatcacatctatgacagacaagattatcttgaagggaagctggtcactatccaagccgtaaaccgtcaggaggctatcgacgtttgtaagtgggtgctggaagaagaacggttccatgatcgtaagttgacggacaggattattcttaatctggtgggggagacagcataataatgaaactcgaatcagcattaaaacactttcacccgaaaacaccgacgttcagtgatgcgtcaaccagtaccgcaccggacagaatgaaagggatggataccgcagcggctttggggatggcgggatcacaagccaagttcggcatggcggcgttttttgccaagaacgaggtcagtgaagaagacaagttcagtacggtagaagaactgacccgatacgcaaggcgaactgttcctaagctgatatccaaagcagcagggaataaactggggccctgtctggttatcttatcgaagatggcgtttgaagattatgcccgttcagcggcgtctacttgtcagtgttcggaatgtcgcgggaaagggcttatctacggcataaaagaagttgaaaaacatcccggcattattcgtgcggacggtgaagtgattatggcgccgtggattgaaaaagagcaagtgggtgaactttgccagaagtgcaatggtaagggtacgctgtcaagtcgttgtcgctgcaaggggcgcggtgtcgtagtcgatgaggaaaagaccgccttgcagggcgtaccggttgataagatttgcccccgatgctcaggtcggggttacagcagagtgccatcatcagtggcttatacggcaatcaaggcctatttacccgagcttaacgaaagaacatggcggcggaactggaaacccttttatagggtgctggtggataagtgctattcggaagagaagcgtgccgaagctgcattcaatgaggtgacaaaataaaccgttgctttttgtccggcattggcttaatatctccaaatagtgggaacttgtaactatactcactccgaattctaagcctcgcccagtgcggggctttttcacatctggaactttggcgtagagggttcgcgcggatgcctgaagagcatcaggactcggttcgattccgagaggttccaccaaattatcgaaggtcacttaggtggccttttttgttacctacgcaatgaggaaattaaccatgtacgcattaaagctaatcacagaaagaaacggtcgttcagtagaagagtcatggatcttgggagacatgtaccgtctggagtttttcccgaaagatgtcgctgataatgttattgcccgtgtcgagcatagccagaacggcaatctgattaatcacgacatcaaaaaaacagaccaagcctacattaccactctgacgggtgacactgttcgcacggtctgtcgaggccgaagtggacttgtagctggccccatacagtaaccaatacagagcgtctatctctgggcgctcgatattgcttattacctaatttgccgccgcaatcacttcccgtacctccgtatctcctattgcggtcggcatacttggtttgtaagcctgatgctacaaatggcaatagttaaaatgagttcttaatccatttacagtagtgttgagtccacaaccacgcattagaggtgcataaatgaaagtatcaatagaacttaatggcgaaacggtctggtatcgtgatgaagaaaaaggtgagggaatggcttcaactggatacataaaggacggtacacagcaaaaaatcattaccgcccttgaagctgcgttatttcaggctaaagctgaatatttatgcgtttagtacactgatagtgtgcttaatattggcactatatccaggcggcatagctaaaacaacattccaataaccagagtgagggggaataatattggcaggaaattgtttataaaaacccccataatagcgatattgtcgtccattcctgtagttactgtattggttgtcatccataaccaatacgtttatctgatggctacactggacagacacgacattgccatcttttagatactctcggctgtgaatgtaagacatttcaccttcctttaggtaagaggtcatcagccatccctccagttgattaatctttggctgatctaacaacataccttaagtatcaacttattacttttaactaactcacaggggcgaccatagctcaccccacggacgcccattgttcaaatggggtggaatatgaagatgaaagagaatcctgatgtatgggtacacctcggagagtggctcatatcggtaagagagcaaggcatctgggcaactcttgccggaacgatggcattttttcgcggtcgctataacggtggcggctgggtaaaggtttcaatcgacgcctttatgtgtgccatgttcgcgtggttcattcgtgacgtattaaatttcatgggtctgaatcctgacctggcctacatcggcagtgtggtgattggctacttggggacagactttattggtcaattgctgcgtaagtcggcagagaaaagagcgggggtcagcaatgacaacgaataacttcaagttaagccaacgcagtgaaaataaccttaagggcattcatcctgacttggtggcagttgttcgtcgtgcgctggcattatctccggtcgatttcaccgtgattgaaggcctcagaacgcttgagcgccaaacgcaactggttgctgaaaagaaaagccggacaatgaactcccgccatttgaccggccatgcggtcgacctgcttccggtgggggctgactggaatgattatacctgttggcttccggtattgaatgcgatgcgtcaggcgggtgaagaacgggggatcaaactgcggtttggcattacttggacgaacaatcccaatgataagccggctaaatttctggatgcgccccatattgagatactggcatgaaatttaacagccagcacttcaccctcggcgctctggtggttgtctccggtctgctctggttcttttacagtgagtatcagcaaaaggctcaagattatagcgagctggacacgaagtataagcatcaacaagtcatgaccgccaatacctttcagactgtcaggatattcaatgatatctcacgaattaatagcgaaagccggagccggtcagccgtggattctgagcagactaaagcggccatcaaagcggttgttgtcagtcatgattgtgccaatcgccttgtgcctgatggggctgttatccggttgcagcagcatacaaaccgaatacgttccggtgccaccgatacccattccggcacatctgctcgctgactgtctgcctccggccatatccgacaaaatgacatggagtgacagtctgctgctgaatgagcagttactgacggtcattgagcagtgcaatctggataaacaggcgatacgggaaatagaagagagcaagccaccccagagcaaatgattctggggtggcaggagtgtattggggcatagtgtcggtgagactctgagtaatcagatttgttatccttatacctgttcaatggaaatcaatatgggggattcgcagcccacaattgttttattgcgggtaaaacgtttttttcataatcgggtaagctctgaacctttgagtaacgtgtctgtgtatatttaactccgctagttgcgagagtgggagtaaatccaagcaggaatagatatttttctacatttggtaaattaatataaggttcataagtcaagtcgagaaacctcgctttaatggttaaaactccggtactatctgcacttaagaatctgcatacaattaagtactctaaatatacgtcaagaatatcagcaccgagaaaatgagtctgtgaatgcgtagtgcccacttgggcatggaaagctcgtctgcttctcacaaggggataactggttctaaatggatctcgtgggtttatcggcataaccacctccaacaaaaacaacataattaattacagcaattcctaaacccatcttcacgcaacaacaagcgaataataattaacaattagttactctctgaaactaaagccaatattcctttacccattcccttgagtggttaaaggaataccccatgccatcagttaacgctggtggcttttttgtatctgcatttcactgcgtcgggttatcgccgtctgcctgtattagccatgacatgttccctttgcatcgagcgtacaggtcagaatcaaaaataatcaatgccccagacagtcattatcagcaacatccgctgtaggcagaagaagcggtgtgacagccggagagacggcctgtattgccatcatgattcattgagtcgtgatcgctatgtagaaaagcaaagtccgataatcggatattggattaaccacacatatagaggtcactatgacagaactgaactatgaagcgattgggcgttgtaaggtgttaagagaaaagatagaggctttacacacgcgaaggcaccaatgtgtttataaactgagagatgaaacttcaaggctgacatttagtgatggctaccggatacctgaaattgccgagtttgacagggatctcatgcaaagtcagatgaaggatattgcccttgtggacagtgacctgatgcacgcagtacacgaatttaatatctggtgtcaggaggcaggagaaccatcaataaaactaaatccttcaactaagaaagatttggagaaattaaaaccattgccatttgatgggtttcccggctctgcgttattaagacgatgatgtggaactgctacataaaggtgcagagtaggttatcaataaggccatcagttaacagggtggcattttctttttggagaacagaacatgacacaaagtacaggcacggcaacatatgacatcactgttggtatcaaatatgacactgacacactgaaccagcttgagacacaactaaagcgtatcgctgaacaagtggatcgcattaatggtcgtcgctatgacgcagatatgaaactgtcagtagatacaggtgctaaggctggaattgctgccgatagcttcaaggtcttcgatgtagccggaaaggtttacatgaaagaggcggtcataccccaagcggtaataaaggataacgacgatcacctccgtcagataatccgtgaagagatacgccagttcgtcacccgtgagagtgaacgaggcggattgttctccaaatggtgatgtgatgccgccaagaataccgagagcctgccgcaagcagggttgccccaagaccaccactgaccgaagtggctactgcaacgatcaccttcacaccggctgggagaaccaccagcaaggcaagagccgacatgaacgcggctatggcagcaagtgggacaagctcagagccaccatcaaggccagagataaacacttatgccaacagtgcttacgcaatggacgggcagtgacaggtgtgactgttgaccacatcaagcccaaggcacacggtggcacggatgcgttaacaaatctggttctattatgctggtcttgccatagggcgaagaccgcgacggagcgattacgatgagtgagaaacaagtgaaactgtcacgcctgtataagggtggtcacttcaagggttatgccctgagtgtggatggcatgttgctgtcgaaccagcagcaggtcgtgattgaaactaactctgagggtgttcaccccacactgaacgtaaccttcacggtaactgatgagatggcgggtgagggggtcgacatttatatttgatctcatcattgcatcatatcaagtgcaatggtcatggtgactgctaccctgagatgattttaattccgtcagtaacaatatcatcagtcatggtcacgcaaggggaggggcgggtcaaatccctgccactctcgccccaagggaccgccgccttacctcttttcacatcgccgcgaaatgcaaacctttttttggggtgccccaactgcgccattttacaggagaaatcacatggcaggacgaccgccaaccccgacccacctgcgtctggtgagggggaacccatcaaaacggccgattaacgccaatgaaccgatgccgggaaaaggggtaccccatgtccccaaacatttcgggaaaatgggcaggtactggcacgagcggatcgccggggaactggataaagtcggcgtgctgaccagccttgatgccaaagcccttgaattgctgattgaagcctacgtcgaatacagaacgcactgtgaaacactggagacagaaggctacacataccgaaccgatcagggattaattaaagctcaccctgcggcaggcatgaaagccgatgcgtggaaacgtattcacgccatgctgagtgcgttcggcatgtcgccctccagtcgatccaaggtcaacatcaccggagaagacaaagccgatcccctgactgagtttttacaaatgagggactgatcatggcaaaagtggctgaaggtattcgctacgcggaacgcgttgtggcgggtgagattgtgtccggcgagctggtgacactggcttgtcagcgttttctggatgatctggcgcacggtgaagaacgggggatcagctttagcgaaccccgcgcccagcatatcctgaacttttataaatttgtcccccatgtcaagggggcactggcaggccagcccattgaactgatggactggcatgtttttattctgattaatatcttcggttttgtccgtccgctgattgatgaacagaccggcgaaattgtcctgcgcaatgatggcagtggccgcccggtgatggtgcgccgttatcgtaccgcctataacgaagtcgcccgtaaaaatgccaaatcgaccttatcctcgggcatcgggttgtacatgaccggggcggacagcgagggcggggcggaagtctattcggcggccacgacccgtgatcaggcgcggattgtatttgaggacgcgaagaacatgatcaaacaggccagacccacactcgggcggctgtttgcgttcaataagctggcgatttatcaggagcagtcggcgtccaagtttgagccactgtccagtgacgccaacaaccttgacggcctcaatatccattgcggcattgtcgatgagctgcatgcccacaagacccgcgatgtgtgggacgtactggaaaccgccaccggtgcccggctgcaatcattgctgttcggcatcaccacggcaggcttcaacaaggaaggcatctgttacgagctgcgtgactacgccgtcaaggtgctgcgcggtcaggtggatgatgacaccttcttcggcattatctacaccctcgacaaagaggacgatccctttgatgaaacggtctggcaaaaggccaatccggggctggggatctgcaagcgctgggatgacctgcggcggctggcgaaaaaagccagagagcaggtgtctgcccggcataacttcttcaccaaacacatgaacctgtgggtcaccgccgaatcggcgtggatggacatgctcaaatgggacgacagcgaaccgcttgccccgccgcatgagctgaaaacttacccgatgtgggtcggggtggatttggcgaacaagatagatatctgtgccgccgtcaaggtctggcagggtaataacgggcatgtgcatgccgactttaaattctggctgccggaagaccggattgaacgctgctcccgccagatggccgaactctaccgtaagtggggagagatgggcgccctgaccctgacggacggtgaagtcgtcgatcacacccagataaaggaagaattgcagcactgggtcgccggggagaacctgaaagaaatcggctttgacccgtggagtgccacccagttcagccgggcactggccgaagaagggttgccgctgattgaggtctcccagacagtccgcaatttgtcggaagccatgaaatcgctggaagcgctggtctacagtggccagttccaccataacggtcacccggtcatgaactggatgatgagcaacgtcaccgccaaacctgacaagaacgacaacattttcccgaacaaatccacaccggaagccaagatagacggccccgttgccctgtttaccgccataagccgcttgctggtgaacgggggcgagcaaccggaaagcctgtccgatgtactgatggcccggggtttacgcgccctctgaggtactttcatgaaaatattaatctttgttgccctgctggttggactggcaggcggcggcctgttgtcttacggggcgtggctgctgctgccggcggcgggatttatggtcgccggcgtattgtgtctgggctggtcttatctggtctcccgcatgttgggtcataaacccggtaagggggcctgatgttctttcccggactgtttcgaaaatccgccgacccgatgacctcacgggaactcagtgaactgatcggcctgtcgtatgacacctacaccggacggcgggtcagcccccggatggccatgcagcttaccgccgtttttagctgcgtgcgggtactggcggaatcggtcggcatgctgccctgttcgctgtatgaacaactggcgcgggggaacaaacgggcgacccgcgaacggctgaacaccctgctgtcggtaaaacccaacaactacatgacgccccaggaattctgggagctgctgattgcctgtctgtgtctgcgcggcaacttctacgcctacaaagtcaaggcgctcggcgaagtggtggaactcctgccccttgagccgggcagcgttgtacccaaactgaacagtgactggttgccggaatatcaggtcaccttcccgaacggggatagccggacactgacccaggatgagatctggcatgtgcgtatcttcacactggatggcctgatcggattaagcccgattgcctatgcgcggcaggcgattggactcgggctggccaccgaagagcacggctcccggctgttcggtaacggtgccgtgaccagtggcgtactgcaaacggatcagtcattgaccgatgacgcctttgaccgcctgaaagcggattttgaatcccgccatcagggactggtcaacgcccataaaccaatgatccttgagatggggctgcaatggaaacagattagcctgtccgccgaagacgcccagtttctggaaacccgcaaatttcagcttgaggagatttgccgcatcttccgtgttcccctgcatatggtgcagaacaccgaccgggcgacctttaataacattgaaaatctggggatcggtttcattaattattcactggtgccatacctgacccgtatcgagcagcggattaatgccggactggtgaaagggactaagcaagggcagttttatgccaagttcaacaccggggcgctgctgcgcggggacatgaaatcccgctttgaggcgtacacccggggcattaactgggggatttactcgccgaacgaatgccgggaactggaagaactgaacccgcgtgaaggcggggatatctacctgaccccgatgaacatgaccactgatcccgattcaccccccaaacccaagacggagactgaatcccatgccgatgatgaccaaaaaacggcttgatgtccccctgaaaatcaaatcggtcagcgactccggcgagttcgaaggctacggttcggtgttcggggtgaaagacagttatgacgatattgtgttacccggtgcctttgaaaactcgctgaagcagtggggcgaaaaaggcggcttacccgcgttgctctggcagcaccggatggacgaacccatcggtatctataccgagatgaaagaagatgaggtcgggctgtacctgaaagggcggttgctgattgacgacgatccgctggcgaaacgggcgcatgcccacctgaaagcggggtcactgtccggcctgtcgattggctacctcctgaaagaatgggaatacgaccggacgaaagaggcctttttactgaaagaactcgatttatgggaagtgagtctggtgacctttccggccaatgacgaagcccgggtcagtgaggtgaaatcggcctttgcccggggtgacattcccgccccaaaaagtattgaacgggtcctgcgcgacgtcggactctcccgctcccaggccaaggcatttatggctgaggggtacggcgcgttgtctctgcgtgacgctgaaacggacgtgtccattttgaatgcattaaaaacccttacttttgaataatcacggagtccactatggcagttgaattgaaagacgttgaacagatcgcgcaggaaatcaaggggcgctttgacgagttcaaagagaagaatgataaacgctttgacgcgattgaggccgaaaaaggcaaactggcggggcaggttgacaccctgaacggcaagctgtctgaactggatagcctgaaaaccgcactggaagaagaactggcgggactgaaacgcccggcaggcggcagcaataacaaggccgcgtctgagcacaaaaccgcctttacccagtttatccgcaagggtaaggatgacgggctggccgaactggagcagaaagccatgcagaccgtcagtgatcccgagggcggttatgccgttcccgaagagctggatcgtaatatcatcagcgccctgaaagatgaagtggtgatgcgggcagaatgcagcgtggtgtccgtcggtaatcccaactttaagcggctggtcaatcagggtggcaccaacagtggctgggtcggcgaaaccgatgaacgcccggaaacgaaaacaccgaagctgacgcccatcgaaccgacctggggtgagatttacggtaatcccgccgccacccagaccatgctggacgatgccttctttgatgtggaggccttcatcacggcggagctggcacaggaatttgccgagcaggaagaagacgcctttacccacggcgacggggtcaagaagccgaagggattactggcctacggcagtgacgcgcagaccgacaaagagcgcaagtggggcaccttgcagcacctgctgctgaaaaagccgaccgaagtgacggcggacgaaatcatgcagctgatctacaccctacgcaagccgtaccgcaacggggcaaagttcatgatgaacaacaagatgctgttcaccgtgcgcaccctgaaagacagtcagggcaattatctgtggcaaccgggtctgcaactggggcaaccctctgcgttgctgggctacggcattgcggaaaatgagcagtttgccgatgtgggcgcggacgccgtgccggtggcgttcggtaacttcaagcgttgctacaccattctggatcgcatgggcgtacgcatattgcgtgacccgtacacccacaagccgttcatccacttttacaccaccaagcgcgtggggtctttgctggtggacagcaacgcggtgaaactgctgaaagcgggtggcggtaaatcataatcaatccaatggcggccaccgtgccgcctttttaccgggggaaccatgcccttacccaccattgaagaactgcggttgcagtgcaagatagatgagacgcaggacgatgacctgttactgaattatcttgccagtgccagagagaaggccgagaactacctgaaccgtaaactctatgaagacagggtgccggacgatgatcttgacggcattctgatcaccccgttaattaagctggccttaatgctggcagtggggttctggtatgaacaccgtgaacctaatgtattagccagtggatttaaagagctgcttaacgactaccggatcagacccatgagggggaaataatgaatatcggccgattgcgccaccgcatcacgattcagggtatccgcacccgacagacgtcttcgggcggcgttgtcaacgaacgctacaccgtggcaacggtgtgggcggaggcgaaatttatcagcggccgcgaggtggtggcggccaaggcagtgttatctgaaagtgttgtccggttctgggtgcgttaccgcgctgatatcgacaccaccatggctatcattttccggggcaaaacttacgccattcaggcagtgatgccggacaataaattaaccctgttggaattactctgtcaggagggcgtaaaacaatgaccaccgtggatctttcagcactcaaagacctgtcgcgggatttggagctgctcagcaaggctgagaacgacaaagtactacgtaaaggcatgtatgccggggcgaaagtgctgcgcgatgagacccgcagccgtgcccccaaacgcaccggtaaactcaaaaagaacattatggcggttaaccgcaaaaaacagcgggacggctccatctcttcgggcgtttatgtgcggggatcgaatcaatccggcaccaacagcgaccccaaaatgaagaaaaacgacccccgcaacgcctactactggcgctttctggaaaaaggcacctcaaggatggccccgaagccgttcattgatccggcctttgaatccaaatcagatgccgccgccgacgcggtatttaatgcggcgttgaaagccattgatgaggtactggcaaaatgacagacggcgatttgtttacattgttagttccggtactgcccggccgggtgtttccctatttaatcccgcaaaccgaaagaaaaaccgcggcgccgtggtgcgtattttccacctacagtatctacaccgatgtactgagcggccagtcggtcaaaatgacgcgggttcagattgatgcctacgcgcccgggctggacgacgccgaccggatttgtggcgacgccttcagtgccatcaaaacattgcaaccttttgaagtagaacgtgagaacagttacgaaaatgacacggggctgtatcgcgcgaccgtcgaatttaaaatctattcctaatcccggagataatatggctaagtatgaaaaaacactggcgacctcgctgtcggtttctgctgaggcagccaatgacgcaaccagcaccctgataaaatgggtggcaattgacacttccgtcaaagaaatcaactacaccggcggtcaaaaaagtgacattgaggtcactacgctcggttcccgtgaacaggagatgattaacggactggcggccccggctgaaattaccctctccgggcactggacggccgacgaggaagggcaggacattttgcgcctcgcctacagcaccgaccaagcctatgccttccgtgtccagttccccagcggcaatggctataccttcttggctgaggtcaggcaggaatcatggcaggctgccgccaatggcatcgtcagcgcctccttcaccttgcgcatgaaaggccgcccgacaccgctggcgaaaaaactgcaaaccaacacacaggaaggacaataatcatgaatattcgtcaactggcattaaccccgaaactgggctttcgcaccaaaacggtaaccgtgactgagtgggataacgccaccgtcaccctgcgtgaaccgtcagctggggcatggatccgctggaatgaagtgacctcgccaacagacaaagaaggaacactctccacggcagaaaaggtgctgcgcaatacccgtgccgatgtcgtgctgtttatcgatgtgctgtgcgatgaacacggtgaaccggtctttactccggacgatatggaggccgtgatggatatctacgcccccgtgcattcccgcctgttacatcaggcactcagtctggtgaccaccggtgatgaagccgaaaaaaagtccgatctccattaaccggctttatgctgacgctggccctgcgcctcggtaaaaccctgtccgaattgcagggcgggttaagtgccagcgaactgatgctgtggctggcctacgaccgtgaaaaccccctcagcgaccgtcggggtgacattcaggccgcgcaaattgcctccgcggtttatcagtcacagggtgtcaaagtcgggctgagcgaggcgctgctgcaatggggtaatcccgatgaggaaagcggcgacgacttcgaaaacttctttgctaatctcacataggtgacactgtggcaaaactgcgtgaactgattatcaaaatctcggccaattccagctcgtatcaggcggaaattgcccgggctgcccggctgggagaaaattaccaccgggtgatggaaaatggcaaccggggtgcggcggcggcggcgcgtggcagccgtgccgccctgcgtgacctgaacagccagctggtttcagtgaaagactctgccgtcgggatggcgggcgcgtttgccggcatcttcgccaccagtaaactgattgaaaccgccgacaaatggacaaacctcaattcccgcttgaaactggcgacggcgtccagtatcgatttagccaatagccagcggttattgatggagatgagtcaaaaaaccggaacatcattcgaggccaatgccacggtctttgcccgtgcggctgccccgatgcgggcactccaatatgcctcacaagacattgttaatatgacggaagcgctatcgacggggttgagaatatcaggcgcgaatgcttcagaatccagttcggtgctggtccaattttcacaagccatgtcgtccggtgtcctgcggggtgaagaatttaacgcgatggcggagaacggcagtcgaatcattcaggcactggctgacggtatgggcgtcgccagaacccaattaaaaggcatggcgaacgacggcctgttgacgatggataaagtcattcccgctttactgagccaactggagaaactgaaagcagaaggcctttcaatgggggcgacggttgaaaaatccctgatgcgcgtacaaaacgccttcatggaatggatcggtggggcgaatgaagccacgggtactacccgcgttctcgccggggtactggatgacctgtctaaaaatattaacgacgtcgctgcggcgggcgcagtggcagtcggtctgttcggggcgcgggcgctgggtaacagggtatcagcgattggggcatcaacctctgcgttgatccagaattcccgcgccgaaattaataacgcggatcaagcttaccgtaattctcaggttcaggttgcctcagcgagagccagcgcttatcaggcacaacaaaacgttatcgccgcgcgttcacgcctgcttcagacgacaaacacacagaccttcgccgccgcagaagcgagactgaaccggacactggtcgcagaagcggcagcgcaggccagagtgacacaaagcatcaatgcaagagccgccgcacaagcgcgactcaatgcggtcacctcgctcggttcaagaatgggcggtgcactgctcggcgctgtcggtggactgccggggatactgattatggccgccggtgcagcctacctgctgtaccaaaaccaaaagcaggccaaagaagaagcccgggcgcacgcgaaagaggcgacaaaaatcaaggaagaactgagcaagatggatcctgttcaactcagggacaccaagaatcagttaaaagaagatcttgccgtggctaaagaggatgtggaaaagttcaggaaggagatgaataaaaaccaaatcagcctcaatcttttcatgaaggataaaagcaacggtaaaaatactgacatcaagatcaccgagttcagcactaaactttcagaaagccgttcggcgtatgaagctgccctgaaaacggtcggtgaaatcacgtctgccctcacgagtctgggtgaccaacaaacaatcaatggggagaaagagaaaaggttcatcacagcgattaacgaaatgcgcaaaaccggcaatgtgacgctggcgctgcaaaatcaaaagctggagcttactgtcagtcttctggaacggatcaaaaacttagggattgatgtgtcgggtatccatgttcccgtgccggtagtgaaattcgagccaaacgacaaaataaagtcgttactgaaagaccaggaaagggaaattgatctttctaaaaggaagggattagataaagtcaggcgtgaggcgtattacaaagccgttgatggggggttgaatccggatgataggcaacaaaagccctatgtgaatcaggtcattaataacgcggctcaggtataccaaaatgccgaagccctacgtaagcaggacgaagccgcccgaaaagctcaaagcgaggcagaaagtgccacacggaaagccgccaaaaccgcagaagattacacgaataaagtggccgaactgaatacgcaactggccaccgaagcgatccgctataaagagggcaatgctgccgccgagctattcgccaattctcaaaataacgtcagtaagtttactcaggaacagaacaaccacctgaaccagcttaacaagcgactggaggaaaccaagcagcgttatcaggacttacaggctgctatcgaagcggatccattccgtaatgttgctaaaagaacccaagaagcgacagagcaactggagcggcagaagaacaatggtcaaattgagtcacccgccgaatacacctatcgaaaaggggatatctggaaagacgaggttagaggcaatgcggacgccagacagcagtatgccgtttccgccagagataacttacggggcgaagttgacccaatacaggatctggaaaaccaacttgaacgcaaaaaggcgctttatcagtcctatgctgacgcaactgttatcagtgaacagcgtaagaatgaactaattgcggccgccgaaacggaaaacaacacgaaacgcattgaagcggcgaaacagttatttgctgcccaaagtacctatcacgcaatcgcagtcaacctgtttgatactgtcagcgaacgcatgggcaacatgattacggggctgctaaccggaactaaatcgctcaaagaaggcatttctgaaatgttcgcttcaatggcacagagcgtcgttcagagtttaatgaaaattgctgcgaataaggcatttgaaatgctggcctcttcattcggtggcggtgcgggtggggcgttcaacggcttcatgtctacgttcgtcaagaatgccaaaggcggtgtttataattctcccagcctgagtagctacagcggtcagatagtcaatagtccgacattgtttgcgtttgcgaaaggggcgggactgatgggtgaagcggggccggaagccatcatgccgctgacccgtagtgccgatggctctctgggtgtgcgtgctatttccccaaagggcttgggtgatcaagggggcaccaatatcaatgtctacatcacggacgggaaaactgaaagttcatcatcgaaaggcgataatgacgccttcgggcgtcgttttgctcaggctgttgctcaggtctactacgctgaacgcgaccgggatttgcggcagggtggtgccatcaacaaagcgataagggcgaaataatggaaatattcacatggctgccgcgcgtgaatgccagttccaatgttgaatttgctatccgaaaagcgaaattcggtgacggttatgaacaggtctctggtgcggggattaaccccaagtcgatgagatggacattggattttgtcggtaatgaaaaacacattactgagattatcgcctttcttgaccggcatgaagggcataagtcatttatctggacgcccccgctggcgagcaaggggctgtttcggtgcgagagctataagtatcaggccattgattacaaaacctatgccctgtcaactgaattcattgaggcgcacgcgccatagaggacaatcatgtttactgctgacgtacaaaagctggacgccggaaataccgtccggctctacgagattgacgggacaaaattcggtgccgatgtgcttcgttttcatgcgtatggtatgcctgtgacgcccgaagaaattgacaccgccgaggagacaggtagtcagccgcagccgaagtccctttggtggcaggggcaggaatataaaccgtggcctgttcagatagagggactggacatgtccacggatggacaggctgcccgccctcgcttatctgttgcgaatattgagggaacggtcaccgcgctatgtctgcaatttgatgacatggtacaagcgaaagtcgctatccatgatacatttgttcattatctggatgcgaaaaatttcccgcagggtaaccctaccgctgatccgcaacaagagcggcagctcatgttttacatcaacagaaaaacatctgaaaccgataagactgtggtttttgaattagccagcccggcgtcactggatggcctgattattcccacccggcaaattcacggcgtatgcacatggtgtgcccgtggctggtatcggacagggaaaggttgcgactacgccggaacaaactattttgatattgacaacaacccgaccgatgatccgagcaaagaccgatgccccggcaccgtcattgcgtgtaagttgcgttacggtgaagataatgagctatcatttggtgggtttccggcctcgtcccttatcaggagatagccatgaatgataagacattaacggccatatttgaacacgctaaacagatgcatcccaatgaatgttgtggggtgattgcccagaaaagccgcgtagaaaaatactttccctgcaaaaatttagcccctaatcccgccgaacaattccagctagaccccggtgattatttagccgcatcaatctggggaactattaccggtattgttcatagtcacccggacgcaactactatgcccagtgatttagatgaggcacaatgtgattttactgaattgccgtggcacattgtgagctacccagagggtgatttcaggacaatctatccgcgcggtgaattgccgctactcggtcgcccgtttgtgttgggtgtctatgattgctatggtctcattatgagctattaccgccaacaatgcggtgttgaactgaatgactatcgggttaattatcattggtgggagcaaggtgaaaacctttacatagagaattttgagaatgccggttttgttgaagtcacaggcgacccgcagacgggcgatgtaatcattatgcaggttcaagcggatgtgcccaatcatgccggtgttttgttagagggtaatttattactccatcacctctacggacagttaagccagaaagtgccttatggggggtattggaaagacagaactgtgaaaacgctgcgttataatcaattgaataaataagtgttcataattagtatgaaagctaggtgccgcataaaagaaaattaatcctgaaaaaataaaggaataagtgtgaatagaatattaattatcatgatctgtggattattactctcagcgtgcaagcctacagaaaaagatttcattaatataggtgaatctcttgttagagatagtctaaatgatccagacagtgcgaaatttgattcattctatcactcatcagataagatatttactccgatcggccgtccatcaggtgaactagatggttatgtttgtgggagagttaatactaaaaacacatacggtgggtacacaggtggaaaaccatattatgtacatattgaaactaaagatggaaagctaaagaagcatggacctatagttatagtaagtgatgatgaccaaaacaatttattaaattttagattagtgtgtcccaaaggtggttgaatcagaagctaactaacgcaggatatagaaagacggagctatgaagacctgctgattgaacaaattacataaataatcgtccatactaacccgcttcggcgggtttttttatgaggtcactatggcttatacagatccccctttacgcacaatccacttacacggcgtccttgctaccaagttcggcgcgacatttgactatgccgtcagagatgccccccatgctatccgggctatgagtaggctggttgcaggttttgaggcattcatgatccatgctcaccagcagggttttactttttcggtcattgtgggtggcagaagttaccacaaaggcgaactggacatgaccaagggtaatggtgatatccatatactgcctgtcatcaccggcagcaaacgcggtggattgtttcaaacgattttaggggtagcgctgattgcggttgcatggtggaatccattgggctgggctgcctcgaccgcattgtttgtcggggcgtcaggggcatcaatggcaatgggcggcgtttctcaaatgctggcacctcagccgccgaggctggggatgcgggaatcccccgacaataaacccagttatgctttcggtggtgccgtcaataccatcgcacaagggaaccctgtgcctcttctgtatggttcgcgcgagataggcggggcgattatctcagcgggtgtttacaccgaagaccagtatcagactgagcaaatagaaaaccaacgcaaacacagccgctaaatgcggttaatgagatggtccccaccaccctgtgagcggtatgctggcagggtgtttctttcaggagaagaccatcatgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtgataaaaagactttcaaccgtcttggcagagaacgaacttcctccctatctggcacagttgctgatgcgcttacatgcccattatctttatcttgtcgaacagctcaccgagcttgagacggcactggagcaggagctgagacgtgatgaaacaggacagcgtcttcagacaataccgggcgtgggtccgataactgccagcgtcttatcatcgcagctgggcgatggtaagcagtatggctgtagccgggattttgctgcttcaaccggtctggtaccacgccagtacagcacgggtggcaaaaatacgcttttagggataagtaaacgcggagacaaaaatctgcgacggttacttgtccagtgcgccagagtctttatccagagaatcgattatcagtcaggaaggctggctgaatgggtaaaggctcagcttgagcgaaaacactcaaatgttgtggcctgtgcgctggccaacaaattagcccggatagcctgggcaatcacaacacggcaaactgtgttcgaaaggtaacgacgacgccagtctgactggcaggttaatcgttaattaaagcagttcccaatctggttttgcgaagactgattattgatgacatgaacggcttatcgacctgatggaatcctgacataaaaaatggctctctgaagccgtgcggttttttaggcttatcaggtgcggaactcatcgaggcgcgggcatccctgcccatagtgacgccggatagatttaagcaagccaacatcaatcaaaaatcagtgttgcaaaaaaggtggggaccatagatttttaggcttatcaggtgcggaactcatcgaggcgcgggcatccctgcccatagtgacgccggatagatttaagcaagccaacatcaatcaaaaatcagtgttgcaaaaaaggtggggaccatagattttttatcacatgttactttttttaaagaaagtgacacgctgagcgaagttaactctggtgaaagtgactattacgccaaatattacaagccggaacctattaatttatttgggatttatctaaccataatggagaaagagcctatttttgtggttttatatgataaagaggataaatatatatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtatatttatatttttgatattaaatagtttttacccatctatctttttatatttatatttatatttatatttatatttatatttataaataaacattattcaatatgtttattattttattattttattattttattattttattattttattattttattattttattattttattagatttttaacataaataaattgaatgcaactaaccatgaatatagatgcttggttttgtgacttcatagaggtgatgaagatgaaatggcggagaggaaagaaaataccgccagttcttaaagaaatggcggtgggaacacgttaagctgattcagacagatctttcagatactggaaaatctgacggtaggattttggtggcttattagccgccttctcttttttggcgttgcgaaccatcgtccgcagttgctggcgatccagatgtggatataatgcaaccacttctgccagagcgccatctgaatcttcgagcagtttgtcacgtaattcttccagcttgtggaacagcactacctgctggttgtgacggttattcagtttatccagtgcaatagtaatcggttccggatcgcgggaacgcaacattttgccaattaactgcaactggcggcgacggccttcacgcttgattctctgtgccaactcaatggctgccagcaggtcgtcatccagcggaatgcgttccagtgcgtttttactcagttcaaccagctccattcccagctttttcagtgcttcagaatctcgcttaatttcacttttactgacccagattatctcatcgtcttcctcttcagcaggataattgtcaagccaatcttcaggctgctttaccataatttttttccttccaaaaaggccggataaggtgcattttggaacatgaccaatcgtccggtgggtgttaacatcctaatattgtgtattgtaactgggaaaattgcctgattaccactcggcattgacgttgtggacgaatgtgaggcgctttttctgataaattatctctttagttcattggattacggttaattaatgatagtcactaatcaatatatcgcagaacagcgcaagcaattggaagatgcggtctcccacgctctcgaattagcgaagaccggttctgatgctgcggaagtcgcggtcaataaaacgacggggattagcgtcagcacccgtttcagtgaagtcgaaaatgttgagtttaacagcgatggtgcgctggggatcactgtttatcatcagcagcgcaaaggcagcgcttcttcaaccgatctcagcccagaggcaatagcccgcaccgtgcaggccgcgattgatatcgcccgctatacatcacctgatccttatgcaggcccggcggataaagatctactggcattcgcagcgccggatttggatctcttccacccggctgatttggatacggatatcgccattgagttggctgcccgtgctgaacaagcctcattgcaggcagatcaacgtatcaccaataccgaaggcggcagttttagcagccattatggtatccggatatttggcaatagtcacggtatgctgcaaagctactgctcaagccgccattctctgtctagctgtgtgattgctgaacaagatggcaatatggaacgtgattatgcttataccgtcagccgccgttttgatgaattgcaatcaccggaatgggttgggcaggagtgtgctcgccgtactctttctcgtctgggcgcacgtaagttaccgaccatgaaagcacctgtcattttctctgcggaagtggccacaggactgttcggtcacctggtcggggcgatcagcggcagcagcatttatcgcaaatcttctttcctgctggatagcttgggcaagcagattttaccttcgtggctgacgattgaagagcagccgcatttgctcagaggtctggcttcaacaccttttgacagtgaaggggtacgtactgcaccgcgtgatattatcaaagagggtgtgttgcagacgtggctgctgacttcctattcagcccgtaaactgggcatggtgaatacggggcatgcaggtggtattcataactggcgcattgcgggtcaaggacaggattttgcagctttgttgcgtgaaatgggaacggggctgattgttactgaactgatggggcaaggtgtcagtgcggttaccggcgattattctcgtggtgcatccggtttctgggttgaaaatggcgagatccagtatccagtcagtgaaatcaccattgcaggcaatttgaaagatatgtgggcgaatatggtgaccgtcggtgatgatatcgaaacacgcagtaatattcagtgtggttcggtattgctgccggaaatgagtatcgccggtcaatagggatactcaatcaacaacagccagtttggattttactggactggctgtgagctagcgatgatattcacctgcggcttcgggctgataaataatttctaatactttgatccgggttttttcactgtttggtagttgccaggttatctcatcattcacccgcaggcccaaaagagcagcccctaaaggtgccatgacagacaggtgcttggtactatcctgtagagacgctggatacacaagagtgcgtacacgctcttcattgctgcccaaatcaataaaacgaatttcactgttcattgtgacaacatccggcggaatttcgaccggaggcacaatttcagctcgatccaactccgaattcagcgcctctgcaatgtgggtattggcaaaggcgggttgttccaacagcaaatctaaacgttccgcatcgagttcgttaataataatttttggttttttcataccacgctccaaattaggctcaatacaaaataacaccccgcatcacaaggaggggggtgttattttcaaagtaataaaattgatattaggctgttctgacgtgaaaataaagagatcatgatcacgaactgttttgtgctgttaatggaacagggctaatccacacaaaatggaagaacagcccgatatcattttgagccgtggattatgcgcctgtaatggtgatccttgggttggtttctccccagatggaagagaattcaacaatatgcattccgccccatttttgaatgtcagattgggtaatttcttctttgccttgtttaccgaaaatgaccacttcatcaccgctcttcacatcaggcaaatcagttacatcgaccatgacggtattcatggaaacgaggccgacaacaggtgcgcggtgaccgttgatcagaacaaacgctttgttggacagactggaactgaaaccgtcagagaaacctatcggcaggttagccagtttggaatcacgtttcaggatgtaggtgttgtcgtagctgacaccattacctttaggatagggtttaacagaagcaacgcgggtttttacctgaatcagcggcttgaattctggatattcagggttcaggatgccgtacagtgcactgccgacacgcaccatgtcgaattgtgcttcaggtacgcgaattgacgcataagagctcgaagcgtgcagaatgatctcgtttcttttcagattggcggttttgatcaaccaagccgtttgttctttgaaatcgttcacgccttcgcggatcgcatccagatctttgagggcataatggctcatcatgccgaccagcttcaggttaggcaattgagcaattttcagcgcttcttgtttaccctgctcagttttcatttccagcccgttacggctcatgcgacccgtgttcagaactaaatggacacggattgctttgccgtgttttttggcaagagcatcaatagttttagcatgttctagatcgccgaccatttcttccatgtcatagcccagcgtactctcaatttcagtcacagccgctgcacggatgcgcatcaattgccctttgaagccgctttcacgcacgatgcgagcttcttcattgctggtaattcctacacaaggcatgcctgtcttgatgacagatggcatcagtaaatcgataccatgaccgtaggcatcacctttcagaactacacacactttggtgtctttcgtcagtttactttgcagtgtgtggatattattttcgaaagtcgtcgtgttgatttcaacccaagcgttgttggtagccgcaacgtgttctgcctgagtattgtctaaagaaagcgtaggggcggcttgagcagtgccttggcacagggtcacgccaagaagaaatgccagtgtagttttattaaaacgcatgaagtaatctccggtttaatatttgaactgaaaaaatgatccgtgtgtaaataccccgtaatgataaattttttattaattaatttcatatagttaaattttatttggggaactttgattgtaataggaatactatttgtaaataggcaatactataagctaaatttatactttaaaatattaatgatcttctatggatgatgacagacagaaggaataatgagaggaatatggcgtgattatgggttaattttcacccttgatatccattgttgaatactgataattatttattagacagtggtattatttgaacgatatatagtcgtaaatggcaggaactgagaaaaaacgatatttagcttaagaaacggcatcttatagtgagatgattcagtgtttaaaaggaaggaaaaggcaggaaagagtagggaaatgtttattcttcatcaaatccggcattaaataactcaataatggcggccagtgcctgctgctcatccgacccggtcgcctcaacttcaatgtaactgccttgttcggaatccagcataagcatggcaatcacactgtgggcttcggcttgaatattgctgctgttgcgcagaatgacctgcgattgaaactgctgcacaaggtcatgcaatttcattgcaggtcgggcatgcataccaagccgatttttaatttcaagctgctttttgactgtcatgctctgccattattgtattatttacgtttttccagtgtgcggtgacgtgattgcacgtttttgccacgggaacggaagtagtccgctaattgttcagcgacgtagacggaacggtgtttaccccccgtacaaccaattgccacggtgagatagctgcggttattggtttcgagcatcggcagccagagttcaagatagctgcgggtctggtaaataaaattgtgtacttctgtgtggcgatccaaaaaggcagccacagggcgatctaaaccggtcattggccgcagtttaggatcccagtgtgggtttggcaggaaacgcacatcgaaaacataatcggcatcaatcggaataccatgcttaaagccgaaagactcaaacaccatcgtcagttcgcgttcgcgtttgcccagtagacgcgttctgagcatttctgccaattcatgcacggacatttcagaggtgtcgatgatcaaatctgcccgtgaacgcaggggttccagcaggtcactttcttgatcaatagcgctttccagcgacagatttttgcttgatagtggatgcaggcgacgtgtgtcactgtagcggcggatcagggtgttgcgatccgcatcaagaaacagtaattgtggcgagaacgtgtccggcagtttcgtcagagcttcttcgaaaatttctggcgactccggcatatttctcacgtctatgctgaccgccgctgaaataccgcgttcagctaatgtgcctgccagttccggcagtaagaccaccggcaggttatcgacacaatagaatcccatatcttccagcgcacgcagggcaacggatttaccggagccggaacgaccgctgactatcatcagcaccataagatgactcccctttaatatctcagcggttctaataaaccgctgctgttttgttgctttccaataattctaatcgctatttattcagttatgattttatatagctcttcgtcactttgtgctgaacgcagacggcggcagagattcttatctgcaagacgctttgcaatcaatgatagtgaatgtaaatgggtctgacactggtcagacggcaccaataaagcaaacagcaagtcaacaggttgattatcgatggcatcgaaggcaataggctgttccagattcagaaacacgccaacggcattatgtgaacactctttatccagtttgccgtgaggaatggcaatcccgttgccgatacctgtggtgcccactttttcgcgggaaagaatagcctcgaatacggcattttccggtaatccaagctgttttgatgccagttcactgataatctctaaggcgcgctttttactcgaacaaggtacgttgttgcgtgtacattcgggcgaaagtaccgaacttagtggtaaatctgtttcgttgttcatttctttaatcacttagggcctgtaataccggatgcctgactggaggcatccggtattgatgcactgtttatacctttcacctgaatctattgggtatgtaagtagaacagtgatgagtttatgacagccccgttgccagaaagctgttaatgttgtctcaacttacttttgtgtttggtcaattgacgtgccagcttatctgccagtgcatcaatcgccgcatacatgtcttcatgctctgagcttgcatgcaactcacctccattgacatacaccgtggcttcagcgattttctgcactttctccactcggagtatgacctgaatgaggttaattttatcgaaatattgatccagtttgccgtattttgtattcacaatgttgcgtaatgcatcagtgatttcaatattgtggcctgtgacattgagttgcatagtgttttccttctctgtgtggttcaaaccagttttttgcgttggtttgaaggcgggatggataacgactctctatattttgcgacagttcgacgcgcgacttgaatgccctgttcggccagaatgctggtcaatttgctgtcactcagtggcttggccgggttttctgccgcgaccaattttttcaccagtgcccgtatcgcagtagaagaggcttcacctccgctatcggtattgacatggctggagaaaaaatatttcaattcaaaaatgccccgtgggctatacagatatttctgtgttgtcacacgggaaatggtggattcgtgcatttcaacctgataggcgatatctgccagtactagcggtttcatgtgctctgcaccatattcaaaaaaatcttgttgccgttcaacaatgcaactggcaactttcaataacgtgtcattacggctttcgaggctttttatcagccatttggcctcttgcagattattgcgaatgaacagactgtcgctttcactatgggcctgttgccccaatgctgcgtagtgttgattgatgcgcagacgggggatgctatcggtattcagtttgacttgccagctttcattctctttatgagcaagcacatcaggaataacatactcggattcacctgcattgaccactaatccgggtttgggttccaatgattgaataatatcgatggcttctttcagggcattttcctttaatttgctctgacgtaacacattacgaaagtctcgattgcccaatagctcaaggtatttgctgacaaccagtttggcttcgttcagataaggtgtttttgtcggcagcatcgaaagttgaataagcaggcattcacgcaaatcgcgggcggcgataccaatcggatcgaaatgctgtatgcgtttgagtacgatttccacttcttctagcgtcagctcattatcgccaatgctggcaaggatctcttcgattgaaactgtcagatagcctgaatcatcaatcgcatcaatgatggaggtggcgatggcagaatccgtttcagtaaacggtgtcaaccctgcctgccacatcagatagtcttgcagtgtctgagtggtttcaccctgataaacgggaaaatcctcagcactgtaatcgctgtttgtccccgaaggagtgccagccgtgtaaatttcatcccaactggcatccaatggcagttcttccggtatattcttctgttcaagcgcttcgcgggtatccatcacctcagttaccgcatcaggagattcctgactgtcgatttcctcatgaggatcatcctgttcaagcagtgggttagcttccaaagcctgctggatctcttgttgaagttcaagcgtagaaagttgcaacaaacggatagcttgctggagttgtggcgtcatcgccagttgctgactgagcctgagttgcaaactttgcttcatagcattaccactttctcctgaatttctctggaatttctcctgaatgacgcctgacagaatcaggattaaagacggaaaccctcacccagataaacgcgtttgacctgctcattgttgagaatatcttccggtgagccgtgggcaatcaactggccttggctgacgatataggcgcgttcgcagacatccagtgtttcacggacattgtggtctgtaatcagaactcccagcccatagtcccgcagatgttgaatgatctttttgatatcgagtacggagatgggatcgacgccagcaaaaggttcatccagcagaatgaatttcgggttggcggccagagcacgggcaatttccacacgacggcgttcaccaccggaaagtgactgtcccagattgtcacgcagatgggaaatatgaaactcttccattaattcttctgcccgctcttttcgttgctcttgcgtgatatccttgcggatctccaagactgccatcaaattgtcaaatacgctcagacgacggaaaatggaaggttcttgtggcaaatagcctattccccggcgggcgcgttcatgcagaggcagcaggctgatgtcttcatcatcaatagtaatggtgccagtatcacgtggcacaatgccgaccaccatgtagaaggtcgtggttttacctgccccattggggccaagcaaacccacgatttcgcctgatttgacggtcagactgacgtcctcaacgaccctgcgacccttataagcctttgccagattttctgcgtttaaaattgccatacgtcgttatttactcttgttgttaacactgatgcctttttcctgtagctgggaaggcaacaggacggtagtaacacgtttacctttatcactaaaggcttccatttgctgtgttggcaccagataggtgattttatcgcctttgatgttactgtcgagttgttcaagataggcattacctgtcagcgtcatcagctctttatccatctcatagcgcatttttgaggcatgccctttgatgggtttgccgtcatcttgtaactgatagaaagtcgccggattaccgtaggcttcaataaccgtttttttcgcatccccttctgggcgagtgacgacgactttatccgcatgaatgtcgattgagccttgttttacgctgacattatccgtaaatgtggctacgttccccgttaaatccaaagattgcctgtcagaattaagggtaatgggctgtttcgtatcttctttcaatgccagtacgggcaggctgactgcaaacagggtactggcaataacggtattacggattaggttgttcatttgggatctcatagtgagtcgtcaccttttcaatcaattcagcagttttgtttcgcagattgccacgcattttcatgccaacagatttcaggccgacaccaatcagagtgacttggtcgtcggataagatatcttgagacaccagattgacggtcgcattttctgttgtgatccgttgcagttgtgaggcatcggtcaggctatccagctggacatcgccgtacagatagagcattttatcgttggtcagctttgctttatttgcgcgtactgtccatgtcggtgtttcggaagtgctattggaggcaaaggttgtcaatatgggtttagtaaaccaagtcagtttgctttccgtatagttctgtacatcatctgccaccagtttgtaagccagcttgccctcgggatcatagacaaaagaagtggcttcctgtgtttgataagtgggatacccatcatccacaattggtgatgaggcgttttcgtttaaattggataaattccagccaatcagcgcaagcgcgatcaatgccagtgttccgatcagccaggattgaattctgctcattctcttttcaattttagtcttatattgataaccctttggcaccttccagcttattctgagcgaaaagtaccaaatcacaaagctccctgactgcaccacggccacctgcaatctgagtcacataatctgctcttggcagcagcagtggatgggcatcagaaaccgcaacagataacccaacttgtgccattacaggccagtcgataagatcatcaccaatataagcgacctgttctggctgtaacgttagtttatctaacagttcctgatacgccaaaaccttatcgctctgtccttggtaaagatgtgtaatacccagtgtttctgcgcgatcttccagcaacttagctttacggccagtaatgatggcgacttcaatgcctgaggtaatcagacaacggatgccgtaaccatcacgaacgttaaaggctttcagttcttcaccctggttgcccatatatatcaggccatctgacatcacaccatcaacatcacaaatcagtagacggattttactggctctttcgataatttcttcgttgaccgggccataacaggtgtccagatacgttttctgactcattcaggaattctcttaaggtttataccacagctgcttataccattacctgtgctttatacatactctacccttcatctttctctgttgggtatataccgaccttatactacacccgcctgtaagaggtcgtgcatatgcagtacgccgagcaatttgtcaccgtcagtgaccagcaaggacgtgatgtggcgtgactgcatcaggttcagggcatcaacggccagtgtatggggcttgatgcggacaccgccgatagtcataacatcagagatgtttgcatggtttaaatcgattcccatatcgaaaacacggcgcaaatccccgtcagtgaaaattcctttgatctgcatatcgtcatcgcagatgacggtcattcccagtttcttgcgggtgatttcaaccaaggcttcacgtagtgtcgcggtataaggaacacggggaatatcatcaccgatggtcattaagtcactggtcagtaacagaagtttgcgtcccagcgtgccacccggatgggaaagggcaaagtcttcagcggtaaaacctcgagcttgtaagagcgcaacggccagagcatctcccataacaagtgttgctgtcgtgctagtggtgggcgctaatccaagcgggcaggcttcctgtggtgttttgatgcacagatggatatcggcagctttccccatgctactgtttgggttgtttgtcatacagataagcggaactttttgccgtttgaggacggggatcaaggcaacgatttcattggattcaccggaattggagattgtcagcacgatgtcttttgatgtcaccataccgagatcaccgtggctggcttcaccggggtggacaaagaaagagggcgtgccagtactggcaaatgtggcggcaatttttcgtccaatatgaccggattttcccatccccatgacaatgatttttccttcacaaccaaacatcaactcacaggctcggctgaaatcttcattaatatattgttccagttctgccaatccgtcgagttcgacctgtaatacttttttacctgattgttgaaaatctatcttagacatttctacttcccacgtcatcggcaattaatcagtaccgtaataattagaaacaaaaagtacgaaaaaataagcgataaaacagcccagtaacaggatgccgtttaatcggttcaatcgatgctttctccccagacagaatatcgtgaataacacactggcagccatcatgacccagaagtcccgggaaaaggcctgaggtgaaataacgccgggtgaaagtataccggggatacccaataccagagtgatgttgaaaacatttgagccgatgatattgcccatcgccatatcattctcgcctttaatggccgcagcaattgaagtagccagttcaggcaggctggtgcctaccgccagaattgtcaggccaataatcagctcactgatgctataaatacgtgcaatcacagccgcattgtcaatcaccatgcgggtagaaatggggaggataatcaatcctaaaacaacccagagaagtgcgatgcctttgttgccttcgacaggtaattctgcatctcgttcctgcatatagctgtctagaccatcatcttgggaaactgttgtcattttgatcattatgacgataaaaaacaaggcggtaagtaacaggacgataccgtccaggcggttcaggtagctgtctgccagaatatagcctacaaatgcagtaatcagcaacatcagcggcaattcccgcctcaggatatctgatttcactgtgatcggtcgaatgagtgacgcagcgccagtaatcagtagcagattggtaatattggaaccaatggcattgcctacagctatgttcggtagcccatcttgagctgctgtgatagataccatcaactctggcagtgaagtgccgattcccataactgtcaatccgacgatataggggggtattttcagtgagcgggcaaaaaccgcagcaccatatactaatctatcagatccatacaccagtaaaatcaacccggtaatgaacagagcaatagtcagaaacatggggtgttccttaaataaaatttattccgaacatgatgctaataatggttgatttttaaacatgaaatgtttattcagctagacttatatattctgacggtcaagcgataaaaagtaaaatttgtcacaactttgctaacgcaaatttggcaatttttttgtagtatgcatgactgattatttaaaaacagtaagaaacaagttttattaacggttaggggctatcaaataatgagtcaacaaacagcaaatcttattgagatctgcggcatgtatttcactcgtggtcaacgcccgattttttctgatattaatctgaccgttccaaaaggaaaagtgactgccatcatggggccttcaggcatagggaaaaccaccttgctacgcctgattggtgggcagatccgccctgaacgcggcgagatctggtttgatggcgataatattccggcattgtcccgccaacgtctctatgctgcccgtaagaaaatgagcatgttatttcagtcaggtgcgctgtttacggatctgaatgtctttgacaatgtcgcctttcctttgcgtgagcatacccaattgcccgaagcgttgattcacactacggtgatgatgaaactggaggctgttgggctgcgtggtgctgcgcacttgatgccatcggaattgtctggcggtatggctaggcgcgctgcattggcgagagcgatagcactcgatcccgatctcattatgttcgatgaaccttttgttggtcaggatcccattacgatgggcattctcgtcaaattaattgatgagcttaaccatgcgctcggtgtcacctgtgttgtagtttcccacgatgtacctgaagtattgagtattgctgattatgcttacattgtggctgagaagacggtcattgcagaaggtacaccggagcagttaagaatgaatcaggatcatcgggtacggcaattccttgatggcattgctgatgggccagtgcctttccgtttccctgcgggggattacaaaactgagttattaggataatggaatgttgatgttaacacgggcactggctgcgctgggtaaacgtgcgatcgaggttgcagcctcattcggccgtgccggctttatgcttttcagtgcaatcattggtaagccagaactcgccaaacaatggaaattattatgtcagcagctgtatagcgtcggtgttcagtcactgctgattatcgtggtttccggcttgtttatcggtatggttctgagtttacagggctatctggttttaacgacattcagtgctgagggcagtctgggcatgatggtggctctgtcactgttgcgtgaattggggccagtcgtcacggcactgttgtttgcgggtcgggcgggttcagcgttgaccgcagaaattggtttgatgaaagccacagagcagatttccagcttggaaatgatggcgattgatccgctgcgtcgggtaattgctccgcgtttttgggctggttttatcagtatgcctttactgtcgctgatctttgtcgcggttggaatcatcggaggcgcgatagtgggcgtggattggaaaggcattgatgccggctttttctggtcttcgatgcaatcggcggtggattggcaaaaagacttgctcaactgttttcttaagagcgtagcttttgccattacggtcacatggattgcattgttcaatggttatgacgctatccctacatcagaagggatcagcagggcgacgacgcgtacagtagttcatgcgtctttggcagtattgggtttggattttgtgctgacagcactgatgtttgggaactaattcgatgcaaaacaagaaaaatgaaatttgggttgggtgttttgtcttgattgcactggctgcaatcgtctttttatgtttgaaagtagctgatgttcggtcatttggcagccagacaacctatcgcgtatctgcggcatttgacaatattggtggactgaaagtgcgttcaccagtaaaaattggtggagttgtgattggtcgtgtagagcgaatctggctcgatcacaaaacctatactccacaggttgaactggaacttttcactcaatacgacaatattccaagtaccagctcgctttctattcggacatcaggactattgggcgagcaatatgttgcaatgaatgtgggtttttatgaccctgatatgggggtatccatgttgaaagggggagatcgtattgaggataccaagtctgcaatggtacttgaagatttgatcggtcagttcttatataaaagcggtgacagtggtcaggcgaaatctgattcggcacctgcacattaatctgcaatccacggcttaggagaaatagcatttatgtttaagcgattacttatggttgcgctgctggtggttgcaccattggccagcgcagttgatcaaaccaacccttatgcattgatgaaagatgcagcagaaaaaactttcacccgtttgaagaatgatcagcctcaaattcaggcaaacccagaagttctgcgtcagattgtgcgtgaagaattattgccttatgtgcaggtaaaatacgcaggggcactggttcttggaacttactacgggcaggctacgcctgaacagcgcgaagcctatttcaaggcttttgaatcttatttagagcaggcatatggtcaggctctggcgatgtatcatggccagaactaccagattgcgccagaacagccattagagggcaagacgatagtggctatccgggtcactattactgatgaaaatggtcagccgcctgttcgcttggattttcagtggcgtaaaaatagcaaaacaggttactggcaggcttatgacatgattgcggaaggcgtaagcatgatcacgaccaagcagaatgaatgggcagatatcctgcgccagaaagggattgatgctctgacagaacagttgaaaatcagtgcgaaaacgccaatcactttagaaaagaaaaagtgacatggaaaaccgggaaataagccaatcgtctgatgacggaaagataagttgggaacaaacgggaagtacactatttcttcacggtacactggatcgtgacagtttacttccgctttggcagcaaaaaggcagcgttatggctgagatcgaaaatattgatgtttctcggcttgagcatgtggattccacagggctggcgttgtttgtccacttaaaaggagacatgcagcaacgtggcaaacgattaacattttctggcataagtgaacgtctagagacattgatagcactttatggcttgcaaagtctcattgctgctgacacgccagatatgtaattcccttttcccataattatcgcccttgtaagtcatcctcttacaagggcgtttttcttggtttaagagtcgtctggtttccattaggataggcgattactattatttttaacgacgtatgtgagcaaattatggatactgatgaaattaaagaagtgctgatgaaagcattggcacttgatgacgttatcgttagcggtgatggcagccatttccaagtcattgccgttggcgagctttttgatgacttaagccgtgtcaaacaacagcaggctgtttacgcccctctgatggaatacattgctgataatcgcattcatgccgtgtcgatcaagacttatacacctgcaaagtggcagcgtgaccgcaaacttcaggggttttgaggttgtttgcctcgccgcgaacagcacactttgaattaaacaagagaatgaagatggataaatttcgagtgaaagggcctacctgcttatcgggtgaggttactatttccggagcaaaaaatgctgcattacccattctgttcgcagcgctgctggcggaagagccagttgaattacagaatgtacctgaattaaaagatattgataccaccatcaaactactcaaccgtttgggaaccaaagtaaaacgcaatggttctgtttttgttgatgccagtaacgttaacgaatactgcgcgccttatgaactggtcaaaacgatgcgggcttccatttgggccttggggccgctggtcgcacgtttcggtcaagggcaggtatcactgccgggtggctgtgccattggtgctcgccctgttgatctgcacatttctggtctggaacagctcggtgcaaaaattgttctcagtgaaggctacgtcaaggcttccgtcgatggtcgcttgaaaggcgccagcattgtcatggataaagtcagtgtgggtgcgaccgtcaccatcatgaccgcagcgacactggcggaagggacaaccatcattgaaaacgcagctcgtgagcctgaaatcgaagatactgccgattttctgaatacactgggagcgaaaattaccggagcaggcaccgatcgcattgtgattgaaggggtagagcgtctgggaggtggtgtttatcgtgtgctgcctgatcgtatcgaaacaggaactttccttgtcgctggtgccatttcccgtggcaaggtgatttgccgtaataccaagccgaatacattggatgccgttttatccaaactgcgtgaagctggggcagacattcaggtgggagatgattggattagccttgatatgcacggcaagcgaccaaaggcggttacattccgcaccgccccgcatccgggctttccgacagatatgcaggcccagttcagcttgttgaatatggttgccgaaggtgtcggcatgatcactgaaactatctttgaaaatcgcttcatgcacattccagagttgattcgcatgggtgcgcgtgcagaaatcgagagtaatacggtagtttgtcacggtgttgaaaatttatctggcgctcaggttatggcgactgatttgcgtgcctctgcgagtttggtattggctggctgtattgctgaaggcaccacggtagttgatcgtatttatcatattgaccgaggctacgagcatatcgaagataaactacgtggtttaggtgcgaatatcgagcgtattaagtcgactgattaaactgaattcatatcatccttcgcccagtctgggcgaaggattgaataagcgaaaagcagcggagttatcggctatactcttcatcttgcaagctgccgcagacgttaaatactaaattcttcagccgtcaaattcttcaaccataaccttgaaggtgagggattgaccatcacgcagcacagtgatgggaaccatactgccagggcgaatgtcagtgacttgatccatcgtctctgtcggagaaatcgcaggttggtgattgaaattagtaatgatatctcccactttgatccccactttttgagccgggcttctcggtgcaacttcaaaaacccgcaaccccggcatttggtttatgttgctgtctgacgagcgaatacggggcaaatcttggacagtgataccaatatatcccctgatgacccgcccatcacggatgagtttatgcatgatttttgtggcaagctcagtgggaatggcaaatcccaagccttcaggcgtgacaccaaattctgacttatcaaacgtcagcgtattaatcccgactaattcccccagcgtattgaccagtgcaccgccggaacttccctgattaattgaggcatctgtttgcagaaaattctggcgacgtgtagggcttaggctaacacgccctgtcgcactgataataccttgagtgatggtttgtcctaaattgtaaggattgccgattgccagcacgatatctcccacatgggcaactcgattgggatttatcgggattactgggagatttttaccattgacctttaaaaccgccagatcggttggagcatccgagccagccagcagcgcctcatagaatcgtccatcttgtaatgcaacaataatagagtcggcttcattgatgacatgtttgttagtgaggatatagccctgttcattcatgataacgccagaacccaagggaagaagttcccggccttcatgagaaaaactacccagattactgctgtagatattgacaacagcaggagctgctcgacgaactccttgattgaaactgtatggtttgtcgttgcggctgctatcactcaggagatgttttaacccattgggacgtagtgaaggtatggtaaccaataagattgcagcaatgagcaatcctatcgatatggagcgcaataacttgatcagcatggcattattcagtaataaataagttaaagaagcatagcacagaagctaacagacacagcttatgctgtgtctgttagtaatactagaacgcgtttttatattcaattggttaattacgcaataacaagtagatattatcgtcaccacgtaaaatgttcagggcaataacaggcggttttgcctcaagcagtttacgcagctcgttgatattccgaattcgctcgttattggcgcctacaataaaatcatcattctgtaagccagacattgcggcaggtgaattctgggtaattttatctactttcacaccttgcgtgtttttcactgtactgttgctcagaatggcaccttgcagggcaacgctcaagttttcagccttagtttcttgggctacattattttctagtgttacgatcacttccattggccttcctttacgcagaaggccgattttgattgctttaccgggagcggttgtaccaaccttcgcacgcaattcagcaaagctggtgatttttttgccgtcaacggagaccagcacatcccctggcttgatgtcagctttagccgccgctgatttaggaatgacttcgctgacgaatgccccttgttgagtatcaacgttgagtgccttggcgacatctgctgtcatttcggttcccttgataccgagaaggccgcgtttgacttcaccgtgggcaatgagctgatctgcgaggttgctggccatgttacttgggatggcaaaaccgatgccgatgttaccgccgccgggagcgaggatcgcagtgttaatgccgatcaattcccctttcaggttgatcaatgctccccctgagttaccacggttgatggaagcatcggtctggatgaaattttccaaaccttccagattcaggccactgcggccaagggcagagataatccccgatgttacggtttgccccagcccgaatgggttgccgatggcgacggaataatcccctacacgcagttgatcagaatcagcgaatttaatggctgtcaggttcttggcatcttgcagctgtaaaagtgcgatgtcagtctgtgggtcacgcccgatgagttttgcggaatattcacggccatcgtttaattgaacccgaattttattggctttctcaataacatggttattggtcagcacataccctttattggcattgataataaccccagagcctaatcctttgaatggacggcttctttgctcctgtggaggaaaacctggtccaaagaaaaattgaaagtcttctggtaactgaagctgctgctgattttgaacttctgtgcccgagacatgcacagtcactacggaaggaagaactttttccagcattggcgcgaggctcggtaattcctgagaagccactgcggcaggtaaagctgcgttacctaccattggagctgaagccaaagataatccaatactgatcgcaagtgcactgagcaatgtgttttttcttttcattgaatacgttctcttaatacctaagccagaaagggaaatcgtacttaaaagacctatcctgtcaggaaatttcattttccttgggaattacgcttattgggataggttttaagcataattgtttcgatgctgttatgactctcaattattcagcaaagttcactaacaatgttgttttaccgtgtttctttacaggtatttacgtgaattaaaattaaaaaacaaaactctttaatgccaggaaagccaatgagccgtggtatcaacaggttaccacggcctgagaatttactgttttttatcttgaatcgggcggaataggccggatgctccctcagaatagtcccgtggaggcatactggaggtgattttacttttaccgacttcagattcagtcaggcgataattgaagggattatcctgtattggcatgtttggcatcagttcgttggaacttttggccatgtgctgatacagctggcgataatcgcgtgccatattatcaagtaattcagcactgtgagcaaaatggctgaccagctccttacgatactcttccaactctgcccgattcttctccagttcggcctgtgctgcattttgctgacgcagtctcgaactgccaaagcggacagccagtgcgccaacgataaaaccaataattaatccaatcagtgcatattcccaagtcatggcaacccctttattaacttcagtgttcggcaatagtgttccactatgtctcaataccattgctatcactataaccgctaattaagtcagagtggaatattgattattaattaatttatatgccacttgatgtgtcaattttatacaaatttgcgatgatacgccgtgaattattggcggaattgagagaggatatggaaaaaagtatgaaagatgggaacaaatataacgaactcagacagaaaagatgagcgcgatttttaccagtacaatgaatcgtgctgagaacaaaaatttttaaggattgtcattttgatgtcaccgattataccttcgtctctctatcaatctgcactgtcagaaggccagtaccaacctgatgaagtgcagcgtaataccgttgcccgcctggatatcattcatcacgatcttggtcatcgctctccggagcaggctttaccttcaagtggactgaaaagcctattgggcaggttatttggcggcttatcaacagagcagccgcgaccgattcaggggctttatatgtggggcggcgtcggacgtggaaaaacatggttgatggatatgtttttccagagcctgccaactgaccgaaaactgcgtctccattttcatcgttttatgttgcgggtacatgaagaattaaccgctttgcaggggcacgaaaatcccttggatgtgatagcggatggttttaaggcgcaaactgatgtgctctgtttcgatgagttttttgtttcggacattacagatgccatgatcctcggtaccttgctggaagctctgtttaagcgaggaattaccttggtggcaacatcaaatattccacccgatgaattgtaccgaaatggcttgcagcgcgcgcggttcctgccagccattgagcaaattaaaaaatactgcgatgtgatgaatgtggatgcgggtatcgattatcggttgcgcacgctgactcaggcacatctttatctcacgcccttgtcggaagataaccgacaggaaatgcatcgcatgtttcagcgtctggcaggacggaaaggagagccgaatccggtattggagattaaccatcgcagtatgcctgccatcagcagtgttgacggggtgctggccatcactttcaaaaccttgtgtgaagatccccgcagtccgttggattacattgcgttgtcgaagctttatcattctgtcctgctgcatgatacgccagctatgactgcattggatgaaagcgcagcccggcgttttcttgcattggtggatgaattctatgaacgccatgtaaaactcatcatcaatgctgaagcgccgatggagcagatttatcaaggggaattactgacatttgaatatcggcgttgtctgtcccgcttgcaggagatgcaaagtgaggaatatttaaaacttcctcatttgccctgatatctgactttgatcagtaagaaaaatcgagattgtcgttatctggcaggataattattgaattgggggtcgattttttatgatgacttctctataatcttgcgaccccacgttacagcaagattttttttcccaaaaacttgcattagtgccggcataggctattcgaaggggtaggtttgctggacaaaagtcgtgtgaacctcaaaaacagtttctgaacatcgagtgttcaccaacgtgtaacttataattgggtaagctttaatgaaaacttttacagctaaaccagaaaccgtaaaacgcgactggtatgttgttgacgcagatggcaaaactttaggccgtcttgcaactgaaatcgctagtcgcctgcgcggcaagcataaagcggaatatactccgcacgttgatactggtgattacatcattattgttaacgccgaaaaagttgctgtaactggcaacaaacgtgctgacaaaatctactatcaccacactggccacatcggtggtatcaagcaagcgacctttgaagagatgattgcccgccgtcctgagcgtgtcattgaaatcgcggttaaaggcatgctgccaaaagggccactgggtcgtgcaatgtaccgtaaactgaaagtttacgcgggcagcgagcacaaccacgcggcacagcaaccacaagttctggacatttaatcgggattataggcaatggctgaaaatcaatactacggcactggtcgccgcaaaagctcctccgctcgtgtctttattaagccaggtagcggtaacatcgtaatcaaccaacgcagcctcgaagtttacttcggtcgtgaaactgcacgcatggttgttcgtcagccactggagttggttgacatgttaggcaaactggatctgtacatcactgttaaaggtggtggtatttctggtcaggcaggcgcaatccgtcacggtatcacccgtgcactgatggcttatgacgagactctgcgttctgatcttcgcaaagctggcttcgttactcgcgatgctcgtgaagttgaacgtaaaaaagtgggtttgcgcaaagcacgtcgtcgtccacagttctccaaacgttaatttgttgccacggctgtggcgatgggttaaagttgaaacccgtcatttatatggcgggtttttttatcatctgattttcctttctttggtgaatagccttttttcccaaaaaatagcgtattacagaaataaataactagattctgatatttcatcattaattctcaatgtacttccccacaaaatgtgcaaaatctggtagactagtaataattttttgccttatccatgaatgagcctgatttggcaggggtttcaatataccctcggataataagtgcgaaacaggatgagaatatgagcgagaatagccgtttttcactgaagggctgttcgttcctttgtttagataaacttggaggttttcatggctgtcgctgccaacaaacgttcggtaatgactctgttttccggctcgaccgacatttttagccatcaagtgcgaattgtgctggcggaaaaaggggtcagcgttgagattgaacacgttgaagcaggtaatttgcctcaggatttgattgatctgaatccttatcagacggttcctactctcgttgatcgtgaattgactctgtatgattctcgcatcattatggaatatctggatgagcgttttccccatccaccactcatgcctgtatatccggttgcacgtggtagcagccgtttgatgatgcatagaattgaaaaaaactggtattccctgatgtataaaattcagggaggaaatactcaggaagctaatgctgcacggaaacagcttgcagaagaattattggccatggcgcctgttttcagagatatgcctttcttcatgagtgaagagttcagtctggtggattgctacctttcgcctctgctgtggcgtttacctgtattaggtgtagagttatctgggccaggtgcaaaagatatccagatttatatgcagcgtgtatttgaacgtgacgcatttttggcttcactgacggaagcagaacgtgaaatgcgtttaccatcacggagctaatttatggagatgattcaaatgtctccccgtcgtccttatttattgcgggcgcattatgaatggctgctggataatgaaatgactccgcatcttgtcgtggatgtcaccctgtatggggtgaatgtcccgatggaatatgcgaacgatgggcaaatcatcctgaatatttcgccgagggctgttggcaatctggaattgactaacgatgaagttcggttcaacgcccgttttggtggtgtagcgcgtcaagtctctgttccaatggcggcagtgattgcggtttatggtcgtgaaaatggcgcaggaatgatgtttgagccagaatctgcctatcaggcgggctccacaccagaagattctgatgttcctgtagcggataatctggtgcttatcagtgacgctaagattgctcgtgataatgactcatcggatgacgaacctccccaacctccaaagggtcgtccaactttgcgtgttgtaaaataaacaggcaaccaggtacagttacaatataaaaaataaaggagattttggtctcctttattatttttagtcgtacccgcttttatagaggcactcgcctgagagtcaaaaataggtactataaagtttgatctagtctccacaggcaattttctatattttccttattttttccggaattcgattttttggctgcattcaggctgttagacagcttttcaataaaacttgtcctttcgcccaagccttttaaagttgacggtatatcgcagatctgatctgatgagaatgaattatattttttcgacagcgataagacttctacggggttattaattaaggcaaaagataaagagcgaaggagttgtttcgaaaattcggaatgcatattgggggataacgtaaatgcaactctcagccactgactttcacctgttgtaatgttataggcgacttcatccctttttccactttctcctaattccgcaacaacggcatttacacctctttcccgcacttgttgcaggatttccgcttgtgtcgataaatgagcaattgagggtgagctcattattaaagatatgaaagagaataagaatatctgtgtgagtaagcgcatctatttattccagtcattgtcaatgaatagttattacttaattaactattatttaatttttgtttggatatcgtttaactaattacactaaaaaaaccgtcttctctttgataagaggaataagattttttgctgtattaacacagtagattaaatctgaatatttacctttagggtataagagtagtcgcataaagcaaaaaaatacaactaatgtgggagtaaaaagtgataaaagtgaacttgtctctgaatttttgaaattttctccggtcaaaagaccggagaagtaattgaagaaacagtgaatagggattaaacctcgagatagtcgagaataccggatgccgcctttctaccttccgcaatcgcagtaaccactaaatcagaaccacgaacagcgtccccgcctgcgaatattttaggattactggtttggaagggcaggttgctggcttcaggagcaacaatacgtccctgctgatcgagattgatctgatgcgcattcagccagtgcaggttgtgaggtttgaaaccaaacgccgtgataacagcatcggtttcgatccgaaattcggagccctgaatgatttcagctcgacggcggcctttttcatccatttcgccaagttgtgttttcgcgactttgacgccgcaaacttgacctgcgctattgatctcaatactgagcggctgaaggttaaactgaaaatccacaccttcttccttggcatttttcacttctcgacgagaacctggcatattgccttcatcccgccgataagcacagataacatgggttgcgccttggcgaacagaagtgcgcaggcaatccattgctgtatcaccgcctccgagtaccagaacacgctgacctttcatatcaacataaggttgttccggtaaagcggggtagcccattaaatgacgggtattggcaattaagaagggcagggcatcatagactccgtcagcaccttcgttttcaagtccgccatgaatagactgataagtacccacgcccagaaatacagcatcaaattgctcggtgagttcagcaagcgtaatgtctttgcctatttccgtgtttaagcggaattcgatacccatgtcggagaaaatttcacggcggcggatcatcacgtctttttccagtttgaaagcaggaatgccaaacgtgagcaagccgccaatttcagggtggcgatcgtaaactaccgcttgtacgccgttgcgggttaggacatctgcacaggccagccccgcagggccggctccaatcactgccacacgtttgcctgtcgggatcacgtctgacatatccggcttccagcccatcgcaatggcggtgtcgttaatgtaacgttcaatattgccgatggtaacagcaccaaagtcatcattcagcgtacaggcaccttcacacaggcgatcttgcggacagactcgtccgcagacttctggcaggctattcgtccggtgggagagttccgccgcttcaataatccggccttcattcgcgagtttcagccagttcggaatatagttgtgcacagggcatttccactcacaatagggattcccacatgaaaggcagcgatctgcctgtgcctcaacctgcatttcagaaaaaggttcataaatttccacaaattctattttgcggattttcaacggctttttcggaggatcgacacgctgtaagtcgataaattgataaacgttctgactcatttttaactccttactgcgcttgaacccgcaattctgcggaagaacggctgcggtgtcccaacaatgcactgacatcactggacttaggtttaaccagcgcgaatttattgacccattgtgaccagctttccagtatgctttcgccatgctgggagcccgtcaatcggacgtgttcggtgatcaatccacgcaagtgttctttgtgaatggccaaggtatctattgagagtacttcgaccaattctgggttgactcgtttgcggaaatcatcaaattcatcaagaacgtaagcgaatccgccagtcatgccagcgccaaaattcacccctgtgttgcccagaacacagacgatcccaccggtcatatattcacagccattatcaccgatgccttcgataaccgtgatagcaccggagttgcgtacggcaaagcgctcgcctgcatttccggcggcaaacaattttccgcctgttgcaccataaagacaggtattaccgatgatggtcgcttcgttacttctgaatgcagaaccaaccggaggtcgaatgacaatttgacctcccgccatgccctttccgacgtaatcattggcatcgccagttaatgtcaattcgacgccacccgcattccagacgccaaaactttgcccggctgtgcctgtgaagtgtaactttatgggatcggctgccagaccctgatcaccatgcaacgccgcgatttcacctgacagtgaggctccgacggaacgatcagtattttggatatcaaaataaagttttttactctgtgaatttttcacataaggcatagcctgcttgatgatatttttattcaaaataccctgatcaaatgacgggttatcttcagtacaatgcagatccttgccttcgtggggttgtgcggtttccagcagcggctcaaggttgagcttactttgtttggcagaaatgccttccaatatctgaagtaagtctgtccggccaatcagatccgttaattcccgtatgcccagttgcgccatgagctcacgtgtctcctgcgcaatgaaacggaaataattgatcacgcgctcaggcaggccatgatagtgagacttacgcaatttttcatcttgcgttgccacgccagtagcacagttattcagatggcagatccgcagatatttacacccgagggcaaccattggccccgtgccgaagccgaaactttccgcacctaaaatggcggccttaatgatatccacacctgttttcaatccgccatcaacctgaaggcggactttatggcgtagtccattggcgactaacgcctgttgcgtttctaccagacccagttcccacggacagccggcatatttcactgatgacagcggacttgcgcctgttcctccgtcataaccggcaatggtgatcaaatccgcataggcttttgccacacctgtggcaatagttcctacgcccggttctgaaaccagtttgactgaaattagtgctttcggattgacctgcttaaggtcgaaaattaactgagccaaatcttcgatagaataaatatcgtgatgcggcggcggtgaaatcagtgtcacccccggtacggaatagcgcagtctggcgatataaggcgtcaccttatcccccggcaactggccgccttcccctggttttgctccttgggcaacttttatttggatcacatcagcactgctcagatacgcgggagttaccccgaaacgtccggaagcgacttgtttaatgcgggacactttcttcgtgccataacgcgcaggatcttcccctccttcaccggaattggaaaaaccgcccagcgtattcatcgcctcagccagtgcttcatgggcttcagggcttagggcaccaattgacatggcagccgtgtcaaaacgtttgaacagggattcggctggttggacttcctcaatggcgatgggctctgctttagaagaaatagcgagcaaatctcgcagcgtcgtggcggggcggccgttcactagctgggaatatttctgataatcactgtatttgccactgtgaacagccgcctgcaatgtattgatgacatcggggttataagcgtgatattccccatcataggcatatttcagcaatccccccagctcaagggtatggcgatgtaaccacgcccgtttggatagattacgcagatcttgttcaaaatcgttgaaatctgccccttcaatacggctgacaacgccgttaaaacacagatctgtcacatcggaatgcaggccgacggcttcgaataatttagagcaacgataagaggaaatagtggaaatgcccattttggacataatcttatatagccctttattgatgccgttgcgatagttcagcataacgcggatatatggcgtgttgatcgtgccatcgtccaccatttttcccagtgattcatacgccagatagggataaaccgcagtggcaccaaagcccaatagtacggcaaaatggtgtggatcgcgggcgctggcggtttctacgatcaggttagcatcacagcggaggcttttctcaaccagacagtgctggatagctccgacagccatgggggcgggaataggcaatttttctggtgaaatatttcggtcagacagaaccagcaataccgctccgttgcggatcagttcttcagcttgtttgcataacgttgtgacagcacttttgaggctgctttcttgtggattaaacgtcaaatccagtatttcagcgtgatagtagggttcttgctgtgtcgtgagttgcacaaaatcagaatagagcagtacaggggactcaaaactcagccgatgtgcctgaccttctgcttcacaaaagacgttcatttcccgcccaatacgggtcgccagcgacatgacatgagcttcacgcagtggatcgatgggaggattggtaacttgggcaaattgctgccgaaaatagtcataaatgacacgtggacggctggaaagcaccgcaaacggagtatcatcccccattgagccagtggcttcctgtccattctcaccgagcacacggataatttgatccagctcttcattactgtaggcaaattgtttgtgataagtcgccagcatccgatcatctaaatcacgctgaccgatttgatcttccggcagtttctcaaatggggtcaattgtttgacatttttgtccagccactctttgtaaggatggcggattttcaaatcattatcggtttcagcggaatggagaatgcggccttcataggtgtcaattaccattaactcaccagggccaacgcgtcctttttctacgacttcatcaggttggtagtcccaaatgcccacttcggaagcacaagtgatcagcttatctttggtaatcacataacgggcggggcgcaggccgttgcgatccaaattacaggctgcgtagcgtccatcggaaatcacgatgccagcaggcccatcccacggctccatgtgcatggagttgaagtcgaagaatgcccgcagatcatcatccatatcaggattattttgccatgcagggggaaccagcagacgcattgcccgaattaaatccataccaccattgaggaacaattccagcatattgtccagtgaactggaatctgagccggtttcattgatgaaaggcgcggcagtttgtaagtcggggatcagtggtgtccggaatttataggcccttgctcttgcccattcgcgattgccggtgatggtattgatttccccgttgtgggcgagatagcgaaacggttgtgccagcggccagcgaggaaccgtattggttgaaaatctttggtgaaataaacagatagaggattccatccgcaaatccgccaaatcgaggtagaagcgcggtaaatcagccgccatgcacagtcctttgtaaatcgtgacgagattggacaggctgcaaacataaaagtcgtcattagtgatgcgcttctctatacggcgtcgggcaatgaacaaccggcgctccagatcttgcggccgccatccggccggggcattgataaaaatctgctcaatacgagggaggcttgacagggcaatcccgcctaaaatatcgcggttgatagggacttcccgccaacccacaatggacaaggtttcgttttgtaattcttgttcgacaatgtcacgacatgattgggcaattttggcatcctgacttaaaaacagcatgccgacagcgtagtttttggcgagccgccatgactgatcgctggcgatcatctggaaaaaccgatctggcttttgcattaataagccgcagccatcacccgttttgccatctgccagaattgcgccgcgatgctgcatccgagccagcgcatgtatggccgtgcgcacaaccttgtggctttgctccccttcaatatgcgcaattaatccaaagccacagttatctttttcctgcgatttatcatacaacatggtagagctccccaaggtctgtccgactctcacatcaccctcaaggtgatataggtatatattattgctacaggcgtctgatttgcgccctcagccaaagaccacttgctttattggcaataacaagcggtaaatcaaaatgatgttatgtcactgcataaagacactgcataaatatgagtcggagaattatccgacaggtgattttcagtggattcccaacttagcgagaaaaatagagcaggtcaaatcgtgccagatcgcgttttttgcaacgaaaataataatatttatttgaattaaaagaaaaataatcgttgttttgtattttgtgactgagatcattaatctgatgtattgtgagctatatcactaaatactgcatgataattattttaaatattcttttaaaattcattattgcgatattttaatcttaattcatgcaatataataggattaaattgcatattttatgttgactaagaataaataattgatttctttttgttctgaaagaatttttaaaataaatatcgcttaattattctgtttttatgactatttattcctgtaggtattggggtgatatccctcaacaaagttgagtttattttacgttatgattcaatctggtgattttacttggagttgttatgaagcggatcaggagatttgcccagtattatgtcgatttgatgatgaaattaggactggtgcgtttttcgttactgctagcatctgttctcattatccttgcgatggtgatacagatagcaatcactttacattggcgtggagaagtacaacgaactgatttaattggctccatcttttttggtttattgatcacgccttgggcggtttattttctttccatcgtggtggagcaacttgaagaatcccgccagcgtttatccagtctggtcgcaaaactggaggaaatgcgccagcgtgatgccaaattgaacctgcaacttaaagaaaatattactcaattaaatcatgaaatcaatgacagagaaaaagcagaaaaaacgcatctggtattgttggataaattaaagtcggaaatggaacatcgtgaaaaaacccagagtgcacttgagcagcaatcgattctgctacgttcatttcttgatgcttctcccgacttggtttattaccgcaatgaaaacaatgaattttccggttgtaaccgtgcgatggaactgctgacaggcaaaagtgaaaaacaacttatcggcctgacaccgacagaggtttacgataaagaagtcgccagtaaggtgatggaaaccgatgaaaaagtgtttcgtcacaatgtatcgttgacttacgaacagtggttggtttatcccgatggacgtaaggcctgttttgaactcagaaaagttcctttttatgatcgcgttggcaaaaggcacggtctgatggggtttgggcgcgatataacggaacgtaagcgctatcaggacgcattggagaatgccagtcgggataagacgacctttatctcaacgattagccatgagcttcgtacgcctttgaatggcattgttggtttgagtcgcatcttgatggacactgatctgacgccagaacagtgtaactatctgaaaacgatccatgtcagcgctatcactcttggcaatattttcaatgatattattgaattggataaaattgagcgccgtaaaacccagcttgataaccagcagattgacttcacgggctttatggctgatttggaaaacctgtcagggctactggcacagccgaaaggcattcggtttgtactagaaccaaaattaccattgccagctaaaatcttaactgatggcacccgcttgcggcaaatcttgtggaatctgatcggcaatgccgtgaaatttactcagaaaggtgagattcgggttcgcatctggcgtgaagaaggtgaacggctgttatttgaagtcaccgattccggaattggcattccttctagtgagttggaaaaaattttcgccatgtattatcaggtaacagacagtgcgggtgggcgtccggcaaccggaaccggtatcgggcttgccgtctctaaacgtcttgcccaaagcatggggggagatattgtcgtggaaagcaccgtggatcaaggttcctgttttacattgtctattgttgcccctgctgttgatgaaaaatcagaaggacaggaagaaagcgaattgccattgcctgcactcaacatcctgttggttgaagatattgaactgaacgtcattgttgcccgctccgttctggagaaattgggaaatagtgtcgatgttgccatgaatggccatgacgcattgatgatgtttgatcctgatgaatatgacttagtgttacttgatattcagttgccggatatgactgggctggatattgcccatcaattacaccagcgctatccaagccagtcacttcctccgttggttgcgttgactgccaatgtgttgaaggataaaagagaatatcttgatgtgggaatggatgatgtgctcagtaagccgctttctgtcaaggaattaaccgccgtgatggagaaattctggggtaaggcgtctgagcctgaacagacattacaggagacaaaggttgtgaagaagaacgaagatttacttgatacagagttgctcaatcaatatatcgacttggtcgggccaaaaatgattgctgataacctgaaaatttttgaaaccatgatgccaagttaccttgccttgttggattcaaacatgaccgcgagggatcagaaagggatcaccgaggaggctcataaaatcaagggagcggcgggttctgttggattacgtcacttacagcaattggcacagcagattcaatcacctgatttacctgcatggtgggataacgttcaagaatgggtggatgagctaaaattggaatggagaagtgatacagaaacattgagaaactggttaactgacgctacaaaaaaataaccccaaccgaagttggggtgcgcgaatactgcgccaacaccagggaaacttgtctacccgcttatctaaaatttgttttcggcgcgagtagttaaaaaactcttccgtactgaatacaggtaccaacatagcaaagataagattttttgttacaagattcattaaaatctgtgatgaagattggtgtttaaccctctaaggggttaagcattaatctactacaaatggagataaatatgaaatgcgttgcagttatattaagtggatgcggagtctatgacggaagtgaaattcacgaatcagtcctgactatgctctctttaagtcgcttgggtgccaaagtgtcttttttttcgcctgatgaagtacaacatcatgtaattaatcaccttaatggaaaggaggaaaaagaaactcgtcacacaatgcaggagtctgctcgaataacacgaggaaatatccagcctttatctcaggttgatattaataccttggatgcgctgatcattcctggtggttttggcgtcgctaagaatttatgtaatttcgcatttaaaggatcagaatgtgaaataaataaagatttattaagtatagtgcgttctatgcatcagcagggtaaacctatgggattcatgtgcattgcacccgttatggtagctaaaatattaggcaggccgataaaagtaaccatcggtaatgacccagaaactgcggcacaaatagaagcaatgggaggaattcacattgagtgcccagttgatgacattgtcattgattttaaaaacaaaattgtaactactccagcctatatgcttgctgaatctctatctcaggctgaacaaggaattgataaattggttcgcaaaatattggaaatgattgagtaatcggatgaaaaatcctttttcaatattgtggttctggttgaagaaaattgcggtagcgatcacaattctgtggttcgttactgtaattttgttttcgtttctgccggtgccgttttctatggtaatggcagagcgtcaaattagtgccttaatgtcaattaatttatcttatgtttcccgttcctcatgggtagatcagaatcaaatttcaccttatatgacattagccgtcattgcggccgaagatcaaaattttccaaaacattggggattagattttgaggctatcaaaacggcgatggcacataataaaaaatttcagaagcggatacggggtgcttccactattacccagcaaaccgccaaaaatttgtttttgtgggaaggtcgcagttgggtgagaaagggattggaagcaggaatggccattgttttggaattattatggtcaaagaaacgtattttgacggtctatctcaatattgccgaatttggtcatggcatttttggtgtggaagaagcggcatggcattattttggtaaatcggccagccgtttaactgcctctgaagcggcattactggcagcggtgttacccaacccttatcgttataaagttgatgcgccctcagcttatttgttgcagcgtcagcagtggattttgcagcaaatgcgacagctagggggagaaagttatctgaaacaaaataaattgcgatagcgagatagcaatgagatgctcaaataaaagcggcactgacttgtgccgctatacgtacaggtgatgttcaacgggatctcaattgagataagtgaatgccgttgttacgcgcttaacaccgctggtttcactggttatcttcgcagcatctgcaccttcctgtctggtgacaataccaaacaaaaagacttcaccattttcagtaacgaccttgatattcgatgacttcactgaatcactggctaaaatcttggaacgtactttggttgtcagccaagtgtctacagaggccgtacccaggtcaacaggattaccttgacggacttcgttatataccacttcagtgccttcaacctttgaggcgagctgttttgcccgatcagccagttgcagatccgggctctgtcccgttagcagcactctaccctgataaacagtcacaattatgcgggcttgtgccttaatttgcggatctttgctgatggcattgctgacgcgggcttccagcgtgccatcgtcaacctgttgaccaattgaccgggggtcactacccgcttttgtcgcaatcgcggcagaacccacgacggcggcaccaatacatccctgcaataacattgcactgcaaaatactattaatagagaaaatagccgcattattgagctccttagtcatcctgatgaggaaataacgtattatcgattaagtcgcacagacagttaattgtcagcatgtgaacttcttgaattctgatactgtgatgcgaagggatgcggatttctacatcctgtggtcccagtaagcctgctagttcaccaccatcataaccggtcagtgcgacaatcgtcatatcgcgcgtgacagccgcttccaccgccttgatgatatcccggctgtttccgtgcgtagagatggcaagcagaacgtctccagcatgtcccagcgctctgacctgtttggcatagatttcgtctggctgtttactgttggcgatggaagtgatcaccacgttatcagcattcagagacagagctggcaggcttggccgctctgtctcaaatcggtttatcatactggcggcaaaacgctgtgctgtcgcggcagagccgccattgccacagcaaaggattttgttgccattcagcagtgattgaaccatcatcattgcggcgcgtgatatcgcgtcgggcaatgcttctgctgctgcgatttgagtttgaatactttctgtaaagcagactttaattctatccagcacgttatgacctatatattaagaatctattttatttagagagtgatagcctatatacccttcatctttcaagctgctacttgaaatctattgggtatagcaataggttttcattcaggtgaaggcatttttcagccattcaaatttctgacctgtaattgcacaaatatcaaagcgacacgaggccgtctccagacactcgttgcgttgatacagccagacagaagctgtatgcaatatttttctgcacttgctctgggtaattgtagcaatggcatcaccatatgttgcgttctggcggaaacgaacctcgacaaatacccatgtctgtttatcacgcataatcagatcaatttccccaccccgaattttcacattctccgcaacaaagacaagcccctgttgttgcagaaactgtttaacctgctgctcgtaatggcgtccctgcgcatagcgattgatgcttggttttttcatcctgaaatgaccattagtgttacttatggcattaattgtactgcgttactgctgtcagcgcttttattaacggtgctgtcaacagtggcatcaatattattggctgcattattctcgataatgatgcggccattgttaaactgcatccacgctagatggcgtaatattgtacaatcatttgtaacggaaagctctcccgacgcccccttcatatggaacccagtgccttgctgtagctgtgtaaactgattagccagtgaccatgcatctatgcccatagcatagagacgcatcagggaatagtcattggcaaatttactggcggcttgttgcattaatggcaaattgacgcctgtcagcaatggaatgtcactaaactgcatgccgtccatttccagacggaaatccggcccgacacccgccttattactgcgtgaattagcatagagcgcgggtttcttacgggaactgattgccatatcgatcattggcttgatgagagtcagttcatccgttgtcgctgcaatgtaaacggcatcgacggcaccactggcagaatttgtaggggcgcttgtggcgatcaccgctccgttcgttttgagcggtgattcccccgcatccggcaggtaagcactgactggaatgggcgtaccagataaacgaatgccaataccccgattgatggattgcttcatttcacccagtgttccgaaagtctgttgcaaagccacattaccgcccaatttctgccattcttctgcgaaggctttagttatccgattacctagctcgttacgtggcactaatattaatggattgcgtttttgttgctgccagagatgtaaagccgcattttgcgcctcattttcaggagacagggagaaatagcagatattaggccgcgattgtgaaacgtccagttcgttgagggcgagaatgttcaatagcgtattaatttgtaccaattgttccacactcggtttcagcaatggtccaacaaccagcgtaataccatcttgttcagcttgtgccagcaggttggtgagtggttggctgttggtatcatagactttcaccggctgatcgttgacggggacagcagcaatagtgtttgaaattgccgagactggagaagatgacagtgcggtttcagtcgtatttgctgctacccctgcttctggcgctgatacggtagcatttacaggcaaagttggctgtggcagtcctttttgtgcatcaaggaagccttgacggattgcctcaccgaacacttttgcctgaccgctcagggggaggaatagcccgataatggcatggctgtcctttggcttgagcagcatttgttgcagcgaagtgggcaaactacggatagcagggttatctggatagcgggtacgccagtcagtgatggcagtacgtagcttatctagatcttgtttattgacgtgataggcattgagtaggtcaagccagccctgaagcgtatactcattggcattaatcaccagttcgcccaactgttgtggggaaagatgcgtcagtacctgccatgtatcatcaatgtttttctggtgagcagcgtcgtctgcggtatgtgtttccagcgcaatataagcgcggataacatccagagacggttgattatgagctgcatcaataatggactgatagcggttaatctctgcgctgatcttgtcttgtggcttagaaggtggttgcccttgctgttctggcgtggtacaccctgcaataatcatagtcgacagcagcgctgtgcagactaaaccagttttgaaacgcacaaaaattgagggaagcatactgtatccagtgatgtttttttcaaagatgctcaattttaaatcggtcattcggatgaaacaatgaatcaaaccaatcgagcagtggttacgacatccacgctatatgttgtgccaacccctatcggaaaccttggggatatcactcagcgcgcacttgaagttcttaaacatgtcgatctgattgcagccgaagatacgcgacacactggcctattgcttcaacattttgccattaatgcgcgcatgttcgcacttcatgatcataatgaacagcagaaggcagatcaaatacttgcgaaattagagcaaggtttgagcattgctctcgtgtctgatgcaggaacaccattaatcaacgatccgggctatcatgttgtccgccgttgtcgtgaagcgggcattaatgtggttccactaccaggtccctgtgcagcgatcaccgcgttgtctgctgccggattgccttctgatcgtttttgctacgaaggttttctgccggcaaaaagtaagggacgccgggatacactgcgcgatttggcgcaggagccgcgaacgctgatcttctatgaatcgacacatcgtctgttggacagtttagaagatattgtggaagtgtggggcgctgatcgttatgtcgtgttggcacgggagctgaccaaaacgtgggaatccattaagggtatgcctgtgggtgagcttttggcatggatcagagaagatgaaacccgtcgccggggagaaatggtactgattgttgaaggctatcgtaaaccggcggaagattgcctgccgccagaagccctacgaacactggaactactacaaaaagaactgcccttgaagaaggcggcggcattgacggcggagattcatggtgtaaagaaaaacgcactgtatcgccatgcccttgagcaaatcgaagaaggtgcgtgaaaaggcctatacatcggatatcaaaccccttataatccgcgccggagttgactagacagtcgctgctttaccgctctccttcgggagatgtaaaggggaggaaagtccgggctccacagggcagggtgccagataacgtctggggggtgaaagcctacgactagtgcaacagagagcaaaccgccgatggcctacttttgtttgcaaaaataagggtgggatcaggtaagggtgaaagggtgcggtaagagcgcaccgcgcggctggcaacagtccgtggcacggtaaactccacccggagcaagaccaaatagaggttcacatggtacggcccgtactgaacccgggtaggttgcttgagccagcgcgcaagttctggcctagatgaatgattgtccacgacagaacccggcttatcggtcaactccaccagattcagccctatagagctttggctttatagggcttattctttttctgggcagatgaaaaacgtgctgtcagagtatgagaatcagccacccaaatcgattagcagcccctgaaatggtgtgtctgcccgcagttttagcagcaattcttcctgaataaataccccatccccacatttgatttccacgttggcatgattgctgccgctgatttttgcattgccacggatggattgcagataagcattttttccccgcaaaggcagagtttgtatatcgctggtcttgatcaccagataacttacccatacctgttggcgcaggaacatgctcttgttttctgacgagggagaggccagtaatgttaatggtcggtttggcagtactgtgcgttgcaacggtagcggctcctgttccggacaggcattgagccagagttgcatgcgtgtcagcgggatttcatcgctgatattatgttcactgtagcgaatgtcctgacgggcggaaaacagcaggcagtctccttggcgtgcatgaatatgacttccctcactatcccggtattgggcttcgccttgcaggataatattcagaatatcgacgtggggatacgcttttggctgaaattcagccttaggcgcaaggacttcctgattaaggacgcgcaatgcgccatagttcaaaaattttgggtcgaaatagtggccgaatgaaaaagtatagcgcgctttgagccagccataatcggctttaccgcattgatttgctgttctagttattatcatgaccgtcatctctttgccaatatgcccttcatctttcaagctgcaacttgaaatctatggggataaacctaattttgcctgatcttaattatctggacgttgaaatgttagccagttaatctggttgctatattcaaaattactgattgagaaaattatgggtaaagaacgggcgcttacattagaatccctgcgcgttatggatgcgatcgaccgacggggaagttttgcggcagcagcggatgaattggggcgtgtgccttctgcattaagctataccatgcaaaaattggaagaagagctggatgttgtattgttcgatcgatcgggtcatcgcacgaaatttaccaatgttggccggatgttgctggagcggggacggttattgctggaagccgcagataagctcacggcagatgcagaagcccttgcccgtggatgggaaactcacctgactatcgtctgtgaagcgttgtttcccgttgtatcgctgttcccccttgtggataaactggcgaaaaaatcgaatacacagttctcattaatgacggaagtgctggcaggggcttgggaacggctggaaacagggtatgcggatattgttatcgcaccagatatccatttcaggccctctgcggaaatcaattcacgtacactttattccatcaataacgtctatgttgccagtgtggatcatcctatccaccatgaacccgaacctttatctgatgccacgcgggtcaagtaccgtggaatagcagtcgctgatacagcaagggagcgccctgtgctgacagtgaaattattggataaacaagcacggttaaccgtcagtacgttagaggataagcgtcgtgcacttttggcgggtttaggggtagcaacgatgccatacccgatggtagagcaggacattgccgaaaaacgactacgggttattggttcggaatacagccatgaaaccaacatcattatggcatggcggcgcgatagtatgggcgaggccaagtcgtggtgcctgcgtgaaatacccaaactgtttatgaagcaataaaatattcatgaaatgaagcccctttactgagaatccacagtcaggggcttttggcaatagaggataattttgaaatggccggcaattaccagtttttattcagtgcgcggtcaatactgaattttccaggccccatcatcgccaatagtagataacctgcaccgatggccatatttttcaagaacattgtttggttcatgccatctgaaaaatcgctgtggaacagaagtgctgtcagaatacagaaaataaacgtaaataccgcagtggtacgcgtcagcagaccgaacaatacggcaaggccaccacccagttcaagtaagatagtgagtggcagtaaaattcccggaactttcattgcctccatgaactgctgtgtccccgcataagcatcacccagcttcccatatcctgcgataatgaacagggttgatattaaaatgcgagccgccaacaggctactatcttcaaattttttcatgaacatctccaagatacagaaggcaatgataataaaaggtctgtttatatttttaatgaccaactcatgagctaaaaaacacaatttgttaatcatgagttgatggcaggtattctaaggagagaggttatttgttgatagtaaggaatattaacaatttattgcagtttttttgaaggaattacctgacatacgaaaaaggatttgaaagagaataagaaaaagacgagagatgaaaatagcattagcgctcgttcaggtttctgcgtggacactatcgtgaatttgaccacccgaaagctcaaaatgaacagagaatgctcgttctcatccggtaaagaatgctttccaaggtcaaacggtgttcaggtttgtctaaacccatccggtgtgttgcatcaatgcagatagcttattccaatggagatcggttaacatagctcgcggcatgatggtgagggctggttgttttttggcgaaagtaattatactaaatcatcacgctgcctaataatcccttgcaaaacgtcaacacgccctattatattgttaatgtaactgtccgtgtttatggaatattaattgatttcaataaatgagttgggtttatgctctggaaaatgaatcttgtttttttgaacataaaccttcaattaaaatctcttttctgtcctctcttcgaaagataattacaatggttcttcactttccgcaatcggcctgtccccgaggctttttaaggcctgtaatttctccggcggagtactgacacaactggccagtgacttaaacatttcgtgattgcataccttggggtttgaggtccattggagcgaaaaacctacgtttaaagagtaacagtctgatatatcaacctatgaaagatttcccaatgatgaaaaaatttgtaatcaataccttggcctttgccacaatagcaacctctccgttttatgcctcagcacaaaaaacactgacggcgcaacaggttgaaaaaattgtcaatgatacgcttacgccgctgctcgaaaaacaggatattcccggtatggctgtcgctgtgatttatgatggaaagccgcaattttttaactacggcgtggcggatataaaaactcaacgcccgataacggaaaataccctgtttgaactaggttcggtcagcaagacctttaccgggatcgccgggggatatgccatgcaaaccgatattctaaatcttaatgatccggtgacggcgtacagtcctgagctaacgggcagtcagtggcgggatgttaaaatgctgcatctggcgacgtacactgcggggggacttcctcttcagctcccggattcggtcacggatcagaagtcattgtggcagtactaccagcaatggaagccactgtcggcacctgggatgatacgcaattactccaatgccagtattggcttattcggtgcgctggctgtaaataaaagccagttgacatttgaaacctatatgacgaagtatgttttcctgcctttaaaactgacgcatacttttataaccgtccctgaatctatgcagtcagattacgcgtggggatataagaatggtcaaccggttcgcgtcacaccgggcatgttgagtgcagaagcctacggggtaaaatctaccacgcaagatatggtgaaatatatgcaggccaatatggctccggacagcctgcctgccgataacgataagttaaagaaggctatcctcgcggctcagtctcgttattaccaagtgggaaacatgttccagggattgggatgggaaatgcataactggcctatcaatccgcagagggtgattgccgacagcaacaatgacatcgctttacaaccgcgtgaggttgaggcactgataccgccacgctctgccgtaccggcatcctgggtgcataagaccggcggtaccgatggctttggagcttatattgctttcatcccggaggagaaaattggcattgtaatgttggctaacaagaactatccaaatcctgtccgcgtggaagctgcgtatcatattcttaaggcattgcgttaagggtgatgctgtgtcggataagcgcggtctggtaacaggctgccttatctgacggaagtagttctgctaattttgcttatataaaaacgctcaagttttgaaggcttttattttttatggcacagagagagcaaaggactgagcgatacatttatcttgattggctataaaactaagattggagacgggaaatttaggttattgcgaccgataaaaccgacttaatccccctaataaatcccaaaaggctaaccatacggcgtgacccgcgataaaacttcatgggatggcatatcccatagatcagtgcgatacccgagccaatggcgacataaggcttgaaggcagatagggtttgccaacctctgtcataaggctgagtgatatcaagccagtgttgggtacactctgaaagtgagtgccgttgctgctgtatttccagtaataactgctgttttcgccattctcgctgttggcaccgtgacttattcatgatggtcatcctccagcattttgcgatctatttttagctgttcacgggttgaattgaaaaaaatcagctttctgcttttcctgatcgtccatattgcaccaaatacggcaagaatcagcagaatgcctgcggtaatagccattgccgttgctcgataaacaggatcaatgacccagaatatcaatattaacaggcacatcaggccaaaggtcgcaagtaatagcgtgaacccaatcagcagcagcaactgcaccagcgtggccgtattttcttccaactcaacggctatgagccggatacgggtttcaaccatgctaacaacaatcgctgccactcgtcgtaaagtatcaaagatccctttgccggggccttgtgaacggggtgattggatcatctcagcgttttgccagtagaatacctaacacaacaccaactgctgcaccgattcctacacctgtccacggattgtcacgaacataattatccgcacgacctgccatttcctttgtttgatcgaccaacttatcgctggcatcactgagcgtgactcgcgcatctttcaacgttttttctgctttactacgtagtttttccaattcagccttggatttgtcaccggaactattgagaacttcttccagcgtatccgcaagggattgcaattcagtacgtaaatcttcagagtttttcttctgcgacatattatgctcctgaaatatacgatggatgaatttctaacatagtctcttttataaggagtttaaagcacagatgtcaaaaatcatcctgttcttcctgagattaatcttaaattctgtttgacagatagctattggataaagaaataggaaggccagttgaggaggaaatttaccggaagttcaataccctgtggtatgttttggctcgataccacagggaaaagccagcctttgtattggcagaagaaaaattatcacgacaggatattactgaggaggatggttagcacgtctcttacgccagatgaccgtcagactgccaattaagccaatgagtagcaaacccagtggtaacagaacgagaaaattcatcacatattcttcgtattgacggaaaagcggacttttgccaagaaaataacctaaagtagttaatatgatgacccacaggaacccacttaaccagttgaaaatctggaaacgtccgtttttcagcccagcaattcctgccagtgttggcagcagggttctgacaaatgcaaggaaacgaccgatcagcagtgcagataaaccgtggcggtggaacagattgtgcgcacgttggtaataatgagtgggaagatgtgacagccagccttgaaccaatttggtattaccaagccaccgtccctgaagataacccacccagcaaccaaggcttgctccggcggtgagaatgaatatcgtcgcggggaagctcatggcatcttttgcgatcaaaacgccaactaatatcaacaggctatcgcccggtaaaaaagccgcaggcaatatcccattttccagaaacaggatcgtaaatagcaggatgtagattgcccatactaatgatgggttagccagtgtttcataatcttggtgccaaagtgcataaatcaagtctgttacaatttccatcaaatgttcctaaaacgcggattaaggattacatcttacttttatggtgtatttctggtgcattcctgttgggtactttgaaaatacaaaatattaagtaccgattgtcataaaataccctcgaacttctttcaaaatggcataaaaactaacagggacactctaacaaaatcagcagtagcgagacaggaaattttggtgaccaattgaacattcattcaaatgtaaaagtaaattcttcgatatatatcaattgattaattattgggtgaagttttcccaaaatagcatgatttaattatttatcatgtggactgcttgaatttatgtttttttattatgcttcacaccacaccgttgtatggctgcaatcagaatattgccattccgatcacacaaatgtaagcaatttgttatcaaatattgtgttgtctgtatatttcaattaattattcgttttagtttttttcatttccctatactggggaagcaaacacaaaaacaacaggctcattgagccaaaaaatatcaaatgggtgggctatggaaaaacgacaaaaaggctttgtgcaatatattgtacagggaagccttgtcactcaaattattattggattaattgcagggatattattggcatggctgctaccttctacggctcaatcggctgatttgcttggctctctcttcgtaagtgctcttaaagctgttgcccctgtgttggtctggatattggtgatgtcctcgattgcaaaccataaaaaaggacaaaaaaccagtattcgcccgatcttgatcctttatctgcttggaacattcggtgcagcggtcgtggcggttatcggcagtacgttgtttccgtcaacgctgatactggtgactactgatgccaaaatttcaccgccagacaatatcgttgaagttattagaggaattttgcttaacatcgttgttaacccgattgatgcgatattaaaaggcaattatgttggcattctggcatggtcaattggtttaggtattgctttacgtcatgccaaagaatcgaccaaatctctggttcaggatctggctgaggctgttacgcagcttgtgcgtgttgtgattcgtctggcacccatcgggatctttggtctggtggcttcaactattgccacaaccggcttcgaagcactgcttggctatgttcgactgctggctgttctgcttggctgtatgattatcgttgccttagtgattaatccgctgattgtttactggacaattcgccgcaacccttatccgttggtttttgcctgcctgcgtgaaagtggtgtgacagcattctttacccgtagttctgcggctaacattcccgttaatatggcaatgtgtcgccgtatgaatctgaatgaggatacctattcagtttctatcccattgggggcaaccatcaatatggcgggtgcagcggttacgatcacggtgctgacgctggccgcagtcaatacactggatatgacggttggcctgccaactgctattttgctgagtgtggtttctgtgattggtgcgtgtggatcatcgggagtggcgggtggctctttgttgttgatcccactagcgtgcagcatattcggtatttccaatgaaatcgccatgcaagttgttgcggttggtttcattatcggtgtgttgcaggattctgccgaaactggcctgaattcttccactgacgtgctgtttaccgctgcggcttgtcaggcagaagatgcccgtcttaatgcggatcagttggctcaacgttaatgattgtctgaaataaaaacggtggtaatcagcggatagctttttatcaccgtttctacatttaaggtctaaaacttgtgcagctaaatcttaagcgccaatctggctccctgatcaattgctctgcgggcatctagctctaccgcgacatcggcaccaccaatcacatgcacattcttccccatcgtttgcagcggctgataaagatctttcaatggctcctgccctgcgcagataatcacattgtccacttcgagacattgctgttcaccgttgcgactgatatgcagcccctgatcatcaatcttcaggtactgtacgctgttcagcatcgtgataccccgcatcaacaggctggcgcggtgaacccacccggtggtttttcccaaaccttctccgactttcgaattcttacgttgcagcagataaatttttcgtggagaacgttccatttgtgccccttctggctgtaatccaccacgatgggagagagtttgatcgatgccccattcttggctaaacgcatgactactcaagctggtgctttgcccattttggctcaggtattctgccgtatcgaagccaataccccctgcaccgataatggcgacacgtggccctacattgcatttatgtttcaatacatcaaggtaagtcagcactttttcatggttgatgccatcaatatctggcgtccgtgggatgatgcccgtggcaatgacgatctcatcaaacgacgcaagctgaccggctgttgcggtgtgattgagctttacctcaacaccgtttaatgccaattggcgatcaaaatagcgcagcgtttcgtaaaactcttctttgccggggatctgtttggcgatattaaattgcccgccaatcttattgtcacgttcaaatagcgtgacatgatgcccttggctggccgccgtgacagcaaaggacaaccccgctgggccggcgccaatcactgcgatagttttaggttccttcactggctctgcgatgaattcagtttcatggcaggcgcgtggattgaccaggcacgaagtcaacttcccgacaaatattctgtccagacaggcttggttgcagccaatacacgtattgatttcgtcagcgcggttttgctcggcttttaaaacaaattcagcgtcagcgaggaaagggcgcgccatggaaaccatatcggcacagccttcactgagtgtctgttcagctacatggggatcattgatacgattggtagtaatcaacggaatgctgacttttcccattagtttttgagttacccaactgaagccggctctcggcaccattgttgcgatagttggaatgcgagcttcatgccagccgatccccgtattgatgatggacgcgccggctttttcaatttccttcgccagttgttcgatctcttgccagtcagaaccttcttccactaaatccagcatggagagacgatagataataataaactgttctcctgtgatggcgcgggcagctttaacaatttccacggcaaaacgcatacgattttcgaagtttcctccccacttatcctgccggtgattagtgcgggcgaccagaaactgattgatgagatagccctctgaacccatgatttcgacaccatcatatccggcctgttgtgcgagccgggcgcaacgtgcgaaatctctgatcgtctgctggatatcttcctcagacatttcacggggcttaaaaggattaatcggtgcttgaatggcagaaggagcaacaaggtttttctggtagctgtaacgtcctgtatgcaagatttgcagggctatcttcccgcccgcctgatgtacggcatccgtgatgacttgatgatgagacagggtatcttcattattcagaatacttgcaccggctgtaacaacaccctgtccgtttggggcgataccgccggttacaatcaatgctacaccgccagccgcccgttctgcatagaaccgcgccagtcgtcgggcaccatcgggatgttcttcaagcccggtatgcattgaccccatcaaaacacggtttttcagggtggtaaagcccaaatccagcggggccagcaggtgagggtaattgctcattgcattctccatcgaatatttggtgacttaaaagtattattgttttcagtatgactaagtggtcggatgagattgagatcaaatttagacggttccagcctgattggaaccattttgttaagcgattgtgacaagtatcaagaaatgatgtgccagtaaaaaccgttcttcaaattctgggatttaatgtgaatatatttaaaaatagttcagcgtttcttttatgccgatgatattttaatctttatggcgtatggatggagttgatccctctgtataggctgcttggatgaaatcgagaatattggagtgagcatgaagaaaataaccgaatgggtcatattatctggaaagttcgttactctggtgcctttggaacataacaggcatgatgaatttgtgcgggctattgaagaggggcaattgcatcagctgtggtataccaatattcctgaacccgctaatgtgaaggctgatatcgaacgccgtttggcgttgcatgaacagggcagtatgttgccttttactgtgattgataaccaaaccggtgtggcagttggcatgaccacctatatgaatattgatgccaaaactcccagactggagattggctcaacatggtatgcacgttctgcccagagaacgcctatcaatacagaagctaaatatctactgctggaatatgcgtttgaacaacttggcggtgttgccgtggaatttcgtacccattttctgaatcaccaaagccgcagagctatcgagcgtctgggtgcaaaactggatggtattctgcgcagtcacttgcgtgcaaaggatggttcaataagagacacttgtgtatacagcatgcttgccagcgagtggcctgccattaaaactcatcttttatggctaatggcaaagccacgctaaacacgcgatcaagtatccccttttgatgataattaatcagtcagggctgctttgatatggttatccagctcgtccagcagttggtaacggcggcgatattcggcgcgtttcttgctggcgatttcttccagggatttcctttctatggctgatggcagatggaaatcattattttccttcctgataccattcagggattcccagaaggcgttataatcggccaccatcttatctttctttttatgccaatagcggatactgcgataaatatgtgtctcattgctgaccgccaagatctgctcacaattcgcatgagaggcaaaacggcagatggattcaatcaacaaacgtttaggaaataatccataacattctttggtggcatggcggataatatccagagaactatccattttagcagggccttgtaatacaccaatgaataatgtttgcttacccttaatcgtcaataaagtgaatgcgcatttcgccagaatgacattttctgttgtggtaatatataacgaaagctcaccttctttattaagattatccaatgaatcaatatatatcatgaatgattcatttttaccctgaaccgttgccagcaaataagcatgagtatcaaatattttgttgataacagccggctctaattgttcaaataatatcttataatgttcattaagtgcacaaacaatctgtttacgcttgaaattgatgctcaaatatggacgatgcaatttgcagggcaagctgggttgcttttttaaaatatccttataaagcggtgtcttagcaattttatttaaaagcttaagtgtagaaataggcgtaaaaatgctgcgcagagcgaatttagttcgataactggaagaatgccagtattcaccgggggtaacacgctttccgacaagatcagcaaacagcttcatacctgaagaagcaggttgttgtagataattcattaggattaaactcaataactaaaaactttgccaagtatatcattgattcactcaatgatattaaaacgtttgtaaatcatttaattactttaaatttctttatttaatgttttttatgcagacctttgttgataaatcttattatttatttaatgttattaaagaggaatttattagtattaatggttagaataaataaaattatattaatatattcatataaataatgagttatttattttatattctttataaataagatgtaattgttaatatatttgagtaaaattgtaatttattctccagaatagcccaatttgctgtttaacattctgggctatcaatgtggcttattcttgtttgtctaaaacggaaatgaatatcggctgaatttaagcgagtttcatatgcaatagtggaaatggattcccttgcccatcgactgctgaacgggcaaaaacctgaaaccccatatgcttatagaagccaacaccttgttcattctgttcgtttacatccagttcgttgatctgcaattcagtcattgcaaatgccagcagcatcttgccgatcccttgacctcgtgcctgtggtgaaataaatagcatttctactcgttgttgatcgactgccacaaatccttcgatgatatgttgatcatttacaaccttatagatgattaaattgggtaagtaatcattcaagataaggggacgtagatcttcaattatagtttcaggcagaaaatcatgggtagcacgcacagaggcttcccaaatctggataagaatcgcgaaatccgtttcagtggcttgctttaaatacatcatatatctccgcagattatgccttggtttagccactagtttgccaaaatatggtctttacggcgcaggctcgccagtagcatataaatagcagtggccagtaagacaatgaaaaagaaattcattaatccattgtgttgcagcataaaattccctgcgcccagggggccaatggaggagccgatactgtaacttaacagcatcacttgagttgcagccacaatgcaggatgaatccagattatcgcaggccagcgtgatggcgatcggatagagtgcaaaggaagacattcccagaagccccaatgccacgatcattacaatataattttcagaaaggtagatcattcccatcgcaaacacgccgagtagtgaaaccattgccagtaacagcgttttgctcactatgacagacagtctactgacaatgggctgaatcaccattccgcccaaaatagtcgcggccattaatacaccaacctgctcaccatcgaagtggctttggcttaacgataaaggcatcagaccgtaaatcgtccccatgacaacccctgacgtaatacaaccgactatcgctggtttgctgaattgggcaatttttttcagcgataagctctgatgctggagagcgggaggttgcccttggcttataagtaatggcggcaggatggctagcaatagcagagccagcaccacaatgaaaggcactataccctgagtccctataaagccaatagccagctgacccagtgttgtaccaccatagagggaagtcatgtaaaaactcagacgtttggcccgttctttagggctatcacccattaacaaccaagactctaccacgacaaaaatccctgcaacggcgatccccgccacgcagcgaataaccagccagatctctttagtcggaaaaaaaggcaaaacaacaaccgtcgtggctaaaagcagcaaaaaactaataaatgaaaagcggtggcctattttggcaataacaggttcaatcatagttgagcctattaataaacctacgtaataagcgctggccaaccagctggcataacccgtatcgatgctgaaacttgccatcgataacggaattaaactcattaagtaaccagaagcaatcgcaaataccgtcaagcctgcgacaggtacaaatgcactgtcattgttgcgcagcagtttcactactgtcgtctccacataaaaaatcagctagatatgcgctgcttctcatcaaaattttgccgaatggcggtaacgatatatgccagggattgggatatatcttggtgatttaagcagtagataagtcgctcaataaccttgagcgctgcggactatagccctttactccggagagatacaatgagaaaaactgatactcatgaatgaaaagattcatgaaagagtgggggaaaataattagtcaatgttgggttaaggcgcattgaccttttgctgttcaatcgatttgactggaacaaaa

SEQ ID NO: 14975 - DNA, 87097 bp, Xenorhabdus bovienii
  Genomic contig Name=Xb4151_4152.C434
cctgctccggtcggaccgctctttaacaatttaatcagacaatctgtgtgggcactcacaagacagtatcgacagcatcgcaagatgccgaaaactttaaagtcttaaagagtgactaaaacagttaattcattacgaactaacagtaacaattctttgagcatcagacttttaattgaagagtttgatcatggctcagattgaacgctggcggcaggcctaacacatgcaagtcgagcggcagcgggggggaagcttgcttccctgccggcgagcggcggacgggtgagtaatgtctggggatctgcccgatggagggggataaccactggaaacggtggctaataccgcataacctctctggagcaaagtgggggaccttcgggcctcacgccatcggatgaacccagatgggattagctagtaggtggggtaaaggctcacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcaacagcgtaaatagcgttgttgattgacgttacccgcagaagaagcaccggctaactccgtgccagcagccgcggtaatacggagggtgcaagcgttaatcggaattactgggcgtaaagcgcacgcaggcggtcaattaagttagatgtgaaatccccgggctcaacctgggaacggcatctaaaactggttgactagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatcctcagaatctgccagagatggcggagtgccttcgggacctgagagacaggtgctgcatggctgtcgtcagctcgtgttgtgaaatgttgggttaagtcccgcaacgagcgcaacccttatcctttgttgccagcacgtgatggtgggaactcaagggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacctgcggttggatcacctccttacctgaatgatagtgattgtgcagtgtccacacagattgtctgatgaaaatagagtatcacggtataggcttgtagctcaggtggttagagcgcacccctgataagggtgaggtcggtggttcaagtccactcaggcctaccagacacgttgactcctggccctttccagggtgacccggtgcggatgcagcggtgttatctgcgttgaaacggcgggcggggaaacggtctgcacagttgtctgacaggccggtgataacactgtatggggctatagctcagctgggagagcgcctgccttgcacgcaggaggtcagcggttcgatcccgcttagctccaccatacaaatcatttcagaacccatggggaaaacacccgtgtgttgtgaaatttttgctctttaacaatctggaacaagctgaaaatttgaaacaatcagtgccgtcatggacgggactggtgagtctctcaaaacgcacacccgaagacaccttcgggttgtgaggttaagcgactaagcgtacacggtggatgcctaggcagtcagaggcgatgaagggcgtgctaatctgcgataagcgccggtaaggtgatatgaaccgcaataaccggcgatacccgaatggggaaacccagtgcaatccgttgcactatcctggcctgaattcatagggtccggaggcgaaccgggggaactgaaacatctcagtaccccgaggaaaagaaatcaaccgagattcccccagtagcggcgagcgaacggggaacagcccagaaccaacatcagcatcagcgtcaggagaacggtctggaaaggccggcagtaaagggtgatagccccgtatctgaagacactggtggtgtgagttcgacgagtagggcgggacacgtggtatcctgtctgaacatggggggaccatcctccaaggctaaatactcctgactgaccgatagtgaaccagtaccgtgagggaaaggcgaaaagaaccccggcgaggggagtgaaatagaacctgaaaccgtgtacgtacaagcagtgggagccttgatttatcagggtgactgcgtaccttttgtataatgggtcagcgacttatattctgtagcaaggttaaccgtttaggggagccgcagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatcttcgggggtagagcactgtttcggctagggggtcatcccgacttaccaacccgatgcaaactgcgaataccgaagaatgttatcacgggagacacacggcgggtgctaacgtccgtcgtgaagagggaaacaacccagaccgccagctaaggtccccaagtcatggttaagtgggaaacgaagtgggaaggctcagacagccaggatgttggcttagaagcagccatcatttaaagaaagcgtaatagctcactggtcgagtcggcctgcgcggaagatgtaacggggctaaaccatgcaccgaagctgcggcagcaacacttaggtgttgttgggtaggggagcgttctgtaagcctgcgaaggtgtgctgtgaggcatgctggaggtatcagaagtgcgaatgctgacataagtaacgataaagcgggtgaaaaacccgctcgccggaagaccaagggttcctgtccaacgttaatcggggcagggtgagtcgacccctaaggcgaggccgaaaggcgtagtcgatgggaaacgggttaatattcccgtactcggtgttactgcgaaggggggacggagaaggctagaccagccgggcgacggttgtcccggttcaagcgtgtaggtgggaagaattggtaaatccgttcttccgtgaacactgaggcgtgataacgaggcactacggtgctgaagtggttgatgccctgcttccaggaaaagcctctaagcatcaggtaacagtgaatcgtaccccaaaccgacacaggtggtcaggtagagaatactcaggcgcttgagagaactcgggtgaaggaactaggcaaaatggtgccgtaacttcgggagaaggcacgctggcgccaggtgacgggacttgctccccgagccgaggccagtcgcagataccagctggctgcaactgtttaataaaaacacagcactgtgcaaacacgaaagtggacgtatacggtgtgacgcctgcccggtgctggaaggttaattgatggggttagcggcaacgcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaaccttgaaccttgatgtgtaggataggtgggaggctgtgaagtgcggacgccagtctgcacggagccatccttgaaataccacccttgaatgtttgatgttctaacgcaggcccgttatccgggtcgcggacagtgtctggtgggtagtttgactggggcggtctcctcccaaagcgtaacggaggagcacgaaggttagctaatcacggtcggacatcgtgaggttagtgcaatggcataagctagcttgactgcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtaccggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacctgacaacaccgaaggtgttttggtgagagagagagacgcagtttcaaatgaaaaacagcagcttgttcgggattgaacacagaatttgtctggcggccatagcgcggtggtcccacctgatcccatgccgaactcagcagtgaaacgccgtagcgccgatggtagtgtggggtctccccatgtgagagtagggcactgccagacatctatttagccagtatgactcataagcagaagtctactgaagttccagtcaaatggataaaaaaaattcggtggtgcggtagttcagttggttagaataccggcctgtcacgccgggggtcgcgggttcgagtcccgtccgcaccgccaccgtatttaggggcgtagttcaattggtagagcaccggtctccaaaaccgggtgttgggagttcgagtctctccgcccctgccagttaacaactaagtaataattgatatagctttcagattaatagcccagctaaatttagctgggttttttcttgcttgtaacttacctcctccgtgtccattgtctgcttgtagaaaaatcccaattattttcacaacaccgttcttagcctgttataggcgctttttcgacaggaatttttaataactgctgaataaatgtttgttgatcgctgttttgcaaccataccgcatataatggacgtttgattagttctttattgggtgaagttaccagtttaggatagtcttcctgccaatgcacaggcagaaaagctgcagcatttacgctatttagtaattctcgggcaatatgtgctgatgtggttgtaatgatcggcggatagtcattttttaagatctgttgctcttgctggtgaaaatcagctccccactccaacttgatgtaattttctatgccttgtttaagattatgttgcgttgtcgataaaacgagttggatattaccgatcaattgactttggaattcatccattttgggcggttctgtcgtgattaagagatctaattcacgggagtgtagttgtttgaccagaatttggcgtgtagaaactcgagattcaattctcatcccttgatgatgctgataaaaagtactcagccaagatatcaggtagccctcccataaggacgccgtagcaccgatagagagttctgtatgctgtgagacataactgatttctttctttgctaactgccaagtattcattagtgattctgcatagggcacaaggcgttcccctgcggctgtcaggcgaatattattgcgatgccgtgtaaataaattggtacccagctgattttctaattggcggatccgaaagctaacagcggattgtgttagatagagtgattcagctgcccgaccaaagtgacgagtcttactgacttccaaaaaggttttcagtaattcagtgtccacatgtatctccaatagtttttgtcgttaagatttaaatattttgttttacagaatgtcaagcctacctaatactccgcgccataattagtatgacagtagagttaggagtgtgtcagatggctgaaagcttcatcacgactaatcgtttttttgataatagaaattatccacgcggattttcccgtcatggtgatttcaccatcaaagaggcccaattgctagaacgttatggccatgcgttcaatgaattggatcttggtaaacgtgaacctcaaacagaagaagaaaaactgtttgttgccgtttgccgaggtgagcgtgcccctgcaacgacagaggaaaaagtatggataaagtatttggcaaaaatcagccgtccaaaacgttttcatactctttccggcggaaaaccgcagatagattctgcggaggactataccgatactgatgattaatatcatcattgatagtaatgatccatcaagaggggcgaaatagcccctcttccagattaccctgcttgtttctgtagttgaataagtaacctatccatgctccggtagctgagtgcttccataatatctggtctttctattcttttttgttctttcaggtctgcaatcgtgcgtgaaactttgagtattcggtgccaggcacggacagataagcctaatttcagtagcgtatcttccagaaaaattgaatcttccatttttagtttacaagcgctgtcagtttgtttgcgattgagataagcattcacatgtccacatcgttctatttgcacttttctggcaatttgtacccgttttttgacttcatagctactttcgccatgtttttctgatgactggcttaagatacctgaaggaagtaagggaacttcaattgagaggtcaaaacgatctaaaaaaggacctgataatttggagagatagcgtaatatttgctgtgggctactgcgattgtgcaatccttgatgatatcccgttgggcttgggttcatggcagcaatcagttggacttgagcagggaaacagactttcgctcttgcacgggatataactatttcgccggattctaatggctcacgtagcgcatctagggcgcttcggctgaattcaggcaattcatccaaaaataatataccattatgcgcaagtgaaatttcccctggtttaggaattgaacctccaccaacgagagccgccattgatgaactgtgatgaggcgctctaaatgggcgtgtatgccacttttggggattaaccgagttacccgtcaggctattgattgcagcgacgtctagagcctctaagtgagttaagggcggtagtaagccacacaatcggctagccagcatagttttgcctgtgccgggagggccaagtagaagaagattatggcccccagcggcagtaatttccagtgcacgcttggcttgctcttgcccgataatatcccgtatatctaaaacaagggggtcggcctgtaacgtaatgggaggcggggaggataaaatggcggtttctcctcgcaggaagtggcagacttgaagtaagtgattggccactaatgtttcattctgggataagatagccagttcagcttgattttctatggacaaaatcaattgtcttcctgttcttttcgcactcagtgcggcggggatggcacccatgactcggcgtatttcgccagatagtgctaactcccctaaaaattcataattatgcagcttatctgtcggtatctgttctgatgctgccaaaatcgcgatggcgataggtaaatcatatcttcccccctctttagggagatcggcaggtgccagattaacggtgatcctttttggtggataagtaaaaccgctgttgagcaacgcgcttctgacccgatctctcgcttccttgacggtagtttcaggtagaccaacaagcgttaagccgggcaggccattactgatatgtgcttctatcgtgacaatgggggaatcaacgcctattgttgcccgagtataaatgacggcgagtgtcatggtgctctccttagcaagaaagtcgctatcatgaattgataaaaaataataaaaagtattttgttgttattttgcgaagagactcgtaaatatatttactgttattggtattttgaaattcattgaccatttggtttttctaattaatattttgttatatattaataatttaatgtttttgggtgctttttataaagagagtgaatgaaatctgtatgatattattcgttagttattatatatgatttatattaatgaattatctgttgtcccatttgtgcataatcatgggcatagataaaaaatatctgcttggatgttacttcctataaaaagatgattaagtcgaatttttattatttttgtattaataattttattaaatatgcagatggcaattttttctgatagcaagaagcataaacggcagtgtatttatctgtttaaacatttatctatatgaaaaatatggttaaaataattttcctgtgaaaaaaataaaattaatcgttgtcaataatcatggaaagtgataactcttaaagatacgttgagcatacgagtttaaacgaaaaaaattatgaacgcatttgtcctagtgattagcctaattatcgtgagcgtggtggtgattattatcccaccgtgcggggctgcacttggacgaaggaaggcttaaacagaaaaatagccagatttcacaaaaacccccgcaccgaaaggcgcgggggttttttttgacacgtagaaacgcataacaaaacaacatcacagcaagccatttacaagctaaatacaacagaggaatgacaatgaacggggcgcaatgggttgtacaagcattacgaacacagggaattgaaaaggtttttggttatcctggtggagcaatcatgccgatttatgatgcgctgtatgacgggggaattgaacacttgttatgtcgtcatgaacagggagcggtgatggcagcaatcggctatgcaagggcgaatggtaaacctggggtttgcatcgcgacatcagggccgggggcaacaaacttaatcaccggattggcggatgcgctgctggattctgttccagttgtggctatcaccggtcaggtgagttctgaattgattggcactgatgcctttcaggaaatcgatatgttggggctttcccttgcttgtacaaaacacagttttctggtcgattctctggataaattaccccagatcatagccgaagcctttactatagcaacaagtggccgccccggccctgtactgattgatttaccgaaagatattcagttagctcaaagcgatttagcaccttacctgatgcctgttgtgtccgaatctttcccccctgaacaagaactggaacaggctcgtcacatgatgctcatggcccaaaaacccattttgtatgtaggtggtggtattggcatggctgatgcagtacctgaactgcggcgttttgttaccgaaacgggattacccgttgtttccacgctgaaaggcttgggagctgcggatgccgagcataaatattatttagggatgttggggatgcatggcacaaaggctgccaatcttgccgttcaatcctgtgatttattgattgctgctggagcccgttttgatgatcgtgtgacagggaaattaaatacttttgcccctcatgccaaagtgatccatgtagatatcgatcctgttgaattcaataaattacgtcaggcacatgtttcattaccggggaatttaaaaacattgttgccccacttacagcaacctttatcgattgaatcctggcaacaggaaatcaaacgcttaaaaagcgaacatacatggcattatgactatcaaggcgtaagtatttatgcgccatcactattaaaacaggtatctgaacgcaagccatccaacgcgataatcacaactgacgttgggcaacatcagatgtggacagcgcagcacatgacatttgataggccggcaaatttcattacttccagtggattaggcacgatgggttttggcattccagcggctattggcgcccagatggctcgtccggaagatatggtgctctgcatatccggtgatggttctttcatgatgaatgtacaggagttaggtaccatcaaacgtaagcagttgccaatcaagattattttattggataaccagcgtctgggcatggttcggcagtggcaagaactgttttttgacaaacgctatagcgaaacgatcttaaacgataatcctgattttattgccttggcaaaagcttttgatattcctggtcaacaaattactgacaaaacccaaatcgatgcagcgctggatgctttgttcagcagcgaaggtccgtatttattacatgtatccattgacgaattagagaatgtctggccattggttccaccaggctcaagcaatgcaaccatgttggagaagtcattatgatgcagcatcaacttgctattcaggcacggttttgccctgagattttggaacgaattctgagagttacccgtcatcgtggatttcagatatgtgctttgaatatggatcatacaacagatagtgataatgtaagcattgaactcacagtcgccagccaacgctctgtaaatttacttttttctcaactgatgaaattagtcgacgttgctggtgttgagatccgacacaaagaatcacaatttataagcgcataaagcgcaattgaaggaaattgaagaatgacaaagcaagctgattatatttggttcaacggtgaaatggttccttgggctgatgcgaaagtccacgttatgtctcacgccctgcattacggaacttccgtatttgagggcgttcgttgctataactctcacaaagggcccgttgtttttcgtcatcgtgaacatatgcggcgtttgcatgactcagccaagatttaccgtatgcccgtgagccagagcgttgatgaattaatggaagcctgtcgtgaaacacttcgtaaaaataaattagtcagcgcttacattcgcccattggtttttatcggtgatgttggaatgggggtcaatcctccagacggttataagacagatatcattattgcggcttttccgtggggggcttatttaggcgaagaagcgctggatcagggtattgatgcgatggtttcttcatggaatcgtgtggcagcaaatacgatcccaacaggggcaaaagcgggtggtaactatctttcttctctgctggtgggcagtgaagcacgacgccacggctatcaggaaggtattgcactggatgttcatggctatatttcagaaggtgcgggagaaaacctgtttgaagtgaaagatggggtactgtttacgcctccatttgcgtcatcagcactgccggggattacccgtgatgccattatcaaactggcacaggatctgggtctggaagtgcgtgaacaaatacttacccgtgaatcgctttatttagctgatgaagtattcatgacggggacagcggcagaaattacgccggttcgtagtgttgatggcattcaggtgggtattggtaaatgtgggccaatcactaaaaaaatccagaatgccttctttggcttatttgatggtacgacagaagataaatggggctggctggacgccgttaatcctgaataaaaaaagacaaaatgtaacaggcggctcgttccctgcctgttttgattgctgatactaattagataagacacgggagtgaaaacaatgcctaaataccgttctgccacgacaactcatggccgtaatatggcgggagcacgagctttatggcgtgcgacgggtatgaccgatgaggattttggaaaacctattattgcggttgtgaactcatttactcagttcgtgcccgggcatgttcacctgagagatttaggaaaactagtagcagaacagattgaggcatcaggaggcgtcgcgaaagagttcaacacgattgcagttgatgatggtattgcgatggggcatggcggaatgctctattctttgccttcgcgtgagttgattgctgattctgtggaatatatggtcaatgcccactgtgcggatgcgatggtgtgtatctccaactgtgacaaaatcacaccgggcatgttgatggcatcaatgcgcctgaatatcccggttatttttgtttctggcggcccgatggaagccggtaaaacccgcctgtctgatcagatcatcaaactggatctgattgatgcgatgattcagggagctaatcccaatgtcagtgatgaagaaagcaatcagatagaacgttcagcttgtccgacatgtggttcctgctcaggcatgtttacggctaactccatgaattgtctgactgaggcattggggctttcgcagccgggtaatggttcactgcttgccactcatgcggatcgcaaggagttgtttttaaatgcgggcaaacgcatcgtcgaactgaccaaacgctattatgagcaaaatgatgatagcgctttacctcgtaatatcgcgaccaaagctgcctttgaaaatgcgatgatactggatattgcgatgggcgggtcgaccaacacggtactgcatctgctggcggcggcgcaggaaggtgacgttgatttcactatggcggacattgatcgtttgtctcgtctagtacctcatttgtgtaaagtggcaccaagcacccagaaatatcatatggaagacgtacatcgtgcagggggagtcatcgggatcctcggtgaactggatcgtgcggagcttttgaatcgtgatgtgaaaaatgttttggggctggatctgccgcaaacgttagctcagtacgacatcatgctgacacaggatgaaggtgttaagagcatgtattctgcggggccagcaggtattcgaaccactaaagccttttcgcaggattgccgttggccgtcattggacacagatcgtaaggaagggtgtatccgtgaacgcactcatgcttatagccaagatggtggtttggcagtgctgtctggtaacgttgcggctaatggctgtatcgtaaaaaccgctggggtggatgaaggaagcctgacttttcgtggcccagcgaaggtttatgaaagccaggatgatgcagtagaggcgattctgggaggcaaagtcgttgcgggtgatgttgtggttatccgctatgaaggcccgaaaggcggtcccggtatgcaggaaatgctctatccaaccacctatttgaaatcgatgggactgggcaaaagctgtgctcttatcactgatggtcgtttttcaggcggaacatctgggttgtcgattgggcatgcttcccctgaagcggctagtggtggcgtgattgggttggtttatgatggagatatcatcgacattgatattccgaaccgtaaaatccatctggatgttaacgaaacagaactggccgtacgtacacaggctgaactatctcgtggagatcaggcatggacacctaaatcccgtgatcgtcaggtttcttttgccttgcgtgcttatgctttactggcgaccagtgccgataaaggcgctgtacgcgataaagcaaaattagggggctgactgtggcagtttatcctcttaatgctgagccaaagggagcggaatacctcaaagccgccttgagtgcaccggtttatgatgtcgctcaggttaccccgctgcaagaaatggaaaaaatctctgcccgtttagcaaataccattttagttaaacgggaagatcgtcagttagtacacagtttcaaattgcgcggtgcatacacgatgattgcgggtttgactgaggagcagaaagcgaaaggcgtgattaccgcttctgcgggcaatcatgcacagggtgtggcactttctgccagcaaagtgggcaccagagccatcattgtcatgccgattgccacggcagacatcaaagttgatgcagtccgcagttttggcggtgaagtcctgttatacggtgctaattttgatgaagctaaagccaaagccatctcgatggcaaaagagcgcggctatacttttgtaccaccgtttgatcaccctgccgtgatcgcggggcaggcaacactggcaatggaacttttacagcaggacgtccaccttgatcgcatttttgtgccggttggtggtggcggtttgattgcgggtgtcgcagtgctgatcaaacaacttgtaccggaaatgaaagtcatcggagtggaaaccgaagattctgcgtgtctgaaagcggcactggaagcagggtgtccggttgacttaccgagagtggggctgtttgcggaaggtgttgcagtcaagcgtatcggtgatgaaacattccgtttatgccaactgtatgtcgatgatgtcattacggtggatagtgatgccatctgtgccgccatgaaagatatttttgaggatgtcagggcaattgccgaaccttccggtgctctggctctggcgggtttgaagaaatacgtacagcagcatcagattcagggagaaaggctggcacatattctctcaggtgccaacgtgaattttcatggcctgcgttacgtctctgaacgctgcgagctgggagagcagcgtgaagcactactggctgtcacaatacctgagcaaaaaggaagtttcctgaatttttgccagacgctgggaacacgtgttgtgacagaatttagttaccgttattcagatgcgactaaccctgctgaagcctgcatttttgttggcgtacggctgaatcgaggcaatgcagaacgtcttgaaatcatcaatgagttgaaagcatcgggttatcaggtcgctgactttaccgatgatgaaatggcaaaactgcatgttcgttacatgatcggtggccgtcctgccaagccattacaggaacggctatacagtttcgaatttcctgaatcgccgggcgctttattaaagtttttgcagacactgggaacacattggaatatcacactattccattaccgcagccatgggatggattacggtcgcgtattggctgcctttgaactttcaggtgcggaagtacgttttgatcgccatcttgaggatttgggttatgaataccatgatgaaacgaataatccttcttttaacctattgttgaaataagattctttgatcatcggcttaaaaaatagcaccttggcaggtgctattttcagaataaagaattgttcacaacatcccccaaaatgctttaaccaatggttcctgtaagcgcttactcagcgtacagacgcctaactcaaacggttcgaccagcgcaatattctctaacagggacacacgattgcgtacaggttctgggctattttcgacgacaaccgccgggatcagcgcgataccgcaacctaacgcaaccatcgaaacaatggcttcatggcctgaaacggtggcgtaaatcaaaggattagggatgctattccggcgaaaccaaagttcgatgcgtgtacgtgaaggcccatgttccggcagaataaaaggaatggcattccagtcaggttgttcctgtgtggcaagtgttctcacggcacaaggcagggaaggggcaatcaataccaaagggatttcacctattttggtaaagctgacattatggggcagtttctccggtttgcctgcaatgcctaaatcagcctgatcagattggatcctatcgacggcatcagcggcatctcccgttgttagttttatttctaccaaggggtgctctgcccggaatttatccagcacctgcgggagatggctataagccgccgtaactgaacagaacagacgtaattcaccgctcaatgagggactctggtgatttaatgaatggcgtaactgctgatattgcaggagcgtctgttgggcaaattgttttagctgttcacctgcgaaagtgagcttgactgtccggttatcccgcagaaataacggatgtcctaatagttcttcaagtcgttggatttggcgtgaaagtgtggatggactgacatgtatagctttggccgtgcgtccaaagtgacaactttctgcaagatgtaaaaacagttttaaatcacgtatatccatcgaattttggccttctaccgtaacaaatttgctgttgcataaaatgcaacataatcttgttaatatatcaatttaagcaatagctttcatggcatatattggaacgatgcaaacgacctcacaacaataacatcggagtcaccatggctaattattttgatacgttgaacctgcgccagcaattagcgcagttaggcaaatgtcgttttatggcgcgggaagaatttgctgacgaagcaggatatttaaaaggcaagaaagtagtcattgtcggctgtggtgcgcaaggacttaatcagggtctaaacatgcgtgattctggtttgaatattgcctatgcattgcgtcaagaagcgattgaagaaaagcgcgcatcatggcgtaaggcaacggaaaacggcttcaaggtcggcacctatgaggagttgatcccacaggccgatttggtcattaacctaacaccagacaaacagcattctacggtggttcaggcagttcagcctttgatgaaagaaggtgctgcactgggatattctcacggtttcaatatcgtggaagtgggtgagctggttcgtaaagacatcaccgtcgtgatggttgcgcctaaatgcccgggtacggaagttcgtgaagaatataaacgtggtttcggtgtccctactttgattgcggtgcatccggaaaacgatgtgaaaggtgaaggcatggccatcgcgaaagcatgggctgccgcaacgggggctcatcgcgctggtgtactggaatcttctttcgtggctgaagtaaaatcggacttaatgggtgaacagaccattttatgcggtatgttacaggcgggttctctgctttgttatgacaagctggtggcagagggaacagagccgggttatgccggtaagctgattcaatttggctgggaaaccatcacggaagccctgaagcaaggcggcataacattgatgatggatcgcctgtccaactcagcaaaactgcgtgcttatgccctttccgaacagttgaaggttattttagcaccgttgttccagaaacatatggatgacatcatttctggaacgttttcttctactatgatggcagactgggcaaatgacgataaaaacctgctgacttggcgtgcagaaacaggccagacaccattcgaaaactacccggatcacagcggcaatatcagcgagcaggaatactttgatcatggcgtgctgatgatagcgatggtcaaagctggggtggagctggcgtttgaaactatggtggatgccggcattattgaggaatcagcctattatgaatcgctgcatgaactgccattgattgcgaataccattgctcgtaagcgtctgtatgaaatgaatgtggtgatttctgatacggcggaatatggtaattacctgttctctcacgttgcggttccactactgaaagaaaaatttatggctaccttgcaggcaggggacatgggtaaacccgtggcagacggcagtatcgataatgcccaattacgtgatgttaacgaagcgattcgtcaccatccgattgagactattggccgtactctgcgtggttatatgaccgatatgcaacgcattgcagtgggtggataatttgcttatcaggtcgatctgatagagatgaacctccataaaataacgcccgatgagattctatcaggcgttgttttttatgggaatttacaggctaagctgttgtttcagatcatcgattgcctgacgctgtaaagtttcaaaaggtgctctcggttgctgcaattcgagtatggcaagagccggatcaatgacttcagtgcgaacgccagacaattcttccattacggccaaaccacagaaaggcacataggcttcggaataaccgccttcgtgtaccatcaccagtttgccatgacagaactcatccgctatctgctgcattttacgcgtcatctcacggaaactgtcactatgcagctgcatccgtgccagcggatcaaagccattggcatcatagccacaggcaatgataatcagctcaggctggtaacgtcgcagtgccggcatgacaatttgatccatggcatacatgtagctgtcatgacccgcaccagccatcagtggaatattgatattgaacccttcacccggaccttcgccgatatcgctttcgccgctgtaacctgccggatagcagcgatcctgatgcagtgaaattgtcagtacatcatcccgttgccaaaagatatgttgtgttccattaccgtggtgcacatcccagtcgacgacggctacccggccaaggcccagttgttcttttgctttttcaatcgcaagagaaatattggcgaggaaacagaagcccatggcttgatcgggtaggcaatgatggccggggggacgagaaaggctgtaggcattatccaattcaccttgcaagacggcttttactgctgcataggttagccctgcggacagtttggcaatttcataactgcctgcacccagtgatgcttcagaccccaatgtaccgccgccgttatcgctcagatacttaaagcgctgtaaataagattctgtgtgaacgagccttaacgttgcttcatcaataggctcggcactcattagctctaatgagtgacttaaaccggaaacatccattaagcttttcattctgcgtttggtttctggtgattcggcatgtcctgccccgcacggcggctgtatccatccacctacgggaaatatgaaggtatgcatggaacccatattgtgccagaaacagagttcatcaaagaaaaagccagttttacgtagcatattacacccattttattgattcgatgataataagatgatagtgctaattaagttaaacagatattatgtgttactgtaagtagagatttactattgcatagaagaaggtaataaatctatttttataaaaaaaatttcaatctatatcacaaaattagattataaataataatgaatccgcgactaattaaaattgttattaaatataaaattttttgtactctttaatttattgatatttaaatgaaagcaatgaaataaatatttattatcatgatttgacaagctaatgaataatatataattgggtttttttgccagtatgtacagatataaaataataagtgttaaataacaataagatataaatttatatcactaagattaaggttggtgtttattagtattaaggagagggataatattaatgtaaatagaatatcgtaaaagtttattttttcttaataatatagtcattgaaagtataataaataattgtaaaaaatattggttcgaaattatatatgagtaatatctataggtattctattttatctcacttatctttattaatttaatattaaaaataaatatttaaattttttaattgtttattatataaagagtttgttgttttttatttcaatataatttgaaaaataattgtcatataagtgagggttaaaaaatagaataacttaattatttcgtctctcgataaccaatttatgtaaagaaaatgccctttctgctacacttcttacctctgatgtttatcctgatataaccccctaaaaagtatgcgattaaatcctagtcaacaacaagcggttgaatttgtcacagggccttgtctggttctggcaggtgcaggctccggcaagaccagagtaatcaccaataaaattgcccacctgatccgtgcctgtggttatcaggcacgtcatattgccgcagtgactttcaccaacaaagcggcacgggaaatgaaagaacgtgtcgcgcagactttggggcgcaaggaaaccagagggctgatgatttcgactttccatactctgggtctggaaatcatcaagcgtgaatacaaagcgctgggtatgaagagtaacttttcgctgttcgatgatcaggatcagagggtactgctgaaagatctgacggcggatttgctggaagaagataaggatctattgcaaaaactgaactccagtatttccaactggaaaaatgatctgatgtcacccgagcaggtgattagacaggctcgttcggcgcaggagcatcaatttgcggagtgttatcgccgttatgatctgcatttgaacagttgcaacgttctcgacttcgatgacttgattaccaaaccgacgttgctgttaatgcagaatgaagaggttcgggaacgctggcaaaataaaattcgttatctgctggtggatgaatatcaggataccaacaccagtcagtatcaattggtgaaactattagtgggcaatcgggcacgttttaccgtagtgggtgatgatgaccaatccatctattcatggcgtggtgcgcgcccacaaaacttgatcctgctgaatgaggattttcctcagttgaacgtgatcaaactggaacagaattatcgttcatcagggcggatattgaaggccgcgaatattctgattgctaataatccccatgtatttgagaaaaaactgttttcagaactgggctatggtgatccgctcagggtgatcgaagcaaataatgaagatcatgaagcagagcgagtcgtgggagagttgctcgctcatcactttattaataaaaccgaatataaagattacgccattctatatagaggcaatcatcagtctcgtatttttgaaaaaatgctgatgcaaaaccgtattccttatcgcatttctgggggaacttcattcttttcccgccctgaaataaaggatttactctcttatctgcgggtgttgactaatcccgacgatgacagtgcatttctacggatcgtcaataccccacgtcgagaaatcggcgcgatgacaatccagaaattgggcgagtgggcaaatcagcgtaacaaaagcttgtatcacgccagttttgatctcggtctggagcagagtctgacaggtcgcgggctggctgcgctacagcactttacccactggatggatgaaatttcccgccaggccgagcgtgagccattgctggcagtgcgggatttgctgcgcggtatggactatgaaagctggctgtatgaaacgtcacctagcccaaaagcggctgaaatgcggatgaaaaacgtcaatcagctttttacttggatgagtgaaatgtttgaaggggatgacctgaatgaaccgatgacgctgtcgcaagttgtggcgcgttttaccctgcgagacatgctggaacgtggggaagacgatgaggaattggatcaggttcagctgatgacattgcatgcatccaaggggttagagttcccttatgtttttctggtgggtatggaagaaggtttgttgccgcatcaaagcagcattgatgaaaataatatcgacgaagagcgacgtctggcttatgtcgggatcacccgagcgcggcgggagctattttttaccctcagcaaagagcgtcgtcagtatggtgagctgattcggcctgaaccgagccgatttttgctggagttgccgcaggatgatttgcactggccgagaggcaaaaagatgatcagtgcagaagatcgaatgaagcaagggcaatcgcgtcttgctgatatcaaatcccgtttggggcttggtcagaaaaacagcgataaataaaatctgatgaataccctgtattcgcgttgaatacagggataggtagattatccgagatgggagttattctgctcttcaaggaacaatgtccactgaatataactttgccactggatttcctgatgtaaggcttcagccctgagtggatgctgcatttgccactgatagggcagggtgatggtgagcgtctcattttcaacccgcagccgcaaggccggcaaagtatcatcttgccgacggctggcaaaaataatagccagacgtaacaagcggcataattgctgtgcctgtaacggtggcaaggcattttgctgactgagtgaggccagatctatagggccgctttgattgttcaacagcgttgccagtaatcttttttgggcgggagtataaccgggaagatccaaatgactgatgagatacgctgaatgagccgggccttggcgaaaatcgacacataagccgatttcatgaagtagacaggcgctggtcaacaactcgcgacatcgggcatccagattccataccgtggcgacctgctgacaaaaatgttcggccagttgtttgacacgcagagcttgttcaatatccagttgaaaacgatgttgaatattgcacagggttcttgtacggatatcctgctcaatggggaaatccagcatcccataaaccagcccctcacgcagtgcacctcccgcaaggatcatgctttctatgttcagtgcctgaaagatggcaattaaaattgccagcccgctagggaaaactaatgcccgttccaatgtcagcccgtcgatttcaagctcttccagcttgccgcactcaatcgccttgtatttaagctgttgtagcttcggcagggtgataagttcatccattccctgtgcgatcatgatttcctgcaacgcctgcactgtaccggaggcaccaacacaaatctgccaaccctgcttaagcagggtcgtggtgataggggcgagaatatgatgggcagcggattctgcctgtgcaaagttttcttctgtcaggctgcgatcattgaagtagcgttccagccaggtgacacaacccacttcaaggctgaacaactgattggcttttgctccggtgcctgtaaccaattctgtactgccaccaccaatatccaccacaagacgcttttcagacccacctgtcgtgtgggcaacaccttgataaatcagccgagcttcttcttcaccactgatgattttgactggattgcccaatatttcagaggctttcccgacaaaatcagccgaatttacagccaatcgcaatgttgccgtagcgacaacgcggatctgcgaggcagggatatcctgcaaatattcggaaaataggcgaaggcactgccatccccgctccattgcctgttgtgataaatggttatttttatccaacccagtggccagcctgaccttgcgcttgatacgggtgaccacttgaatgctaccagatacttcacggacaaccagcatgtgaaaactgtttgagcctaaatcgatagcggcatagagcgaagaagaactcagcatagtattactcagcctggatgtttacggttgcgagtcggatttccacggcgcgacatattggtgcgccgtgggtgccctcctgaacgagcgcggttacggcgcttgggtacaggtaaatccatcagcagtgcatcactgttatatttgcttacagggatctgatgctggatatactcttcgatcgacgttaaattcagagcgtattcttcacatgccagactgattgaatgcccgctttctcctgcgcgacccgtacggccaatgcggtggacgtaatcttcacagtcgtccggcagatcatagttaaatacatgggttacaaaaggaatatgcagaccgcgggcagcaacatcagtggcgaccagaatatccagatttcccagactgaattcttccaaaatacgcagacgttttttctgcgcaacatcacccgtcagcagaccaacacgatgcccatcggcagccagatgggcccagatatcttcgcagcggtgtttggtattggcaaaaatgatgcagcgatctggccactcttcttccagcagggtctgtaacagacgcatcttttcttcattggaaggataaaacagctcttcctgaatgcgatgccccgttttctgtaagggttccacttccacatattcaggactattcatctgttcaaaggcgagttcacgcactcgataagacagggtagcggaaaacagcagattcattcgctgagcggcaacaggcatccggcggaacagccagcggatatctttgataaagcccaaatcgtacatgcgatcggcttcatccagtaccacaacctgaacagcattaagattgacatatccttgtttggtgtaatcgattaaacgacctgttgtgccaatcacgatatcgacgccagattccagaaccttaagctgcttatcatagccgtcgccaccgtaggcaagccccattttcagtcccgtggcttctgccaactcctccgcgtcagagtaaatctggacggctaattcgcgggtgggggccataatcagcgcccttggctgattggttttgtgatctgccgcagcaggatgggtcagtaaataatgaaaagtagacgtcagaaatgccagcgtcttgcccgttccggtttgtgcctgccccgcaacatctcggccttcgacagtaaaaggcaaagttagcgcctgtattggcgtgcagttggaaaagccctttttatcaagggcttcaatgaccttggggtgcaatgcgaagtcggaaaacttcttttctgtcaaatgtgttttgctcatagtgtggtagaatatcagttaactattgctttaagaaagtgtatccgctgaaataaagacacgtttatgttggttaatgtacactgggaccgtaaaaaattttactttggagcaaaaataatgaacgagaagattataagtgatcgtatcatccatttggctgatgcggattttgatgcaaaaaaattaaatgtaaaaggcgcagttctcatcgaattctgggctgaatggtgtggtccctgtaaaatgattgcccctattttagacgaagtttccgaagaatacgcaggcaaactgacagttgccaaactgaacgttgatgatcacgaacaaacaccaaaagctcatggtattcgcggtattccaacactgatgttgtttaaagatggtgaaaaggtcgcaacgcaagtaggggctttgtcaaaaacgcaactgaaagcgtttttagactcacatatctaatttagagtctgatcacagtaatcacgggcgtttagcggataaagtgatttatcttactgaccgctagacgtctgcaacgaagcatggtaagttagcagtcatgtgcttgtatgaagcattgcatcagtggattcttcaatctatataaagaattgacattaagcatgttacatactaaacaatctgtagtgtctgataaatctgttatctctggttcatctgaagtatctgatggcatatcgcatttggcaaagtatttgagagcatatatacgggaatcattcggtatatagcttggtgctgacagcgtctctatgttaagcatctttatgtcgcgcttttttatatctcaatcgttattgagatagtatttgctgaagttgtgtttactgagacagtactcacattgagataatgcttacgataagatagtttttatgatgagatagttcttatatttgaaattaaccacgtttcgttactattatctcagccgtgttttgacagtttgtcagccttattttgaaatcaatctgagtacttcaaactattgccttgtaatattagttaatatgttaaaaggttttattcgtttctggtacaaataaacaggcaccgataacgctgccataccattcacgttcatagttcgagatataccccgagttaaagaacccaccattatgaatcttaccgaattaaagaatacgccggtatctgagttgattactctcggcgaaaatatggggctggaaaacctggctcgtatgcgcaaacaagacattattttttctattctcaaacagcatgcgaagagtggagaagatattttcggagatggggtactggagatattgcaggatggatttggtttcctccgttccggagacagctcctaccttgcaggtcccgatgatatctacgtttctcctagccaaatccgtcgttttaacctccgtactggtgataccatttcaggtaaaattcgcccaccaaaagaaggtgaacgctattttgccctgttgaaagttaacgaagttaactttgacaagcctgaaaacgcccgtaataaaatcctgtttgagaacctgactccacttcatgccaacaatcgtctgcgcatggagcgtggcaatggttctactgaagatttgactgcacgtgttctggatttggcagcacctattggccgtgggcagcgtggcctgattgttgctccgccaaaagcaggtaaaaccatgctgctgcaaaacattgcggctaacattgccaacaactacccagactgcgtcttgatggttctgctgatcgatgagcgtccagaagaagtcactgaaatgcagcgtctggtaaaaggtgaagtgattgcttcaacctttgatgaacctgcttctcgtcacgtacaagtggctgaaatggttatcgaaaaagcaaaacgtctggttgagcacaaaaaagacgttattatcctgctggattccattacccgtctggctcgtgcgtataacactgtagttcctgcttccggtaaggtactgaccggtggtgtggatgctaatgcactgcatcgtccaaagcgtttctttggtgcggctcgtaacgttgaagaaggtggtagcctgaccattatcgcaactgcgctggttgatacgggttccaagatggacgaagttatttacgaagaatttaaaggtacaggtaacatggaactgcacctgtcccgtaagatcgctgaaaaacgcgtcttccctgccattgattacaaccgctctggtacacgtaaagaagaattgctcactacgcaggatgaactgcaaaaaatgtggatcttgcgtaagatcatccatccgatgggcgaagctgatgcgatggaattccttatcaacaagctggctatgacaaaaacaaacgaagaattcttcgactttatgaaacgttcatagtttgtaactgataaatagtcatttcgtcaaaacgccacaagaatgtggcgtttttttatcaagggattaacctgttcgcctgaaatggtacatattttgcatctttttcatcagattaagtgagtgttttctgggcgcaatcatttacaaatgcttaggaaaccattattagtcatgctctacagcttacattatctatttgctttatttttatacatagacagaatgtcttctttattaacagggaacttatggatttggtgtcgaatggaacatccataagtcaatgaataatagatgatccatcattattttacagagagttgttattgtgaatattcccagtatgagtgtcgaaattttttgcatatttatattttcatccgtgtttctgtttgtggcacgcaaggtggcaaaaattatcggccttgttgataagccgaattaccgcaagcgccaccatggattaatccctctggtaggtggtatctctgtcttttttggcgttttttttgcttttgctataacaaaagaatttatacctcataaatggttatatctggcttgtgcgggaatattggtttttatcggcgcgttagatgaccgttttgatattagtgtgaaaattcgggcagcaattcaggcactggttggcatcagcatgatgtattttgctgatctcaaaattgaaagtttgggcagcgcttttggttcatgggaaatgacactgggtccattcagctacgttgttactttgtttgctgtctgggctgccattaacgcctttaacatggttgatgggattgatggcttgttgggtggtctgtccagtgtttctttcggggcattgggaattttgctatatgtaaacggtaatacggcactggcgttttggtgttttgcgtttatcgcgggaatattaccttatatttttctcaatctggggctactcgggaaacgtttcaaagtttttatgggagatgcgggaagcactctgatcggctttaccattatctggttgctgactgaaacaactcagggcgaacacagttcgattaatccagtgactgcattgtggattatcgcgatcccattaatggatatggttgccattatgtatcgccgactacgcaagggtatgagtccgttttcgcccgatcgccagcatattcaccacttgatcatgcgtgcgggtttcacttcccgtcaggcatttatcttaattaccgtggccgctgctttattggcatcgatagggatcattggtgaacacctgagttttgtgcctgagtgggttatgttggcattgtttttgcttgcatttatgttgtatggctattgcatcaaacgagcatggcgggtagcccgttttattaaacggtgcaagcgtcgtatgcgccgggcagtcagccatcactaaaaacatttggcttatcaaagaggttttgggcagtgataaactcagaaacgaaatctaagcaggatcaatctgttatagagcatgagttggatattcgtgcactgtgtcatgctctgtggcgcggaaagatatggattatcgcactggcaatgattttcgctgccgttgctttaggtgcgtcgtacctgatgcagcagaaatggagcgcaaccgctattgtggatttaccgacgaccaatgatctggggagttactattcacaacaacaatttttgcgcaatctggatactcacatcaatgcctctccagaggtacaactgccgactatttcagatggtgcatacaaggaattcatcacacaggtggtggcgtatgatacccgccgcgaattctggcttcagtctaattattacaaacagtacagagaaggtaatgagaaagcagatgcggtattgctggaagagttaattaatacgattcaagtggtacggcgtgatgataaaaaattaccgaatgaagtcataaaattgacggcagaaacggcagtgaatgctaatcagtttctgcgagagtatatggcgtttgccaatcaacgtgcgagtactcacctgaacaatgagattaaaggtgcgtgggcaacccgtatccagtcgatgaaagcgctggtcaaacgtcaggaaatggtcgccaaggcgatgtacaatcgcaaactgaatgtcttacagcaatcattgaaaatagctgaaaaacaaggcatcaaccgtaatcaaacagacattcccattgaagaattacctgaatcccagatgtttatgatgggggcgccattactgcaatcacaaattgaaaccttggaagccactgggcctaattacagcattgattatgatcaaaacatagcgatgttggctacattgaatgttggcccgactctgcaaaatactttccagacctaccgttacctcagaacccctgaggtgcctgtcaaccgagacagtccccgccgtgtattcatgatgattatgtggggagctattggtctgttggtcggagctggagtcgcgctgacaaggcgttcgcacacataaaatcagctcaaataagttttattcggggaatacaaaataatgactatttccgatggtctgtatgctacatacacatatatcggaagcagggatagaaatggcggtaaaaaagcgcccttttctggaagcatcagtaatgattgacaaaataagagagccactgtgaaagtgttgactgtgtttggtactcggccggaagctatcaaaatggctcctttggtacacgcattggccaaggatgctgcctttgacgcaaaagtgtgtgtgactgcacagcatcgggagatgttggatcaggtactgcatttgtttgatatcacgccagattttgacctcaatattatgaaaaaagggcaggatcttacggatatcacgtgtcgtatccttgaaggcatgaagccagtattagaagagttcaaaccagatgtagtgttggtgcatggtgataccgcgaccacaatggcgaccagcttggccgctttctatcagcgcattccggtaggccatgttgaagctggcttgagaactggtgatctttactccccgtggccggaggaggccaaccgtaaaatcgcaggtcatctggcgatgtatcattttgcgccgacagaaaactctcaaaataatctcctgaaagagtccattagcgaaaactctatttttgtgacaggtaatacggttattgacgctctgctgtgggtacgtgatcgcattgtgagtgatgacgcgctgagtggccaacttgctaagctttacccctttattgacccgaataaaaaaatgattctggtgacaggccaccgccgtgagagctttggtggcggatttgagcgtatttgtgaagcgttggcacaggtagccagagcacaccctgaagttcaggtcgtttatcctgttcacttgaacccgaatgtcagcgagcctgttaaacgcattctgcatgacatggataacgttattctcattaatccacaggactatctgccatttgtctacttaatgaatcatgcctatatgattctgacagactctggtgggattcaggaagaagccccttctttagggaaacccgttctggttatgcgtgacaccacggagcggccagaagccgtcgatgcgggtacagtgcggctggtgggaacaaaaacgcagaccatcgttgaggaagtcacgcgcctattaacggatgacatcgcttatcagcaaatgagccgcgctcataacccttatggtgatggtcaggcttgccagcgaattcttgaagcattgaggaaaaatcaggtgacattatgagctttgaaacaatttctgtgatcggccttggttatatcggcttgccaactgctgcggcattcgcttcccgcaaaaaaaacgtcatcggtgtggatgtcaaccaacatgcggtagagacaattaaccgtggcgcgattcatattgttgaacctgatctggacaaagtggtgaaaaccgctgttgaaggcggttacctgaaggccgtgacttgtccgcaggctgcggatgctttcctgattgcagtaccaacgccgtttaagggcgagcatgagccagacatggcctatgtgcgttctgcggcagaatcgatagcgccagttttgaaaaaaggggatttgatcattttggaatccacttctcccgttggtgcaaccgaacagatggcagaatggctggcagcggcacgtcctgagctatcattcccacagcaggcaggcgaaaatgcagacattgatatcgcgtactgtcctgagcgtgttctaccgggtcaagtcatggtggaattgatcaagaacgatcgtgtagtgggtggcatgacattaaaatcgtcccgcagggcgagcgagctgtacaaaattttccttgaaggcgaatgcgttgtcactaatgccaaaacggcagaaatgtgcaaattgactgaaaacagtttccgtgatgtcaatattgcctttgccaacgaactttccctgatctgttccgaacaggggattaatgtctgggaactcatcagtctggcaaaccgtcatccacgcgtcaatatcctgcaaccaggccctggcgtaggcgggcactgtatcgcggtagatccgtggtttatcgtgtcccagaacccggcacaatctcgcttgattcataccgcgcgtctggtgaatgacggcaagccgctttgggtggttgatcaagtgaaagccgcagtagcgggctgtctggtggagagcggcaagcgggcggatgaaatcaaaatcgcctgttttggtctggcttttaaaccgaacattgatgacttacgggaaagccccgctgttcatatcacgaagatggtggcacagtggcatgttggtcaaactgtggcggttgagccgaatgttcatgaattgccgaattcgctgaaagagagtgtggaattaatcgatatgcaacaagcattgaatgaagccgacgttgttttgatgctggtggatcacagccagttcaaggcaattgccggcagagaaataaaacaaaaatgggttgttgatacaaaaggagtttggcgttgaaacgtattctgattacgggtggtgcgggtttcattggttctgctgttgttcgccatattatcaatcataccgaagacagcgttgttgttgttgatagtttgacttatgcgggtaatcttgagtcactggcatcggtggttgatcatccgcgttatgcctttgagcaggttgatatctgccagcgtgatgcattggatcgtgtatttcagcagtaccagccggatgccgtcatgcaccttgcggccgaaagtcatgtggatcgctccattgatgggcctgccgcctttatcgaaaccaatattatgggtacctatgtcttgctggaagcatcccgcgcattctggcagcaactggatcaggaaaaacaggctgcattccgtttccatcacatttcaaccgatgaagtgtatggtgatttgcatggcgatgagggttttttcacagaaactacaccttatgcaccgagtagcccttattccgcgtcaaaagcatccagtgatcatttagtcagagcctggcgtcgtacttatggcttaccgaccgtgatcaccaactgttcgaataactatggcccttatcactttccggaaaaactgatccctctgatcatcttgaatgcattggcaggaaagccattgcctgtctatggcaagggagagcagatccgtgactggttgtatgtggaagaccacgcgcgcgctctgcatctcgtggctaccacggcagaaccgggtgaaaattataacattggtgggcataacgagcgcagaaacattgatgttgtagagactatctgtgaactgctggaagagctgcgtcctgtcaaacccgcaggtattgtctgttaccgtgacctgattacccatgtggcggatcgtccggggcatgatatgcgttatgccattgatgcggcgaaaattgagcgcgaattgggttggactcctcaggaaaccttcgaatctggtattcgcaagactgtgcaatggtatctggagaatgagaattggtggcgtcgggttcaggacggttcttatgcgggtgaacgtcttggtctggcgaatgaataaacctgtctgggagatgacatgaaaggaattatactcgcgggaggctccggcactcgtctgtatccaataacacgcggcgtctcaaagcagttattgcccatttatgataagccgatgatctactatccactgtcggtcttaatgctggcagggatccgcgatatcctgattatttccacgtcggaagacttgcctgctttcaaacgcttattgggcaatggcgaacagtttggtattcgcctgagctatgcagtgcaaccttctcctgatggcttggcacaggcatttatcattggtgaagaattcattggcaatgatgcctgctgtctggtgctcggagataatatctactttggtcaggcgtttagtccgaaactgcaaagtgtcgttgcccgtcagactggagcaacggtattcggttaccaagtgatggatcctgaacggtttggtgtcgtggagtttgatgagcaataccgcgtcctttcgattgaagaaaaacccgcccggccgaaatcaaactgggcagtcaccgggctttatttctacgacaacaaagtggtggatttagccaaacaagtgaagccttctgcccgtggcgagctggaaatcaccagcattaaccaaatgtatctggaacgcggcgaattgaacgttgaactattggggcgcgggtttgcgtggctggataccggcacccatgacagcctgattgaggccagtacttttgtgcagaccgtcgaaaaacggcagggattcaaaatcgcctgcctggaagagatcgcatggcgtcacggctggttggatgatgaacagttaaaagccgcggctgccgagttggcaaaaacgggctacggcaaatacctgatggacttgctccatgtctattcacgccaatattgaaccactggcatgggatagccaatttttcggtttgtccactgcccgtttgaatttttcaccgcaggcgtcagtgctgacgacagctcagttagatgagtatgcactggtacaggcgaaagtccctgcccggcagacggatatcattgacggattatctgctttgggcttttcactggtggaaggtgaggcggattttttgctgccggtggattctggcgcgatgagttacagaaatgcaaccggaattcagtcggaacaagcgctgatttctgcaacatcgcaggatatacctgtattgacggcagccgcagccagtgtattcaaggccagccgctttcgggtgccttggtatcagcctgatgatagcggtcggttttacgcggcttgggttgaaaaagccgttttgggtacttttgaccatgaatgcttgctcgtcaacgatgagtgcggtcaaattatcggctttgtcaccctgagagatatcggtagccatgaagcccgtattggcttactggcagcccttccgggcaattatcaccggggcattggtaaaaaattaatgtcggcggcgcagcggtggtgtgaaaaccaccagatacagcggctgagagtggcaacacaaatcagcaacatcactgccttgcgtctttatacacgtagtggtgcaacaattgaaagcaccgcatattggttatacagaggatgagatgattccatttaataaaccaccagtagtcggcacggaactggaatatatgcaacaggcgatgggcagtggcaaattatgcggcgatggtcacttcactaaacgctgtgaagagtggatggaacagcattttaactgtctgaaggtgctgctgacaccatcttgtacagcggcattggaaatggcggccattttgctgaatatccagccgggtgatgaaatcatcatgccgagctacacctttgtttcgacctccaacgcctttgtcctgcgtggtgcaaccatcgttttcgtggatatccgcacagacacgatgaatatggatgaaaccaagattgaagctgccattacagaccaaacccgtgccattgtgccagtgcattatgcgggtgttgcctgtgaaatggataccatcatggcgctggcggaaaaatataacctgtatgtggtggaagatgcagcccaaggcgtgatgtccacctataaaggccgcgcactcggtactattggccatatcggttgtttcagttttcacgaaaccaagaactactcttccggcggtgaagggggggcgatattaatcaacgatgaatcaatgatcccccgggctgaaatcattcgtgaaaaagggactaaccgtagccaattcttccgtggacaggtggataaatacacgtggcgcgatattggctccagctatttgctgtctgatttgcaagctgcatacctttgggggcagctggaaattgctgagaatatcaaccagcgtcgcttatccctgtgggataactattatcaggcattgcagccattcgcagaagcggggcatctgaccttgcccgttgtgccggagggtctggaacataatgctcatatgttctatatcaaactaaaggatgtcgaggagcgcggcgcattcaaccgctatatgcaagaagcaaatattctgaccgtgttccattacgtagcattacatacgagcccggcgggtgaaaaatgtggccgtttccatggagaagatcgctttacgaccagcgacagtgagcggttggtgcgtttgccaatgttttataacattactgatgaagagcagcaggtagttatcaaccgtatcaaggaattttttgcctgatatgtcacttgctaaagcttctgtatggacggcgggttccacactaatcaaaatcggtgtggggctgctggtcattaaacttctggcggtgtccttcggcccagcgggtgttgggcaggcgggcaactttcgccaattgattaccgtactgggcgtgctgtctggtgcggggatttttaacggtgtcaccaaatacgtggcggaacaccatcagcagccggaaaaacttagggcgatactgggtacttcgtcttcgattattctggggttttccaccctgttggccgttatttttctcttgttcactgacgccatcagtatcggcctgtttggtcacaataattacaaaacagttgtgcaggcgcttgcattgatccaaatgggcattgcttacgccaactattttctgtccattctgaaaggtttcagggatgctcagggcaacgcactgtcgattattctgggtagcctgacaggaatgattgcctatggcctctgttattggctgggaggctatgaaggcgcactagcgggtttggctttggtgccggctttggtggttctgccggcagggttgatgatcctgcgcagtaaagtgattacgttttcagcattaaagcccatgtgggatcgtgtgattgccagccatctgggaaaatttacgctgatggcgctactgacgtccattacgctgccagtggcttatatcatgatgcgaaatctgatggcagagcgttatagctgggaggaggtcggaatttggcagggggtgagcagcatttcggatgcctatttgcagtttatcaccgcctctttcaccgtctatttgttgccgacactctcccgattggagagtaagcaagaaattactggcgaaatcgtcaaagcactgaagtttgtgttacccgccgttgctgcagccagcttttcagtttggctgttgcgtgattttgtgatctggcttctgttttcagataaattcaccgcgatgcgggatctattcgcatggcagctggtgggcgacgttttgaaagttggcgcttatgtttttggttatctggtgatagcgaaagcggcgctgcgtttttatgtactgactgaaatcagtcaatttctgctgctggccggcttttctcattggctgatacctgaaaatggagcactaggggcggcgcagtcatacatggcaacttacattatttatttcatcctttgttgtagcgtatttattatttatcgcaggcgagcatgacaatcctaattcacgtcttgggatcggatattccacatcacaatcaaacggtattgcgtttctttaatgacgtcttggctcaggaaatgatttttccagctaaaccgtgttttatggtggtgtccaaagaccacacatggctatctaattacccggccttggcgatcacggtttatggcagcaaagctgctttggcgcgtgctgtgatagagaaagcgcaggcagacagaaagacccgtttctttttccacggccagttcaatgcggctttgtggctggctttatgggttggcaaaatcaaacgccatcaattctggtggcacgcttggggggctgacttatatgaagactcccgccagctaaaattccgtttgttctatcagcttcgtcgtttggcacagaagcgggtggggcaggtttttgccacgcgtggtgatctccagtattttagccagtccaatcccaatgtaccgtcaacactgctctattttccaacgcgtatggagccatcactgatcgtaacggaaaaactatgctcgccagaagggatcaccattctgctgggtaattccggtgatcaatctaaccgccacattgaagcgttaaacaagattcaccgtcaatttggcaatgaggcgagagtgattatgccaatgggctatcccggcaataatcgggcttatgtccaaaacgtggagcaaaccgcattgtcgctgtttcgggcggaaaacgtccatattttgaaaaataaaatggcttttgacgactatctgtcattgctgcgtcaatgcgatttgggctatttcattttcaatcgccagcagggggtcggaaccctttgcctgttaattcaatttggtattccgtttgtcttgagccgtcagaacccattctggcacgatctgacagaacagcagatccccgtactgtttgatggagatgaactgaataaacactgggtgcaggaagcacagcgtcaaatgctgtccctcgataaaaaggcgattgccttttttgatcccaatttcattgaagggtggaaagccgccctatcggctgcattgggagagtattaatgactttggcgcaattcagcgggttatttgttgtttacgtgatctcgctgttctttatcctaaccctgacatatcaagagttccagcgcgtacgctttaacttcaatatctttttttcactgctttatttgctgacattctattttggctttccgttgacctgtatgttggtgttccattttgaggtgcagatagtccctgtagacgcattgttgtacgcgatgctggcttctggctgtttttatgctatttattatgtcagttataaaacacgtctccgttataagacgccagcctgtaaaactgcctcgtctagcacaccatcttcggtcgtgtctcgtcggccgctgttcaccatgaatcgggtggaaactaacctgacgtggctgttgttggccagcattgctatcttcacagttggctcgttctttatgcaaaacggctttttgctgtttaagctacagtcgtatagccagatattttccaatcaagtttccggtgtggcactcaagcggtttttctacttttttattccggccatgctggtggtgtttttcctgaaaccgactaaaacccgctggttgtgctttttggtggcgacagtcgggtttggtatcctgacttatgtgatagttgggggaacacgggctaacattattctggcttttgcgttattcctgtttattggaattgtccgtggctggatcactttgtggatgctacttttggcgggtgttatcgggatcgtcggcatgttctggctggcattgaaacgttatgggctggatgtgagtggttcggaagcattttatactttcctgtaccttacgagggataccttttctccgtgggaaaacctcgctttgctgctggataattacggcaaaattgattttcagggactggcgccgattgcccgtgatttctatgtttttattccaagttgggtgtggccggacagacctaatctgatattgaatactgcaaactactttacgtgggatgtgctggataatcactctggtctggcgatctctccaaccttgataggctcattggtagtgatgggcggcgtattctttattccctttggcgcgattgttgtcggattgattatcaaatggtttgactgggtctatgaagcggggaaacaggaatctaatcgctataaggcggcaattttgcaggctttctgttttggggcgatttttaatattattgtcctcgctcgtgaaggaatggattcttttgtttctcgggtggtgtttttttgtctcgtctttggcctgtgtctggtggtcgcaaaattgctgtattggctgtttgaaagcgtggggttggttcgaaaatttgtcatcagcaatatgcctgcgtcgcagaaaatatccgttattgcggatgttaaggaagaaaaatgacactgaataacattccaaaataccgtatccgtggcctcagtctctggggctttcgtggaatgtcgcatttcctcgatcacctttttcaggatgggcaggtaaaaacaggcacattggttgcgattaacgcagaaaaagtccttactgcggaaaaagacaatgtgttgaacatattgctggatgaggctgaatacttatatgccgatggcattagtatcgtgcgtgctattcgccgtaaatatcccggtgcgcaggtgtcccgcattgcgggagcagatttatgggaagctttgatggaacgcgcaggccgggaaggtacgccggtatttctggtgggtggaaaacctgatgttctggcgcagacagaaaacaaactacgtagtcagtggagtgttaatattgttggcagtcaggatggttattttacccaggaagggcgtgatgcggtgtttgagcgtatccatgccagtggtgctgccattgttacggtagcaatggggtcgcctaaacaggaaattttcatgcgtgattgccgtaaagtgtattctgacgcactgtatatgggcatagggggaacgtatgatgtctttaccggacatgtcaaacgtgcaccgaaaatttggcaaaatttgggattggagtggctttatcgtctgttatcgcagccaagccgcatccggaggcaaatcaagctattgaaatttctgggctattattacggtggtaagctgtaaacccgttatttggctattattgacccactgtatcaacatcagtgattaggatggatatcgtgggtttgacctgcctcgctaatttcttccattccatacatccattttgtctgctattcactatgcataatgaaacaggctttgactcgattttataattttttatttcactgatggacaaaacgtgttttgatccctgccttttttacaatgattgattatcaattcctgtaattttctgcttgcaaatagagacatcataaaaatggatagggagttttatgagtgattcaaaacaaagcctgcaaaggggacttgaggcacgtcatattgagctgattgcgctaggtggcacaatcggcgttggactgttcatgggttctgccagcacgttgaaatgggcgggaccttcggttctgttggcttacatcatcgctgggatttttgtttttttcatcatgcgttcgatgggggaaatgctgttccttgaacccgtcactggctcattcgctgcgtttggacataagtacctcagtccttattggggatgtctgacggcttggggctactggtttatgtgggtttcagtgggaatttcagaaatcaccgctgtgggggtctatgcagaattctggttccccgatctgccccaatgggtttctgcattggttgctgtcgggttggttgctctagcgaacttggcggccgtgcgtttgtatggggagctggaattctggtttgccatgatcaaagtgaccacgattatcgtcatgatcctgattggtatcggtttgatctttttcggactgggtaatgactggcagcctattggcttggataatttgaccgcacatggcggctttttctcgggtggctggaaagggttcttgtttgccctctgtatcgtggtggcctcgtatcagggagtggaactggttggcattacagcaggggaagctaaaaacccacaggtcacacttaaaaaggctattaacaatattctgtggcgtattctgatcttttatgtcggtgcgatttttattgttgtgaccctgtttccgtggacagaagctggtacgcatggcagcccgtttgttatggttttttccaaagtagggattgcttctgccgcagctgtcattaacttcgtggtgctgactgctgcgctttcgggatgtaacagcggcatgtatagtggtggccgaatgctgtatgccttggcgaagaatcgccagttaccggcttcattgctgaaattgtcaaaaaatggcgtacctgtgagatgtattgcgatcaccattggttgcctgattgcaggttccagcctgaactacctgatcccgaatccacagtcggtattcgtttacgtttatagtgccagcgtattgcccggtatggtaccgtggtttgtcattctggtaagccagttgcgtttccgccagcagaatcaggaagcattaaaacagcatcggtttaaatcgctccttttcccttatgtcaattacctgactctggtatttctgagttgtgttctgatagggatggcaattaatccggatacgcgtttttcactgatggtaggtggcgcatttttactacttgtgtcactggcttattggctggggaaatttatttgcgacaaacgcaaaatagttcgttagattgatttttgatcaagaaaaccctttgcggtggaaatgtgctgactttatcaacgaaatgattgaagtgtaatcaaacaaatcttttccttaaaaaaagcactggacagttcgacattaaatccgtactatcctccaccgcaacggcgttaagcgcccgtagctcagctggatagagcgctgccctccggaggcagaggtctcaggttcgaatcctgtcgggcgcaccatttaaagcgtacgagagcagtggcagtgggttatcgtggtgaacaacgttgtaagcagtttatgaaaagataactttcgaaaagatagttgttatggtggctatagctcagttggtagagccctggattgtgattccagttgtcgtgggttcgagtcccattagccaccccattttttttatgacacgcgatggtggcggaattggtagacgcgctagcttcaggtgttagtgtccttacggacgtgggggttcaattcccccccttcgcaccataagaaaaatgaaagatgttgtaagagtaagagaagtacatttcggcgagtagcgcagcttggtagcgcaactggtttgggaccagtgggtcggaggttcgaatcctctctcgccgaccagattctgagaaagccctgcatatagcagggctttttctttttgcatttctggtagaaatgctattcctaaccgttatttcccaactatcaaaaagcccttcatttctttttgtcattttgcacttttatagttgttgtaactatttgtttttaaatgtattttatgtatgatgttgtatttctgcgacaaaccataccattaagcgtctctgtttggagacatttaactcattgattattatcttctatatgtaaactgctgaaagggcgtctcaaatgagagacggtattgttcgactattcttggtgaaaagtcgaatgcctgttgtcggggatctgatacaccttgagtaagagagaattaaccagattactaaaagttggcacgaaacgtgcttataaagaattgtagatactcatcccactccttatgacagcataggcttcataaacctcgggatgatgtagagctgattatcagtgcctatggtccacgttatagatgaataagcatttagtcttttcatcaccaaccggacacaacgttgagtgaggcactatccgtctgtagacctgattgtatttatacacctgtcttttttgataggtgtttttttttgcttgtatcctgagatttgcatgatgcaccaaggttaacgattcaataatatcgatagatattgcaaccgttaaccttggtgaattttcatctaaaatgaaggcgttttattcttctgcatcactctcacgcttcagagtcagcataaagcctttactacgtgtctgagctgcttcttcacgcttatgctgtttatctaacgcatcggcaagccaagcataatcatgggcatcaggacgctgtacaagagccgccttgaatgcggtttcagcctcagcccactgactgtggtgtaaggctacctgtccaagtgtactgttcagcaatggtgtcgctccatgccgctttaataaatatgccagtgatttttgtaaggcttcggtctcatctgcctttaagtgtggaattaacagtagcaggcgttcgtcatattgctgtttcaacccattgaggacaatctgctgtgcagtgtcgtgatcattacactcaatcagatgttcggccatggcgacttgcagcacgatatcattgcggagtttgcggttttgatctttccaccatgccttcaatccggtactgcctttttctgccatgatctgattcatcaacccgatgtaggcttgctggcgcaattgatgaatatgttcttcatcacacaaaccaacctttatcagagagggcaggatatcaatgagggattggtaggctcctgactgtgtataagcctgctccgccagtcgcagtacttcaggatggcgcggtgcgtggttcagcagcttatccacaccattacgggcggcatgaacttcgccttgtgccagttggatacggactcgggtaatatcgacaggtaactgatctttatcggcgacttctgcggcacgttcaatatactggatagttcggtggtaatcgccacgctgctgggcggcttctgcggccagtaaatagttgacgacggggctttccgcatggtcagcattacgggtcatcaaatgttcaacctgcttgaagtccccttcggccaatttgagcagagcctgtttggtctgtaaacgtgcccggctgcgcttgtatccgccaaagagccaactatgggtgaacgtactggtacgttttaacctgcggtaacaccaaccgattaaaatcagcaagaattgtaacagaacaaacataatcaccatcgcagtgacgctggtggtgatattgtgattgtctgtttggatcaaaacgtatccctgatgcccggacaacacagggccgagcacaacgcctacgatgaggataatgaacagcaataatactttcagcatgttcaaccctcctgaacaggtgttgctgcctgaccagatgtttctgcgggcttcggttgaggttgaacttctgattgaggctgaacttgagtgtccgactgatgcggtaagttgtagatacgcttgcgcattaggtctgccagtattggctgactgctcaggtgttcagggagttcaatggaaagtggtttctgcgccagcgaatcaatatcctgcaaaaaggtttttgtatctgaggacgctgtatcgaaataagacctcacccaacttgaaacggcttccaatgattgtttatagacttcattctggtgacggggaactgcttgtgctgccaccagcagcctggagcggatgttttcgcgcagataaacgtcttggttcggcgccaataatggtactgcggaactgtcacgacgtttgatagtaatgaaattctccataaagctgtcccagctcttactcagatttttacgccagtcagagagtgaggcactaattcctgtatcgccttcatccattggcgcttcttgttctccattatcttccagccgtaaattatcgatctgattggataagcggttcagagtaagaataatgccatctaaatcaagctgattgattttagagagagtattgatatcttccataatggcttggcggacgtgtagcaggctgggatcatccatctcggcaaggctttggtcggcgtctttcagcagtgcgattgcagtggtcgtgtcttgctcggtccatattttgcggccagccatcttcacgagataatttgcttgtgtcaggcgccagttttcgagatccgtatttgaaatctctgatatgcgggtctgaagctccaccatacggctgtctgtttgtttattttgcagtttggcttgttgcaagtcactctctagcttctgaaactgggtagcaaaatcttgtttgtcgccagactgttgttgtacgagagaggcaacctgctgctgaagagcaaggttttcggctgttaatactgcattttgttgcttgccatgatggtaaaggtaaacgccacctgcaccgatagccaacataatggcaactgagagtgtatttcccacccacccacaacgtttgggtttatggggagccgtttcaggttgctgagggtgttttgtttcaaccgcatcagtggattgcttttgttccgtcataatggacatcccatattggtttattctagtgcctgcattaaggcgtcattatctgcactcttggctacttttatcgtctgccaacccagtgtctgggcaatattggcaaggcgttcgctgaccacaatcaagtagcaactcaataaccacgctttgccatcatcatctgtggctaagttatataatagttgcagcatttcgccactggtcacaacgagggtttttataccatattgttgccaatggcgactgaaatcagcgacatgatatttgataggctggcgtgaataacactcacaataatcgactttccctccccgatttattaatgtcgaagcaataacttcacgccccccattaccccgcagcaataaaatctttttatcattcacccgttgtaaaatggggagttgcagtaggtcttcactcgtttcaccctgttcaggccagaggatctccaacccggttttttgatgaaacatcagggaagttgatttgccgataccataataggatagcttatcaggccatgataggccttcttgcagaagctgttcattagcgtagtgaacagcgttttttgacaacaggaagactaaatcacccgccgacagccgttggagtttctgtgacagcaacggcaaatcgcccccgggataaatcgtaatgagtggcgcactgaaggctatttttcccatagccctcagtcgcttggccaactgctctcctgcgggatctgggcgggtgatcaaaatgctcattcaggaggattcctctggtagacgtcagccagaatctggcgcgcacctttttccaataattcttctgccaattccacccccgcgcgacgagcctcttctggtgatacggttttttcaccacgaacagttatactgccatcgggagctccgacaagtgcgcgcagccagatattgtttccctgccagatagcatagctgccaatgggtacctgacagccaccctcaaggtgggtattcatggcgcgttctgccagaacgcagatttctgttcctgtatggttcaagggagcaagtaactcacgggtttgcttatcatcaaggcggcactcaataccgacggcaccctgaccgactgcgggaaggagtaactccggttccaatggcatacgaatgcgatcttccaaccctaatctcttaagacccgcagctgcaaggataatggcatcataatcgccgttatcaagcttgcccagacgggtacctacattgcctcgcaggtcacgaaccaccaaatcaggacgtaactgacgaagctggcattggcggcgtaaactggatgtaccgacgatactgccaatgggcagttcatcaagcgaggtatattttactgaaacaaaggcatcccttggatcaccccgttcgcaaattgtgaccaaccccaagccgtcaggaaattccacagggacatctttcatagaatggacggcaatatcagcccgattttcgagcagtgccaactccagctcttttacaaataaccccttaccacccacctttgccagtggagtatcgaggatcacatctccgcgtgtcaccattggaatcagctccactttcagttctggatgaaactgttccagttgcttttggacatattgggcttgccacatagccaacgggctttggcgggtcgcgatacgaatgattttcattgtcattgataattatattggataatcgtattaataacggtatttaggggcttttgagccgctaaattgcgagaagatagagtcagttttaacatttcaatacatttttttccagttaggtaaaagccagaaaaaacctggatagattatagatatacaggttgtgagataaaaataattttaaatattaaaataatattttatttaaatagagaaaataaacaaacagattgatttaaaagcagattactatttgaaatttatcctgatggaaaaaacggaaggagaggtatttactaattaaaaatattattagtttaagcacttatgtaaaccttatggtattacaatgctttacataacttatatgaaaaataatcaactataatccctttttcaaaaaacgtattattatgtctattctgtgattaatgtaatattttacaatgagttagttgattatcgtctattgcggagagggcggaaaggtggtattgcgtactttacgcttcgactgcaaggtgttaaattgatcacgtttccgacaataattttgtaaaaatttttaaaagtcatcttgcaatacgatgctttatcggaaacgggggctactttaggcactggaactcaatcaggcgaaactcttgtatctctatattgaaacattgaagcagcgactggatgcaattaaccagcttaagttagagcgcgcgaccagctcaatgagtcccgtttttaagcaggtctataatttaattccggtattattgcattatcatcatccaatgatgcccggttatatcaaaagcaacgttcctcatggcgtttgtttcttcacgcctgatgaatctcagcaattttggattaatgatctggcatgtcagtctgctgatattttgtcactcgctcccaacggtgagctgccgattacgggtatttactcgatgggcagcacctcttctatagggcaaagctgttcttctgacctggatatctggatctgtcatcaatcctggctggatcataatgaaaaagcgttactggaacagaaatgcactctgatagaacagtgggcggggtcgctgggtattgaggtgacattttttctggttgatgaaaatcgctttcgtcataatgcctgtggcagcctgaacggggaagactgcggaacaacccagcacatccttctgctggatgaattttatcgcacagcggtctgcatggcaggtaaacgtttgctgtggatgatggttccggtggaagaagaggggcagtatgacgaatatgtgctgtctctttatgcccaaggtgttttgacgccaaacgagtggctggatctgggcggattgagtgaactgtcagcagaagaatattttggggcaagcctgtggcagctctacaagagtgttgactctccttataaagcagttttgaaaagtctgctgctggaggcctactcatgggaatatccgaacggaaaattgctgtcaatggagatgaagcaacatttccatgatggttctattgtttccttcggtcttgattcttatagcatgatgcttgagcgtgtaacccgttatctcaccgcaacgaacgatttcacacgtctggatctagcgcgtcgttgtttttacctgaaagtttgcgaaaagatgctggaaagccacgaggataaaggctgtacaggatggcgtcatcaggtcatgtcgcagctggcgcatgagtggggttgggatgccggcaaattggcaatgctggataaccgtaattcatggaaaatcgggctagtgcgtgatgctcataatgaattactggataccatgatgatgagttatcgcaatttgatccgctttgcccggcgtaacaatttaagtgtgagtgccagcccacaggatatcggtgtactgacccgtaaattgtatgcagcatttgaagctttgcccggtaaagtcactctggtgaatccacaaatttcaccggatctgacagaacaggatctgacgttcatctatgttccgcccgggcgtgtaaaccgtagcggctggtatctttacaatcacgcgcccacgatagaatcgatcatcggccaccagccactggaatataaccgctatttaaataaattggtggcgtggacctattttaacggcctgctgactaaaaaatctcgtatccatattcatcacgggaagtcgcaatgtgaccggaataatctgtgtgatttggtgaacgatatcgctacccattttccaatccgcctgcctgcgccgacgccgaaagcgttatatagcccctgtgagattcgtcatctggcgattattgttaatttggaaaaagatcccactacggatttttccaatcggatcgtgcattttgatttcagaaagctggatgttttcagttttggtgaattgcagcaatgtctggtggggagcatcgacctgctttaccgtaactcgtggaatgaagtgaggacattgcatttcagtggcgaacaatccatgctggaagcgctgaaaaccatactgggcaaaatgcatcaggatgcggcaccacccgctgaggttgatgtgttctgctatagcgagcatttgcgtggattgatccgaactcgcgtccagcagttagtttcagaatgtatagagttgcgtctgtgtagtaaccgtcaggatcccaatcgctttaaggcgttacgcatttcaggccagacatggggtttgttttttgaacggttaaacgtttcggtacagaaattagaaaatgctgtggaattctatggcgcgatttccaatactaaattgcacggcctgcccgttaagatagataacaaagaaaagcatttacctcccgtgatcgatgggtttgcctgtgaaggaattattcaatttttcttcgaagatattgaaaaaagtcaggggttcaatatttatattcttgatgagtcaaatcgggtagaaatttattcccattgtgagggcagcaaagaagaactagtctgtgacgtcagccgtttttattcttcctcgcatgatcgttttacttatggctcgagttttatcaacttcaacttaccacagttctatcaaatcatcaggaaaggtgagcgtactcatgtctctccatttatagatggagtgtttccaccggataatacgaaacttaatgatacagcgtacagtgttgatgtacttctggatgattcgtgtaggtcacatgatccttgtcattcgttgtatccctattgatataaaacgaataatttaaaaatacgtgaatttccggcatattatatattacatttaaaacgtatttttattatttatttatttatttatttaattaattaaatatagatttatattgtattttactataataaaaacatcgttaattaatttgatgttaatataaaaaattaattaattagtaataatatttttctttaatatctatatttcagacttatattaatgacttgttgtattttatattttatattttatattattgcaattggttttatggtgatctacagcgattaggtttatggaaggtaataaaaatgccgtatttcaatacggcataagcggtaaattatctgcgtagtagcaaaacaaattctaaaactgaaatgattcgccactctgttctgtgatcgactgttccagcatggatagaaaatcgttaccactacggtcacaaatccatcgattttcctgataatcaaagtggtagccaccacttttggttgccaaccagatttgatgaaagggttcctggcggttgataatgattttgctgccgttttcgaaagttagcgtcattacgccgccgtttgtttcacagtcaatatcggcatcgccatcgtagttatctagttgctcttcaatacgctgcatcaattgatcggccaattgatgaaattcgctatcgttcatgttcatttcctatttgcttttcagggtctaactgcgattatagagagtattgacgcatgaattacaggcattaattattatgatgaaaaaacaattccgttggtcactggctatcataacattacttgcggtttctggttgtggcttgaaaggtcctctttatttcccgccggcagagccgactgtgacacaggctcccgcagatcaggaaaataaagcacagccagaacacaatacacaatcggatactcaacaaaaatagcaccgataatctggtttctcttggagcagtctatgttggagtagtatatgcagttctccaaaatgcatggtcttggcaatgattttatggtcgttgatgcagtgacccagaatgtttatttttcgccagaattaatctgccgtttggctgatcgacgtactggcgtgggctttgatcaattactgatcgttgaagctccctacgatcctgacttagactttcactatcgcatttttaatgctgatggtagtgaagtttcccagtgtggcaacggagcgcgctgctttgcccgttttgttcgcttgaaaggattgaccaataagcgtgatattaaggtcagtacgcaaacaggccggatggtactgagcatcaccaatgatgatcaggtctgtgtcaatatgggagaaccggactttgaaccacagcatgttccttttcgtgccattaaggcggagaaaacctatattatccgtgccattgaacgcaccgtgctctgcggtgtcgtgtcgatgggaaatcctcattgtgtgatacaggttgaagatgtcgacaccgcagaagtggagattttggggccagtattggaaaatcatgaccgttttcctgagcgggcgaatattggtttcatgcagatcatgaatcgtagtcatattcgattgcgtgtctttgaacgtggtgcaggagagacacgggcttgtggcagcggtgcatgtgcagccgtcgccgtcggtatccagcaagatctgctgaatagtcaggttcgcgttgatctgccgggtggtttcctgcaaatttgctgggacgggccgggcaagccactctatatgatagggcctgcaactcacgtttatgaaggtacgattcatttgtgatggattcagttttatctgagtcattattgaaatatggggcattggaaaatgggtaaaaatgacgatccactgcacttggaaaattggctgaatgatcaggcggtagtggattatttgctgaataatcctgagttttttatccgcaatgccaatagagtcgataagatacgcgttcctcatccggtgcgtgaatgtgtctccctgatggaatggcacatggatcgccagagaaagcgcatctgtcatctggaagacgatttgttacatttggtggagcaggcgaaacagaatgaaatactgttttgccgtctgctgcaattactcgctgatctctccgctgccaaaagtttgcaggactttctttcccgcttgagttcatggtcgaaaacctttgggttgagtaatagttatgttcggttattcagtgataaatggcgtcttggtgcgccgctgaatgcgccggagctggctatctcgcgtcatatttttgagcctgtccgcattcagcgatttggtgacagtaaccattatcttggcacactgtatggtccagaaattttactgctgataccacaggctcgctatgtaggttcagtcgctatctcccttttgggttcacggggggagctgggcatggtgattttcaacagccgcaataaacagcactatcatgaaggtgtgggaaccgatctacttgatcatctggcgaaattgctaccggaattattgtcccgctgggtagaacgagtatgactcagccgcttgacttgctgcttgaaccagtagaaacctttttgcattatctgcgggttgagcgtcgtttaagcccattgacgatcactaactaccgtcgtcatttggtggttctggcatctatgtcactggatatggggatacatgagtggcaggcacttgatccggctaaagtcagaatgtttgcttcccgcagccgtcgggcggggttgcagtctgccagcctggctctgcgtctttcttctctgcgtactttccttgattggatggtaatacagggggaactggatgccaatcctgccaaagccgttagtgcaccgcgtaaaaagcgccatttgcccaaaaacatggatgtggacgaagtcaatcagttactcaatatcaacctgaatgatccattgtccgttcgtgaccggacgatgatggaagtgatgtatggtgcaggtttgcgtttgtcagaactggttggcctggattgccggcatctggagctggcaagtggtgaagtctgggtgcagggtaagggcagtaaagaacgtaaagtacccgtgggtcgcatagcactggaatggctccagcgctggcttgaaatgcgggaattgtttgagccggaagataatgccgttttcatttctaccaaaagcggaaaacggatctctgcccgtaatgtacaaaaacgatttgaacagtggggcgttcgccaaggggtcaacagccatatccatccccataaactacgccactcttttgccacgcatattctggaatccagtggtgatctccgtgcagtgcaggagttgctgggtcatgcgaatttatcgacgacccagatctatacccatctggatttccagcatctggccaaagtctatgatgtggcccatcccagagccaaacgaggaaaatcataatgcgtttttatcggcctctcgcgccgtttgctgcgatgacattcgatctggatgatacgctttacgataatcatccagtaatcgataaaaccgaaaaagaagtgttgtgttttatcaggcagtacgatgtcaagttcaatcattttgagagagaagatctgtatgtgtaccgtcaggcggttcttgagtcggagcctgaaatttaccatgacgtgacatcttggcgccgccagtcagtagaattgatgttcagccaccacggtttcaatcgtgaggagaccctgcgtggtgcggatgaacttatgtcctgctttacttattggcgtaatcagatcatcgtgccggaatccacctataatactttatctgtactggcgaaaaaaattccgttggtggcgatcactaatgggaatgccgaacctgctgcgtgcgggcttgaaccttattttgagtttgtcctcaaagcgggggtggacgggcgggctaaaccttacccagatatgtatcatctggcggctgaacggctgaacctgccaataagccagatcctgcatgttggcgacaatctgaaaactgatgtggaaggtgctctgtgcagtggcatgcaggcctgctggattaacctcgaaaatagaaacctgatgcaggagcccgaagggcgccgggttccacatgttgagatttctgatttggcttctttgatcgcactgatataatttcatattgtgatctgtataaaaaaaacagtgacaaaagtgactgttctcaattgatggtaattatggacgtttcttatctgctcgaaagcctgaatgataaacaacgcgaagctgttacggcatcgcgtaccaatatgctggtgctggctggggctggcagtggtaaaacgcgcgtgctggttcaccggatcgcctggttactgtcagttgaaaatgcgtcacctttttccatcatggcagtgacttttaccaataagtcagcggctgaaatgcgccaccggattgaaaacctgattggcaccagccaagggggaatgtggatcggaacattccatagtctggctcatcgcctgctgcgttttcatcaccttgacgccaatctgccgcaagatttccagatcctcgatagtgaagatcagcacagactgatcaagcgtattatcaaggcgatgaatctggatgacaaacagtggccagcccgtcagggcatgtggtacatcaacggtaaaaaagatgaaggactgcgccctcagcatatcgaaatctacggcaatccggtagaaacgacatggatgaaaatttaccaagcctatcaggaagcgtgtgaccgcgccggattggtagattttgccgaattactgctgcgtgctcatgaattgtggctgaacaaaccgcagatcctgcaacattatcgtgagcgtttcactaatcttatggtggatgaatttcaggacaccaacagtattcaatatgcttggatccgcctgctggcaggagatagcggcaaggtgatgattgtcggtgatgatgatcagtcgatttacggctggcgtggggcgcaggtggaaaatatccagcgttttctcagggattttcccgccgcagaaaccattcgtctggaacagaattatcgttccaccagcaatatcctcaaagcggctaacgctctgattgctaataacaacgaccgattgggtaagagtctgtggacagaaggcggggaaggtgaaccgattgcactttactgtgctttcaatgaactggatgagtcacgttatgtggtcagccgtatcaagcattggttggataacggcggtgcactgaaagagtgtgcgatcctgtatcgcagtaatgcccagtcccgtgtgttggaagaggcgttattgcaggtttctatgccttaccgcatttatggcggccagcgcttctttgaacgtcaggaaatcaaggatgcgttgtcttacctacgtttagtatcgaaccgttatgatgattccgctttcgagcgtgtggtcaatacgccgacgcggggtatcggggatagaacgctcgatgttgtgcgtcaagtggcgcgtgatcagcagaaaacgctatgggaaagctgtctgctgctgcttcagcaaaaagtgttggcggggcgtgctgcatctgcattgcagcgttttattgaattaattgacgcgttggaaacggaaacgcaggagatgccgctgcacgtacaaaccgaccgcattatccgtgactccggcctgtgggcgatgtatcagcaggaaaaaggcgaaaaagcacaggcgcgtatcgaaaaccttgaagaactggttactgcaacccgccagttcagttttaaggatgaagatgaagacttgatgccattgcaggcctttttgtcccatgcggcactcgaagcgggggaagggcaggcggatgtttatcaggatgccgtacagttgatgaccctgcactctgcgaaaggtttggaatttccgcaggtcttcatcgtcggtatggaagagggaatgttccccagccaaatgtctcttgacgaaggcgggcgattggaagaagaacgtcgtttggcctacgtgggcgtgacaagggcgatgcaaaaactgacactgacttatgccgaaacccgtcgtttatatggcaaggcagtgtatcatcgcccgtctcgttttgtcggggaactgccgacggaatgtgttgctgaagttcgtctgcgggcaaccgtatcacgtccggtcagccataagcagctgggaacacctatcagtgccggcgacagtggttacgcacttggtcagcgtgtacatcatccgaaatttggtgaaggaacgattatcaatatcgaaggcagtggggaacattgccgcctgcaaatcgcgtttcaaggtgaaggtatcaagtggctggttgctgcttatgccagacttgaaacaggccaataataatccggtcgaatgttgacaggctttttcgtctaagcgtaacattcgcgccttacgataaacgtagggagtataaggagacttatggtacatgctgaacgcatttaaattagagaataatcgcctgctccgtcttgagcttgaaaacggtgatcagttatctgactctatgtgggtagatttagtggggctgggagatgaagatcgtctccgtgttcagaatgaactggggcaagtactggcaacccgcactgaattggatgatattgaggcatcggcacgcttttttgaagatgaagatggtctgcacgtccactcattcttctactttgaagatgccgaagatcatgctggtaactcgacagtggcatttaccatccgtgacagtcgtctctacacactgcgagagcgtgaacttcctgcatttcgattataccgaatgcgcgcccgcaaccagactatggttgacgggaatgcctatgagctactgttggatttgttcgaaactaagatcgaacagttggcagatgtgattgaaaatatttacagcgtactggaatccctgagtcgagttatcatggaaggcaagcagggggatgaatttgactcagcgctttcaaaccttgccgagcaggaagatatcggctggaaagtccgtctgtgtctgatggatagccagcgcgcgctcaacttcctcgtgcgtcgcgcccgcctgcccgctaatcagcttgaacaggcccgcgaaatcctgcgagatatcgaatctctgttgccgcataacgaatccctgttccagaaagtcaactttctgatgcaggcggctatgggtttcatcaatatcgaacagagccgcattatcaaaatcttctcggttgtttccgtcgtattcctgccgccaacgctggtggcttccagttacggtatgaacttcgaatttatgccggaattacactggacatttggttaccctgcggccattggtgtgatgattgccgcgggattagcaccttacctttatttcaagcggaaaaactggctgtaataatccccgcccattggtgggcggagggataattcggctacttgcgcaagcggtgctgggtgtacagagcatccagcgtaaacaggatcaatgcagcccagataaaaccaaacgtgatcaggcgctccggaccaatttgttcaccataaaccagcgttgccagcaaaaacatcagcgttggaccaagatactggaaaaatcccagtgtggataaacgcagatgagcagcggctgcggtgaaaaacagtagcggaacagtggtaatgatacccgcggcaatcaacagcatgttcagtgatagcgtgttatctagcatattgctggttgggctgctggtaaaacagagaagatagaccatcgcgaccggaaatacccagacagtttcaatcatcatgccggtttgggcatcaacgcccaattttttacggatcagcccataaacggcaaatgtcatcgccaagtacagtccaaccacgggtacagagccaaattgccataactgaattaatacgccggtgaaggccagccctaccgcaacccattgcatccggcggaaacgctcgccaagaaatatcatgccgaacagcacgttaaccagtggattgataaaatacccgaggcttgcttccagcagatgcccattattgactgcccagatatagacaagccaattactggcaatagtgaaagcggtgatacctaacagtagcagttttttcggttgacgggcaacgacccacactttacgccagtggcgtgtcagcgttagcagtagcaccataaagaacacagaccatataacacggtgcgacacgatttcatcgggcggtacctgttgtatggtcttgaagtagatgggagccagcccccagataagataagcgcccaaggcatatagaacgcctttggcagtctgttggtcagtcataatatccttgaatgtaaaataaaatcagaagagcttgtgaattgttagcactcatacaatgtgtcactgggatgaatgatttacaaggggttaatgctgtgagggatgaataaaattttgccactcaatttaatggcgttttatacttaatttgtatttattaaaaaataattcactatatttatacaatctaactcatttttcatctcaaagtttgtgtgttcagaagtggattaaaaaatgaactttcgtggttgatggactaaacgtaatttatctagaaattagcctgttctaatcttatacaatcaatgtaactgactattttttatcattaaattatctaatgctctatcccgatagtaggtgtttatatgatagtaaaatcggtttttttatttagagtgctattttcatcaataagaaatcgataacacaatggttcatttcagtcatgacatcaatttattgaatcctgtatagtctgcctatttggcgaacattcagatggcaaagattgatgtgacctgcccatcttgttgtgcagttaaagggggtcaccgtaatgggcgctctcgctctggtcatcaacgttatctttgccagtcctgccgtcattcctggcaacgggaattcactgatgcgtctgatggcgctactggcatgaaatgcaaattattttgataaaaaaacattactctaatttaatgaattataaccaagagtacttgttattttgaattacatgagcataaggtagcacaatatgaaaaaaattatttttttagctataggtatgtttgctctagggtttgatgcgtatattatagcagggcttgtaccggggatcagtgaaacctatcaaaaaagcgcctctcaaatcggacaatctgtaagtatatttactttatgttatgcaatatcagccccactatttgcatctcttttagcaggaaaacctataaaaaaggttctattaaccgctatagtaatttttggacttgcaaacgcattaacggctctttccccaaatttttctgtattcttgatatccagagcgattgcaggtgttggtgctggtttgttttcaccattagctgtagccggctcgactctgttggttcctatagacaaaaaaggaagagcacttggcctaacaataggtggaatgagcatgggaactgtgttaggtgttcctataggtctttatatcgccgaccaatttaattggcaatctgcaatgtggtttgtcgttattctgagttttattgctgcgttaagtattctaaaatttctaccacacgttccagtcacagcaccacctgcaataacagaaagaatcgcaatgtttttggataaaagggtcacaatcactgtactaataacattttttgcaagtattgcaagtttaggcttatacacctatttatctccattattacaagacattaatgattcaaataatttaacaatgtatttatgggcttggggtctggggggattatttggaagtttatcgattggatatataattgactactttaagaagccaaaaattttaatggcatttatattaattattttaatgatttctgtcatgtgtattccgataatgattaatctatcatttataaaatatttaccgttctttatatggggtgctatgggatgggcatcaggggcacctcagcaacatattttattatcttatcaacctaaacacggaagtgctgccatagctctcaatagttcgattaactacctaggaagctcggtaggagcgataataggtggagtagttatatctctgggaatgggaactatggttttaatctatttcgcggtattttctatggtaatttcattaggtcttcaattttatagtatgaaaagcaatgattttaaaataattaatactgaatccagccaataactactgtagcgcgccgcgtgaattgaaaaagggtgccatttaaaatgagaaaattcacgtatggtgattttatcaaaacacgcggaatatttagattgttttataataaaataaatgactttatttttctcctctgggagtcaataaaaagtatcacccaaccaaatacgtcgccattgcgctggcgatatgcacctgccgctcattgtgcagttcaattctggcaactgatactttgttgccactacggacgatattgctgctggcggtgaacacttcaccgcgtcccggacgcagataatcaatacgcaaatcaatagttccgatggtcggcaggcgtttttccatttctgctatcgtgatggtttccattgccgtcagagcgttgcctgcgcaaatcaggccaccggcaacatccaatattgaggcaatcacgccaccgtgcaggattttctgggccatgttgccgaccagcttatcttgattgcgaaattgaagctctgcatagtcgtgatcaaagcggagtaattcgaatcccagcaattggttgaatggcatgtgataaacaaataaatcaccaataatcttacgggcttcttcctgtgttaatggctgggttgatcgctgtattgtttccatgtcggatttcctgatgttaaaaagtcagtaagctgatgttgaacagaaccttatggttaataatttgttaagtttatgcttttataactcatcttaccagtttgcgaagcacctcgaaaaacaatttattgaaggaaaacttactacagaaaatcaccattcagtgtgtagaataaacaggtgacgttttagttttgggatagccgtttttatacccagtgatttcagtggatatggagaatccatgatcgatgatgatttcgggaagatccgttttggcatcgacaccatgctgaatgatatgctgtcattgtttcaacagtgagatagcatagtatgtacaggcacctgaatcgcgtctgtattttttactgcctgttttttttaaatgattgagggaaggcgtgtctaccgcagaagtcatcagcacggcatcgctggctgaacaagtattacgaaaaacattcggatatcagcaatttcgtcccggacagcagcaggttattgatgctgttctcgatgggcgtgattgtctggtcgtcatgccaaccggtggcggtaagtcgctgtgttaccagatccctgccctgatcaacaatgggctgacgttggtggtttcgccattgatctcgctgatgaaagatcaggttgatcaactgagggcgaacggcgtagaagcggaatgtttgaactcaacccaaaaccgtgagcagcaggttgatatcattcaacgctgccgtcaaggaagcatcaagcttctctatatcgcgcctgagcggctggtaacagataattttctcgatcaattgcatgattggcaccctgtgctgctggctgttgatgaagcacactgtatttctcaatgggggcatgacttccggccagaatatcgcgcgctggggcaatttcgccgacgctttcctgaacttccatttattgcactgacagcaacggcggacaaaacaacccgtcaggacattactcgcctgctggaactgcacgatccgcttatccacctcagcagttttgatcgccccaacatccgctatacattggttgagaaatataaacctctcgatcaactatggtcatttgtgcgtggtcagcagggaaaaagtgggatcatttactgcaacagtcgaactaaagtggaagaaaccgctgaacgcctgcaaaagcgggggctgagtgttgccccttaccatgctgggctggataacaatcaacgggcatgggtgcaggacgctttccagcgtgacgatttgcaggtcgttgtggcaaccgtcgcttttggtatggggatcaacaaacctaacgtacgttttgtggtgcattttgatattccgcgcaatatcgaatcctattatcaggaaacaggcagggcggggagagacggcctaccggcggaagcgatactgtttttcgatccggcggatatggcatggttgcgtcgttgcctggaagaaaaaccggcaggtgagcaacaggatattgaacggcacaaattgaatgccatgggcgcatttgcggaagcccagacttgccgtcggctggtactactcaactattttggtgaaagccagcagacatcatgcggcaactgcgatatttgccttgatccaccaaaacgttacgatggtctgatggatgcgcaaaaagcgctttcctgtatctaccgcgttggacaacgttttggtattggctatattgtagaagtattgcgtggtgcaaataaccaacgcattcgtgattttggccatgacaaattgcccatttacggtatcggtaaagaacagagtcaggaacattggatgagtgtcctgcgtcagcttgttcatctgggattgattagccaaaatatagccaattattcggcgttacaattaacagaagcggcacggcctgttttgcggggagaagcgtctttacaacttgcggtaccacgtatccaaagcctgaaaagccggaatcagcaaaacaaatcatacagtggcaattatgatcgtaagttatttgccaaattgcgcaaattgcgtaaatccattgctgacgaaaataacattccaccttttgtcgttttcaatgacgttacgctgattgaaatggcagaacaatgcccgataacacctaatgagctcctgctgattaatggtgttgggcagcgtaaactggagcgttttggcgatgttttcatggcgctcatccgtgatcattttgaaggttttgaataaccagaagatattaatagaggatgatgaatggcgcctgagatattgaaagcaagctggttaaaccgcgaacctcagttctctgcgtttacgaatggactattactggatttctggaaaaccagagacgaacgggaatttatgggtgttgatgatatccctattcgttatgtctctttccgttctctccatcacgataaaacgttgttgatcctgccgggccgcagtgaaagctatgtgaaatatcctgaaatagcctacgatttttaccacttgggctacgacatttttattattgatcaccgtgggcaggggcgttcagggcgaatgcttgatgatccccaaaaaggccacgttgaaaaatttgatcactatgtggatgatctagccaaatttgttgaattggaaattaccccgcgtcagtctcacggttattatgcgttggctcattcaatgggagccgcgatcctcagccgttttctattacggcaagaacttgtacgtcaagagcctgattttcgggcggtagctctgtgtgcaccgatgtttggcatcaacttaccgatgccgcgctggttggcaaattttctggtcaatcaggctgaaccttatcctaaaaggcgtaacagctacgcggtatcaacagggcagtggcgtccgttgccctatcttatcaacctgttaacccacagttatgcacgttatcagcgctatttacgctattatgccgattatcctgaattgcgcctcggagggccgacttaccactggatgcgtgaaagtatgcaaatgggagacgaactgattgaaaatgcaggggtaattcagactccgcttattgttttaaaagcgagtgaagataagatcgttaataatcgggagttactggcattttgtgaatctcgacaaaaagccggaacaggaaaagcaggaagaaaacctctggtcatccaaggggcacatcacgaaatcctgttcgaaaaagatgcattgcgggcgcaggctcttaatgcaatttgtgatttttttgaccagcactgatttagtttaggaactataaccatgtatcatgttgttgcttcagacttggatggcacattattgtctcctgaccacaaattaacgccgtataccaaagaaacgctgaatttactgatgaataaagggattcactttatttttgcgacaggccgtcatcatattgatgtagggcagatccgcgatggtttgggcattgatgcttatatgattacctctaacggggcgagggtgcataatactcagggaaaattggtattcagccataatctggcgcctgagattgctcttgatttgtgcttaatggagttcgataaccctaataccctcaccaattattaccgtaatgatgattggttcattaaccgtgaaagccctgaacagaatgagttttttcaggaatctgtttttcagtatcagatttttccgcgtgataatttccccacggatggcgtgtgcaaggtctattacgttagtgaagatcatgactatttggaacagttggaagaaactattaaagcgcgttggggagatagcgttaatgtcagcttttcactgaggaattgtctggaagtgatggcgggtggtgtatctaaaggccatgcgctggaacaagtctgtcaggccatcggatatcaattgagtgactgcattgtttttggtgacggcatgaatgatcaagaaatgttatctgtggcgggtaaaggctgtattatgcagggcgcacaccaacgcctgaaagacatcttgcctgaaatggaagtgattggcgctaatgctgatgatgccgtttcatactatttgcggaacatgtatcaagtctgatggtaatggttcggaatgttgattgagagcagcacctgatggggtgctgtttttttctggccatttttggaaatgatatttttattatatacaatgattagttatattattttttataaatgataaatacttgttctgatattatttttaatagttattgttattccaaatataatggttttaatcatttaatcatttaatcatttaatcatttaatcatttaatcatttaatcatttaatcatttaatcatttaatcatttaatcatttaattatttaattattttctggtgaatttaaactctaaaatatatttatcttaatgatttttattataagtactcaataaaagttaattgcaaattgctcaccataacactccaatagagtatttagctcatactccattgtatcctgagtccagatgataaaacgtcgccagtgatttttattccttcacttgcagtggtgatccgtcgtctccatgatactaatcgctccggttggtggtttttactggcttttgttccgattttaagcatcgcgttattggtattcttctgcttggaaggatctaaaggaaataacgattttggagcagatcctaaaggaatgctttaatatctaaaagtgtatcactaattgagaaattggttttgcatactcataaaacggtcatgtattgaatagttagatcacttgctaaacgtagttttctcgctcaataaatgtccctatcactttgtcatgcatctcttccgatttagagtagccgattgtttttctattcagcctttttagtcgggtacgataggtaagattatttcactctattcgttgggtaaacatctttccaacaagatggttttcttccagagggcaatgataaacagcataatcatccgtgcagtggaaccgaatgttaaggggggacagaagcgataacgggaatacccttcatttccttttccatgtccttttacgtcttctggtttgtgacaataacgatagtgaacgtcaactttagccatgtttcaccataaaaaggctggagttatcacaacaactaaccattcaatacatgaccccatttccctcctatcagttgtagcctcagttgaattttcaggatcaaatcaagatctgtgtataaaattttgggtaagtccctaaaatcaccccaggaatgattcatgatatcgaagactatagttttatctgcattgatcgttttcagtatgagtgctgcctatgcaagccaagagaagacgggatgtgaaataaagaaaaaaacactggagaaacaacttaaatacgcacaggcagatggagataaacgcctgattgcaggattgacgcgcactttagaaagtataaaggccacttgtgagctggaaaaacgcttaaaatatccacaacacaacccagagccgacaaaagatagacttaaaaaagtgcagaccaagaagaaatagcagacctgcaccaaaacacctatcaaccaatagctagggtataactacaagcttcttcccctgacttgctgtgcattagaaggggagattttgtaataaactttatcgcccataaatggcttattttcaatttccaccgaaaggatcgagttatctctggaaatcgcataatagataaaatcatttcctgttacatcataaggataattaaaatcgggtttaagaaatttcttctcgtaagactctgcatgggggtaatattcatccgaataaatcaccttctgatttttaacaaagataattttataaaaaagactggctttccccgtaaatgctgcaccgatgatatattcaatatcctcacgacccattcctttatcgatgatatacattttatcccaatcaaaagacgtgattttattcacatcgatcaaacaggccgtattcttctgacaatgtttatcaacataaccaataagactcaacctgctgttattaaaagataaaaatacaatggaaattcccaatattaacgcaaatatgataataatattcttgttggcaacatggacaaacatcattcccccttcataatcaaatttgatatgagaaaacggtttttagaattttacccttggcaatcaactcattactattaaagctataacatcggtcttatcactattgctcatgtcgtaatattgataaacctaatttgaaagagtccccctctgctttcaatcagcagactgatcttttggagtttacaatatgtcatgagggtatatcttgagttgtgaagaagttgctacattacttacaagcaactgttttacaattgctatttaatcttttaagtgcaacttacaagataaaaaattcaaccccctttttgttcttcctgcatttaaagaacactatcatcggtgctctatacagcgaaaaagtatagtaattgtactagaaattttttttgttacaaataggaaaatatggtaagcaaataatagatgaaataaatcatcactaatgtgaaaggaaagcagacttgcgtggaggtttacataataagaattggagcgggaaacgagactcgaactcgcgaccccgaccttggcaaggtcgtgctctaccaactgagctattcccgcttacatatcgatgtatggtacttttggtgtaatactttcggtatgccgtactgttgaaattcttcatcggtacggggagcgcattatacgaaaaatcattgccctgacaagcccccaaacacaaaaaatcgcgttctttgctctgattgatgattaaatcagcaagaaatctgtttcatcatcaatccagagattaattatcgtaaacctcgtgcaccaaacacactttttatttctggataaagtgctcgcggtagtaaaccaactcagcaattgattcccgaatgtcgtccaatgcctgatgagtatttttcttgctgaatcccgacaacatttcaggcttccagcggcgagccaattctttgagcgtactgacatccagatagcggtaatgaaaatatttctccaactctggcatataacggaacaaaaaacggcgatcttgacccacactattcccgcaaataggagattttcccgcaggaacccactgctccagaaaagcaatcgtcgctttttctgcttccgcatcaccaaactgactttgtttcactcgctcaaccagcccacttgcagtatgcgtccgcacgttccagtcatccatcaatgccagttgttcatcaggctgatacaccgcaataaccggcccttccgcaaggatattcagttccgagtcggtgacaatggtcgcgatttcaattatgcgatcgcgctctggctccaaaccggtcatctctaaatctatccagataagattgttctcactttttgacatgatatatcctagtttccttcaaaacagatagtctgtattagtggtgtatcataacgtttttgatcactcacagcgataatcagcaaaatagatgaaattaagtgaggttaggtggctaagaataaactctccaaagggcaacaacgccgtgtgcaggccaatcaccagcgcaggctgaaacagccgctcaacaaggctggcactcataaaccagaaatggatgacagcctgtttggcgagccacaggaaggactggttatcagccgattcgggcagcatgccgatattgaagccgcagatgcgtccatacagcgctgcaatattcgcaggacaattcgttcactggtcacgggtgatcgtgtcgtatggcgacccacattacagctccaaactgatgtcaaggtcaatgggatcgtggaagctgtgcatgaacgcacctccgtccttactcgccctgattactacgatggcattaaacccattgcagccaatatcaaccaaatcatgattgtttccgccatcttgcccgaactttcgctgaatattatcgatcgttatctggttgcgtgtgaaacacttaatattgagcctctgatcgtgctcaataaaatcgatctgttggatgccgaaagccgtgcatgggtcaacagtgtcatggatatttaccgccacattggctatcgcgtactggaagtttccagccataccggagaaggcgtatccgagctggtttcccagctggtggataaaatcagcatctttgcggggcaatctggggttggaaaatccagcttgctgaataccctgttaccagacaatgaaaaagatattctggtcaatgaagtatcggataactccggcctgggtcagcatacaaccacaaccgcacgcctgtatcacttcccacagggaggcgacgttatcgactctccgggcgtccgtgaatttggattatggcatttaacgccagaacaggtaacacaaggtttcattgaattccgtgaatacattggcgaatgcaaattccgtgattgcaaacatcagactgatcccggatgtgccttgaatgcagcactggagcagggagcaattgcagaagagcgtttcgaaaattaccatcgaattttagaaagtatggcgcaggtcaaaccacgaagaaatttcacggatggccaaaaataagacaataattaacgatacgttaccctgacattcaacataatggcgggtacaatagtagacttttgcccaatttgcctatcaaaaatccaagaggttgatgtgctggataatattaaaattaaattgcaatatttactgccaaaacaatgtattactaatttggcaggctggttcgccaataaaaaggcgggctggttgacacagtttgcaattcaatctttcgccaaagtctataaagtagatatgaatgaagccgaaaattcttcattcacagcttactcaacattcaatgaattttttgttcgcccattaaaagagggcattcgtcccatcgtcaatgaagctcaccagttggcgctgccagcagacggaaccatcagccagctcgggatgatccgtgacgatcaaattattcaggctaaaggtcactactataccgtagaagctctgctggccggccagcatcaacttgctgaacagttccgcaatggccatttcgtcacaacttacttatcacccaaagattatcaccgtgtccatatgccgtgtgacggcgtactgcaagagatgatctatgttccaggcgagctgttctcagtcaatccattgaccgcagcaaatgtccctaatctgtttgcacgtaatgagcgggtcatctgcctgtttgatacagctttcgggccaatggtacagattctggttggtgcaactattgtcggcagtatcgaaaccgtctggagcggctgtgtcacccccccgcgtgaaggcatcatcaagcgttgggcttacccagcagcaggtcaggaaggcgcgatttctctcaagaaaggagaagaaatggggcgtttcaaactgggttcaacggtgatcaacctgtttgcacccaatcagattcaatttgccaataatttatacagcggctcacaaaccctgatgggtgacctgttggcacagtctgttacggcaaatgaagagcaggcagcaaatgcagatgatgaatctataaacaaagatatcatcagctaatttttatcaccaaggagccccttattgtgcgcctgattatcagtttacttttcagcctgtttcttgcgaatccggctttcgcttcgatagcacagttggatgaaacccaactgaaacaagagctaaaacaggttggaggcagtaaaaatccacaggatgctgaaatcgcacaggcacttcaaggggcaataaactggcttaacgatgctaagtccaccgatgaacgcagccagacataccaacaaactattgatgattttcccaagatcatcaaagaattgcgtcagaaaactcttactgaaagtgatattgtcccttccattccggccaatcagtctatcggcgagttagagcagcagactctccagaccagtagccagttgttggagcaagagcgtcagctacagcaggaacaggataagatccgggaaatcagtgattcaatgaacctgttgccccaacagcaggttgaagcgaggcgtctgctggcggtggcaacttcccgcctccaatccttgggtacgcctccgacaccgctgaccgaagcacagctgaaactcgctcaagccgaagtcagtgcccgcaaagcggtcactaatgaactggagatgtcacagctttctgctaataatcggcaggaaattgcccgcatgcgggcagatttatttaaaaaacgttatcaacgtctggatctcaaactccagcaattacgcaaccaattaaacattcaacgccagcaaaaagcagaatcggctcttgaacataccgaaatgctggcagagcaggcgggcggaaaactaccgcagtttttgttggatgagctccatcaaaaccgccagctgtcacaactgctcagtcaacaaacccaacgcatggaggccattggctcacagcaacgcaaagctgctaacgatattctgcaagtacgccgaacactcaataccatccgtgaacaggcggaatggctgagtgattcaaccgcacttggtgaagcattaagaactcaattaacccgcatccctgatgtgccgaaataccagcaacttgaccgaaatattgtggaattgcgggtcgaaagactgaaatatgaggaaatgcaggagcgctcccaacaggaaaatggtcaggcattgccttcatctcaaagcctgacatcagggcagaagcaggtctatgaatctcttatccgtaccagaaaagagttattgaattccctgctttcaggttatgacaatgaaatattggaactcacgaaactcaaagtcgcaaccaaccagttaaatgaagctttaaaagagataaaggatgccacccatcgatacctgttctgggtcacggatgtcaatcctatttcactagactatccgttgcttgtcgttcaggctctgacacggctgctctctctggatacgttatctcagctaggggtcgcaattcacgttatgctgaccaccaaagataccctgctctatttactgggtacgctattgctggtgattttcagtatcagctcacatcgtcaatatcatgcgttccttgagcgttccagcaaccgtattggcaaagtcacacaagatcatttctcccttaccctgcgtaccgttttctggtctattgtcgctgcattacccctgccgatactttggtcagccattggttatgggctgcaaaatgcatggcagtacccgatggctaccgcgattgggctcggtgtcagtgagacaacgccagtcctgtgggttttcatgctcagtgcggcatttgccaatccgaatggtctgttcatctcccacttccgctggcctgaagaacgcataaaacgggcaatgcgtttttatcgtctgtctattttcttgatcgtgcctctcatgatggcattgatcacattcaataattatagtgagcgcgaatttgccgcgacactcggcagactgtgtttcctgatgctgtgcgtttccctgagtctggtgaccagcagcttaaaacgcgccggagtaccgctgtatatggacaaacacggcgcgggcgaaaatatcatcaactctgttctgtggtggatactgctatctgccccgatcttggccgctcttgcggctatactcggctatctgcaaacttcacaggcgctgctggggcgtttagaaacctctgtcgccatctggttatccctgctggttatctaccatattattcgtcgttggatgctgatccagcggcgaaaactcgcctttgagcgggcaaaacaacgccgtgcagagatcttggctcaacgcgctaaaagcgaagaagagacggctaatattaatagcagcgtggaaggctccattgaagttgaagaacccgtgatcgatctggatgccatcagcgcccaatctttggggctggtgcgctcgatcctgacgatgattgcgttggtttcactgattctgctgtggtcagaattacattctgctttctcttttctggagaatatccggttgtgggacgtcagcacgacggtcaacggggtcaataccatccagccaattaccatgggatcagttctgattgcgatcttagttatcgtcatcaccacgcagcttgtccgcaacctacccgcgctactggaacttgccctgttgcagcatcttgaactcacaccaggcacaggttacgccatcacgacactaaccaaatacggccttacattgattggtgggattgtgggtttctcactggttggtattgaatggtcaaagcttcaatggctgattgctgcgatgggtgtgggtctgggttttgggttacaggaaatttttgccaatattatctctggcctgattatcttgtttgaaaaacccatccggattggcgataccgtcactatccgtaatttgactggcagcatcacgaagatcaatacgcgggcaacaacgctgtcagactgggacagaaaagaaattattgttcccaacaaagcatttattaccgagcaattcatcaactggtcactgtctgacacgatcactcgtatcgtcttaacaatcccagtgccggctgaaactgattccgcagaagcgactgacatattaatgaccgcatccagacggtcaccattaattcttgataacccgatgccagaagtgtatctggttgatttacaaaacggtattcaaatttacgaattgcgcgcttacgcagcggagatggggcatcgtatgcccgcccgccatgaagtgcatcaatatattttgcaggagttccacaaacatggcattaccttgccattcccgccatttcaggcacgtgttgatatcttcggacaagaaatccgcagtgccacaaccaatatttcgggtcgcaatccaccgcgtaaaccgggagaactataagctcaattcgagatgatgaggcgtataccttttcagataagtggattactggctttaaatggcgtttcgatcttgggaaacgccattacagatattgccattccgtggctgattctagaaatatcaggcagcccactgctggtcgcagccgtgatgtctgccaaaatagtgccgttgatattatccattttctttagcgcacaactagtagataaatacggagccttccgtatttcagtcttatctgatttggtgaacttcctgagcgtcttgctgatacccgtattttatacaatggatatcatgcacttttacctgttagccattctgcttatattctcgacaattttagattctccgggacgtttagcaaaagacgtaatgctggcaaaggagattaaacagaataaaagtgaacatgagttgatcaatggaatcaacagtaccattgaaaatatttgtgacctcactggacctgtattgggttcattgattattgccctgttcggtacaatcaacgccctatacttcgatgcagtcagttttttagtggttgcgctggggctgattattctgaagaaacactttgtcaccaatatcaatgaagttactgagattccttctctgccacaccactatttcctcgaagcactcaaatacgttaagtcagaaaaggaactgttttctattcttatcctgagttcagtggtcaattttgtcatcgctccattcctgatcgtttatttaccttatgtgaataaagtcgagtttaattccgtcgtcagccttggtgtttccatgacctgctttggcttaggcacaacgttttcttccttactgtacggtatttacggcaaacattttgccaacaaccatattatcctttctggctacagtctgtttgtactgtgtttgataaccctaagcctgctcagtgggcaatatattctttttgcccagctatttgctatcggctgttgcattggttttaccgcacctgttgaagtcactttaattcagcgccaagtgccagagaatctgtttagccggataataacgctgttttcttctacgcgctttcttgccgtgcctgtcgggtacgtctgttttggtactctgctgggatccagccttaccaaacaaacaccgttaattatggcaacaatagtattgggtggtttattggcttatctggctatgcatggaagggtgaaatgaagacaactctttttcaaattgacaaactattacaacaccatgtgtctttacccttataccgccaaatataccagcgttttattcaggcgattaatcagggcatattgagacctgaacaacgtgttccgtctattcgtacgttatccagtgaactgcaagtttcacgcagtacagtggaatctgcctatacgctattactgaacgaaggctatctagagtcccgagggcaggcaggtacgattgtgtccccaaagcttgcggacagagtattacagcctcctgaaacacttatatcatcgtctatcgatgtgactaggtcgtgtcccttaattatataaccgcttgtaaaagagtcgaatacagcctaatttcaccatggataaatagtttcgggcggttaatgagcaactgtctttcactttacaccgtgtggaatgattcgtcccacggtctatttgtttttatcattgcattgagaatgaccagtaatttacgcatacacgcaacgatggcgactttgtttggcttgcctgcttcggtcaatctcttgtagaaagcgcagagaacggggttaaatctaattgccgttaacgtggccatatatagcattcgacgcaccattgctcttcctccaaagattgttcgtttcccccggaaaaatccagaatctcgattaaacggtgcaacaccaatcaaggcactaatttcccggcgtgttaacttacccaactccggtacatcagcgatcaaagtggctattgtggcaggcccaacgccttttactgtagataataaatcgagtttggaacgatgataggttttaatgtgtttagacaaggcagattcaatgaccttaagctgttcctgtataaagctgatcattaaagtgatgctttctcgaatgtctggatggcaattccccaacctttggcgttctgagatggaaagtacgaccaattggcgacgacgtgcgatcatggcttgcaagactcgttgctgagcagagggcaatatcctgactattttatcccggtctgttcgttgagataaaaccagggctaactgtgccagcacctgagcatctattttatcggttttggctaagttacccattgccttagcaaagtcacgggcttgtcggggattgacgatagcaacagccagccctatggtctgtaaaacacaagcaacggatacctcataaccccctgttgcttctaatacaactaaatcaatctcatagttggtcagtgtagccgctagttcatcatgaccttcaggggtatttggatatgtcattacggttccctgagcaccaagtgcaatttcaagtgaagctttggcaacatcaataccgatacaaatcgttttagtcatggttcttcggctcccattcttgcaaatacgaattgtgtttcaagcaactgttcgggtttctcgaagaaaagtcacaatcatgcgtcgaaagctcattaacgggcttaatcccttgatggttatctgactgcatgattgttaccaatctaacttaaccataataaaccagattaaagatacaagatggtcaccctcaccctgtaggagtatgctgacagagtgattctttttaaagaggccattatcatgaacactgttgcaattatcggtatcgatctcggcaaacattcatttcacgttcattgtcaggataaacacggcaaagccattctccgtaagaaattcacgcgaaacaaattatttgaattcttaggttcaacaccatcgacgtgtattgtgatggaagcgtgtgcaggagctcattttatggcaagaaaaatgagtgctctcggccatgaagcgaagctgatttcccctcaatttgtccgcccttttgttaaaagtaataaaaatgattttattgatgcagaggccatctgtgaagccgcatccagaccttctatgcgatttgttcagcccagaccagaagctcaacaggcgatgagagcgttacatcgagtcagggagtcactgattaaagataaagtaaaaaccaccaatcaaatgcatgcttttctacttgaatttggggtcagtatgcctaaagggattgccattataagaaggctttcgggtgtattagcagagaatgaactccccccatacttagttcagttattgatgcgtttacatgcccactatctttacttggttgagcaaattactgagcttgaaaatgaacttactcaagagctttttcgtgatgatactagtcaaaggctaatgactattccggggataggaccgataactgccagtgttttatcgtctcaattaggtgatggcaagcaatatgctaaaagtcgggattttgcctcatcaacagggttggttcctcggcaatacagtacaggaggaaagaataccctgatggggatcagtaaacgaggagataaaaatttacggcgtttattggtgcaatgtgcccgagtctacatacagcggctaacacatcaaacggggcgactggctgaatgggtaaaaaatcagcttcaaaaaaaacactcttgtgtggttgcttgtgcactcgcgaataagttcgctcggattgcttgggcaataacgacccaacgaactgagtttaatccatcctgataacgtcgaactaagtgactacgtaatcatagataaaagaagttacttatctggttttgcgaagactggtaattgatgacatgaacggcctgacggcctggtgataaacctaacaaaaaaaatggctcatagaagccgggcggtttttaaaggagtatcaggcgcggaactcattgaggcgcgggcatccttgcccatattgacgccggatagatttaagcaagcccatcataaatcaaaatcagtgttgcaaaaaagagggtgaccatagatattttctgtcttttttatttgtaatttatattttttaatatatttattatgtttattattgttgtcagtttggattattaaaaatatattgaaaaattatattgtttgtaacaaaaatactgtatccactcatataaagggaaacgaccatgtttaacttaaaggacaaaattgcgtttatttccggaggaacgaaaggtattggcaagggtattgctcaggtatttaagcgagcgggtgccattaccattatttccggtactaacagggcaagaggcgaggcgattgcaaaagagctggatattgattttattcctcttgatgtgacggatcaggcggcatgcaaaaatgtgattgatgagattgtcgaaaaatatggcaggcttgatattctgtgctccaatgctggtatttttccgcaacattatcttaaagacatgactgctgaagattgggatttagtgaatactgtcaacctcaaaggaacatttttattggttcaggctgcattgaatgttatggagaagcaacattatggccgggtcgtgcttacatcatcggtgacaggggagatgacaggtattccgggttacagccattatggtgccagtaaggcgggtcagttgggatttatgcgcagtgcggcgctggaatatgcaggtcagggtatcaccattaatgccattatgccgggtatgattatgacagaaggcttaaaggcatttggtgaagattatctacagcatgttcaatctacaacgccgatgcgcgttttagggttgccggaagatatcggctatacggcctgttttcttgcctccgacgaagcaaaatatattaccggacaggcgattgtggttgatggcgggcagatactgccagaagtgcagggtgcttaagaccttgatgtgataaaaaccgttttttcttttccaccattgccgtaaggcagaagaaaaagataagataatcacccaataaacacagggagaggaattatgttctctccctgattttttgttgtctgaatcaggtaaagaatattatgtcactgaactatgaacgtaacccgcttccgctaccaaacggacacaataaagtgttattgcactcgtgctgtgctccctgttccggggaggtgatggaggctatgctggcttcaggaattgatttcacgatatttttctataatccgaatattcatcccctaaaagaatatgaattgcgcaaagatgaaaatattcgttttgcggagcagatggggatcccctttattgatgctgattatgatcgtgataactggtttgaacgtgcgaaaggcatggaaaatgaacctgaacgcggtattcgttgtaccatgtgttttgatatgcgtttcgagcggacagctctttatgcttatgaacatggttttcctgttattagtagctcgctgggtatttcacgctggaaaaacatgcaacaaattaatgaatgtggcgtccgtgcagcttcccattaccccgacttaacctactgggaatataattggcgtaagggcggcggttcttcccgcatgatagaaatcagcaaacgtgaggagttttatcagcaggaatattgtggctgtgtttattccctgcgggataccaaccgacatcgtttatcgaccggacgggaaagaataaaattgggtacagtattctatcaagcggaaagtgataaaaaagatcacgaatcaaattgacgttcaaggttatactctctattcattgttagtacacacacctgccagttattgctatgtgactgacaggtgttttttatgttattattttattttattttattttattttattttattttattttattttattttattttattttattttattttattttatttttaaataataactcagtgatgaattcaaatgacacaggattgacattatattcattaataatacaattggtttatttttcatagaaaagaatgatatagtgcaataattcaattaaatagcaggtttatcatttatatatatttaatcaatgtagatgttttaaagatgaagggaacgtgataaaaagagagataaagtactcaatatcctgctaaggatacggaattatatattaaggtaacacttatgaagaaattttgtcgttggattaaaatactgcctattatctctgtttttttgcttattgcgtgtgatgaagagaattacagttttaagttacgtaaagataattatgcagaggctcatactaaatttaaaaccaatattgttgatgaaagttttatcggagatggaaaacccgctactccaccaaaggatatcttttcattggtgtattatcctgctgatgatggtgatatggctgcgtttctcagtgctccaccgttaaataatgacaaaaaatatcccgcagtgatttggttgatagggggatacggtggtattggcaatagtgattttttctggtctgaacagcccgaggataatgatcaatcagcctctgcattccggcgtgatgggttggtattgatgatacccagttttcgtggtgaaaatgttaatcctgggcgctatgagatgttttacggtgaattacgtgatatagaatcagccagacaatatcttgcgaagttgccgtatgtcgatcaaaatcgtatttatttggcgggacacagtacgggtggaactcgggcattattggccagcgagtatagcaaaggattcagggctgttttctcattggggggaattcctgatttgcgtttacgtctagaatatgggtcagttccggtggctgtaccatttgaccaaaataatccagaggaatttgaacttcgttctccacgtacttttctgagttctatcaaatcccccactttctattttgaaggagagaaaagttattgggatgaatttgatgaaataaaacaaattgtagaggataaaggtataccattgcatatctacgctattcaaggcggggatcattttaatattattttacctttaaccaagatgattgcagaaaaaatcttgagtgatacaggcgagaaaacgaacattcaatttgatgaacaggatattctgaagattcaatatcaccttccgctgactgattaatgtattatattgactatacctatagtaaataaatttatatatgtaatatcacggtttgaaaatataaaagtcaaaaaaaaaggcctgcatagacaggccaaaggatacggtgaagcataaaaccctagtgtaacttagcggtgatgggtcacatcgactatatgtgagataaaatactgccgtccaatggattgcacagatcgatcaaaggaaattgatcgataaaaacgatcatatttgatcgaacaaatagaaaaacgcagatttttccagttggatgagggacttacggcttttcagtttgatctaaaatatctttacataaacctggaaagccttgattaataataattattgttactcaacaaacgataaatagttatgtgagtgactaatctttaccatatctggcgcgattgggggtacaaccaaaacgccgacgataactttgggtaaaataggactggctggaaaaaccagattccaatgagatatcggcgatgctcatttcactgttcagtatcaattgatgcgcataaagaatacgctgttcactgatccaggcgcgtggcgatgtaccatagacgctgttaaaaagttccttgaatgaagttaatcccataccgaactcgcgggcaaagtcattgagccgccattccttgagataatgtgcgtccataaatgtttgcaggcgttctacctgacggttactcaactgtcgcaataccgacatcagtaatgcgccctgtttgctaagagaaagcaataatagtaattcttcaaccctgagctgaatcagggcaggagggtaatcatgagccagcagattggccagcccacggatactttccgtcaatagggggaactgactgaagggaataagcctacgggccggaaaattatgtcgttcaattttactcagtaacgatccgaaacgttttaaaaaactgcgcagaaactccatttgtaagggtagccataatacctgacagttttctgtattggttttggctacgtagctccccggatgggtaaaaaggatttcattcgatgtgatatagtaagtattggtgcaatctttccatatcatttctccatcgagtaaaacatacagccctctttgtttatgttcgagggtattgaaatcaggtatggtcaatagatgagtacaaatactcttctggtttaagcctgtcgtccttttcatgtaatactcctaatcttccgtatcatgagtaatcattttttgtgatgagtgcatggtgtatttatttattttattaattaatagatgttggaaaagcctttcatttggctctcgaattatgctgatagcattgagtgcgaagtgaaacagtattgatagatatcgaaatagcatgtataacatcaattaaatcactttttgtattatatctctaaattaatatttgtgttaggtttcagtgttaaaatttgcgctataaatttatttttatgttttttaaaggtattaaagcaagtttatttatgacttgtttattttttatctcatggtctttaatgcttttataattcacttgctggagagctgttcattactgtcatttaggtggttttatacttttaatcctatttaaccatactaaatgacaatttttatcatcaaaaatatgtcagttaatatgtgtaattatttgattttaaaaattaattataaattatttgctctattgggcaggtaaatagactcccactatttgtataacaagtaaatagagtaagcgagtgatatagatagattatttttaaatttagccagccaattgcacggtggcattgaaaagaaagttaacaaaattgagcatgcggatttttaatatataagcgaacgtgatctgatttttatgtttcgattatttttataagttaacattaaaacactgtttcgtcatttttttaaaatcactcgtgtttttgtcctcctttatcgcttaaaaaacctctcatgacgaaagtcaataatttatatcagattgttatccttagcttttatggggggggatataattacagagtttgaatcgtgatatttaatttcggttgccatattgttaatcatatcagtcaactgatctgaaatgttttccacataccagacatgatattaaattattagtattttgtttatattgttgcaatattattaatttatctgtttttttattcaaaataataagttaaatctataaagatggattttttattctgggaatatgggataattaaacgaaaattcagaacgttaaacttaagtagtaacgttatccgtgtaatagcgctataaatgcctcggttatagctgagtagattgttttttatacttgtataatgccaggatgaattttcacagcctttcctcgttacctgctaaggcatatgcatagatatagatatagttgctgatgaaatataagaaaaaactacaagaacgagaaagatatggaaaggtatcgtttttcagataacgcttttttatacagtgtatggctcctttgggggggtgccttagggctatatttgtatggcgctcatctcggttgtgccataacagcaattatatcttttctagccttggtactttactttacaaatatgaaactgagaataaatgctatgtttggaaaaaaaactgaggcaccagttgccaatcctgttacgccaatcatttctacacagcctgaagataaaaaaaacctcagtgttgaaacgcgttccaatacgattattgcgaaaaattcggtatttaaaggcgatattgagatggaaggcgatattcaggtctggggaaaagtcgttggtaatattcgcgtaaaaggtggtgctattcgtgtcatgcatgccggaaaagttgaaggtgagcttaatgcgccagaaattattattgatggccatgttgacggtacgtgctgtgcggaaacgctggatatcctggagcacggcgaactacgtggtatcagccgttgtggaagtatgtcaatccggcgtggcggtttatttgtcggtcagtctgaacaggtcgaaaacaagaaaaagccggatattgagcgggttgtttccatcaaagagaatccggcagataaagcgaaagccaaaaatagtgcttaatattggataataaaaatccatgccatagccgccggaaaatgtgtatcattttccggcggtttttattttgacggctgaatgatttttatcctgagtctttaaggaggcgttatgattatcaaactggaaacagaaagattgctactccgtggctggaaagaagaagatcgtgagcctttctttcgcttaaatagcgatcctgaagtgatggaatttttctttaatacactgaatgaagagcaaaataatattcttgttgataatttgatccgtaagtttgaaacgcagggtggctggggattatgggcagttgagcgaaaacaggatggtgcattcatcggcatgattgggctaaatattcccagtgaagagtcaccctgttatccctgtgtcgaaattggctggcggcttgataaacctttttggggcaaaggttatacatgtgaagcggctcgcaggatttttgatttcgcgtttacagacgcggggttggacgaagttgtggcattcacttccgtacttaattaccgctcagaaagtgtgatgaaaaaactgggcatgatcagagatgaaaaaacatttctacatcctttggtgccggaaggtcaccgattgagagaacatgttctgtatcggatccggcgttcaagttgatggcatgatagagtaaacattatcaaggttatcccgacaggcaggataaccttgatggaaaccatgttgttacccagatagttattgtctggatatcaccagaaccacgcggccgatgaattgaatgtcgctgactgaacagtcaaaagtgacgtcatcatcgctgacacggattttactgacaggaattttggcgatccttttaatactgtgcataccttcgatatccaccagccataagccatcctgaatattgtctccctgagcatcaagcagataccatgtcacgccatcatcaacaaccaacgggttgttaagctctttggaaatcaattcgctgtccaggatcactggattagcctcgttcagtttacctcccgataactttatacgaggaattgatggcgcgatgatatcttccagccgttctgttttaccactctctccatccgaaaacatttctccctgacctgtgcttaaccacagcagtgaagcgccagtttcgagattacactggatgatccaatccgctggaaagctatcacgaagatagcggtttgccattgtgcttttggaaacgcccaaatggtcactcagggcttggcgtgatttaaatccatacgcgcggacaagacgctcaatagcgggtcttcccccactatcagcccccatttttatctcaatattggtatttttcattgacagt

SEQ ID NO: 14976 - DNA, 186791 bp, Xenorhabdus bovienii
  Genomic contig Name=Xb4151_4152.C435
agaaagacgcgcataaattttttcgcaaaatagtgttggctactgcgctaatgacaggggtaaattactctgcgcaggccgatgttgtcacatctatccgtccgctgggttttattgttgccgctattgctgatggtgtaacagacactcaggtattgctgcctgacggtgcgtctccacatgattatgcgttaagaccttccgatatccgtaagattaatcaggccgatttggttatttggatcggtccggatatggaaacatttctggcgaagccgataaccaaaattgcgcagaacaaacagttggcgcttgctcaattatccaccattaaaccattgctattgaaaaacaatgaagatgaaaatgatttagaagaatcgagtcagcctaaacatgacgctgatcacgaacatcaccatcacggtgaatataatatgcatatctggctttctccggagattgcgaagcaggtggctcaggcaatttatattcaacttgttgagcagtatccgcaacaaaagcagcaattagaagtaaacctacgtaaattcaatggacagcttgtacaaactgacaaaaatattgctagtattctaaaacctgtgcgagggaagggatatttcgtttttcatgacgcttacggttattttgaaaaacattacaagttggccccattaggtgtgttcacggttaatcctgagatacagcccggcgcacagaaattacattatatacgaacacaattagttgagcagaaagccacatgtatttttgctgaacctcaattcaggccagccgttattcacacagtagcaaaaggtactgatgtacgtacgggaacactagacccattgggaagtggcatagtattaaataaagacagctatatgaaatttataactcagttgtctgaacaatacgcgagctgcctgaattagtacaataaggaactttattagtgcagcagatagttaaaactatcgttctggtatacaacaacttgccgagaccacacaagctaatgcttggttctctgacgttagtcaccttagctgtcgcagtgtggcggccagttgcttaccatgaacaagaagaaagaacaggcagtattattctgagtaccccaaataatatctcagatgcgaccgacgattcgataggcgatatcgatgagcagctccctgatgaaggaattggagatgaagagggtggttcggatacaactgtaaattatcctcaccaatatgttgtctccgatggggataccttaagttctattttgacccagtttgggattgattcatctgatgtggctttattggccaatcagtataagtcattgcgcgatttaaacattgggcagtcattatcatggacaatcgatgataatggtaatttaaaaacgttaacatggggtatatcacgacgtgaaacccgtatttatacccgtgaaggtgatgtctttaaagaaacaagtgcatttcagaaaggggagtggaaaaatacgattgtcaagggcaagataaatggcagtttttctggtagtgctctttccgctggattaaccagtggtgaagcaagagatatcacaaaagcgctgcaatggcagatagattttcgtaaattgcgtaagggcgatcgcttttctgtgctgatgtcccgtgaaatgctggatggaaaaagtgagcagagccagttaatgggcgttcgtttgcatagtggcggaaatgattattatgctttccgtgcagatgatggccgcttttatgatggcaatgcgtctggtctggaacgtggcttcctgcgttttccgactatgaaacaattcagattatcttcttcttttaatccgcaccgtttaaatcctgttactgggaggattactgcacataaaggtgtggattttgccatgcctgtggggacacctgttctggctgtaggggatggggaagttattgtctctaagtttgatggtgccgcaggtaattttattgccattcggcatggtcgccagtataccactcgatacatgcacttaagaaaattgctggtgaaaccaggccagaaagtgaagcgtggtgaacgtattgccctgtcaggtaatacagggcgctcaactggcccacatttacactttgaattctggaataaccagcagccagtaaatccacttacggctaaattgcctcgctctggcggattaaacggtaaagagcgctcggaatttatagctaaagtcaggggtatcaagcctcaattattgctggattgaatgcatcgctcactcgattattaacagacataaaagcggatgattgatatcatccgcttttatattatttttgttggaagcttgtgtattgaaagcttgttttggaaccatcagagttagctcatgaataaagagaaagatacagatagtaaactgggatatgtcccaacgtttcatctatcctatttgcatcctcgttattgggggctttggactggtgtgggaatattggctggattggcttatgttccggtaaaatggcgtgatccactgttagccaagatgggtatttgggcgggcaagaaagcgaaaagtgctcgtcggagggcgaaaatcaacctggtttattgctttcctgagctacaggaacagcaacgtgaagcgttgattgataaaatgtttgcaaccgcgcctcagtcttttgtcatgctggcggagctttgtctaaagggagctgaatcaacgcttcagcgcacccggtggcatggtgaagaaatacttcactcgttaaaagcacaaagtaagaatgtcattttactggttccccatggttgggctattgatattccagctatgttgttggctgcgcgtgatcaaaaagtggcgggcatgtttcatcatcagagcaatcccgttgctgactatttatggaataaagttcggactcattttggcggccgcctgcattcccgtgaggcggggatcaaaccgtttattgcgtctatccgtcaggggcacttgggctattatctgcccgatcaggatcatggcgaagaacacagtgaattcgtcgatttttttgctacttacaaggcgacattacccgcgattgggcgcttgatgaaagtcagtcgggcagccgttgtgccattatttcctgtttataattgccagactcatcagttggatatctatatccgtccaccgatggatgatattgaagggcaggatgacacttatattgcccgtcgcatgaatcaggagctggaggagttggtgcgtcctaatcctgaacagtatacgtggatactgaaactgcttaaaacacggaaagcaggggatatagagccttataaaaggaaagatctctgattttttaatatcaggggcagcatattctgcccctgatgctattcattggtagccaattactctacttcaagcactcgacaggtattggtactaccaatcgtttccatctgatcgccctgagtaaccagcaccacatcaccagaagtcagataacccttatcgcgcaggcgattgacggcttcgtttgcggcggagatcccatcagtgtgggtgctgcaataaaccggtgtaacaccacggtagagagcggtgcggttcagggtggattcatggcgtgacatggagaatataggcagaccggaactgatgcgtgacatcatgcgtgctgtgcgacctgattccgtcatggcaatgatcgccttgacacctttcagatgattggcagcatacatggctgacattgaaatggcctcttcaatgctgtcgaatgtaatatctaatcgatgtttggacacattaatgcttggcattttttctgcgcccagacaaacttgcgccattgctgcaacagtttccgcaggatattgacccgcggcagtttcggctgaaagcataacggcatcagtgccatcaagcactgcattggcaacatccatcacttctgcccgcgttggcatagggttagtgatcatggattccatcatttgagtggcggtaattacgacacgattcagttgacgggcacggcgaattagctttttctggacaccaactagctcaggatcaccaatctcaacgcccaaatcaccacgggcgaccatgaccacatcagatgctaaaatgatttcatcgataatatcgtcactgctgacagcttccgcacgttcaacttttgcgacaatttgggtttcacaacctgcatcacgggcaaggcgacgggcataattcagatcttcacctgagcgggggaaagaaaccgcaaggtaatcaaccccaatttttgctgctgtaatgatatcttgtttgtctttttctgtcagcgcttcagccgacaaaccgccaccttgtttattgatgcctttgttgttggaaagtggaccacctacagtaacttccgtgaaaactttcatgccctgaacatccaggactctcaattgaacgcgtccatcatccagtaacagagtatcaccggttgtaacatcagacggcaatcccttatagtcgataccaactttttctttatctccctctcccttaccaagattggcatccagtaggaatttatctccaatattcaggaaaattttgccttccttaaaagtggatacgcgtattttaggcccttggagatcgccgaggatagccacgtggtagcccaaacgggctgcgatttcccgcactttattagcacgttgaacatgatcttccgcagtgccatgagagaaattaaggcggacaacgttggcacccgcactgatgactttctctaaattgccgtcacgatccgttgcagggcctagcgtagtgacgattttcgttcttctgagccgtctggacatgtattactccgttgacctgtgaagtatagggtttttgattaccgtaagctaaccatttagattcttgattatcaaccccgtaataagaatgatactgacgggaggagactttccattatgctaccagcctagagggctgataaatagtgaacaaaaacacagtctatttttctgatttactcatacttatcaaaccgagaattgcgtaacgcttctttgactctcttcaagttatccctgaattttgagcctcggcgtaatgtaaaacccgttgccagtacatcaataatggtaagttgagcaattctggaaaccattggcatataaatatccgtgtcttcggggacatccagcagaatagacagggttgcttcgtgtgccagcggtgagcccgttgaagtgatggcgataacagttgcgtcattttcacgggctaatctggcgatttctaccagatttttggttcgtcctgtatgagaaattagaactacaacatccccttcggcactgttaatgcagctcattcgctgcatgacaatatcgtcaaaataggtgatagggatattaaagcggaaaaatttgttcatggcatcatgagcgactgcggctgatgcgcccaatccgaaaaaagagatttttcttgcctgagtcagcagatcaaccgcacggttaatggccgtaatatccagattacttttaaccgtttctagatttgccatcaccgattcgaaaattttgctggtataagacgtgacgctgtcactttcctccacattacgatttacgtaaggcgtaccattcgccaggctctgtgccagatgtagtttaaaatccgggaatcctttcgtgttcaggcgacgacaaaaacgattaactgtaggttcactgacattcgccatcttagctaaggtagcaatacttgaatggatggcagtatgtggtgaatcaaggatgacctgcgcaacctttttttctgacttactcaaaatatcaaggctattttggagacgttccagtgtattcataagacgcagttcaacctttggttttaacgatttcattaacaggagaaatctatgtaactttcatgaaaatatactacttgttattgaaggctggcagtggcaaaaactgaataaattgctatttttcatgaaaatatgacaagtgtctaattttcaacttggtaagattacttcttaaacgttggaaattttcagtaaattgttacagtgcggtataaatatcaaccaaaatacagttttaacgtaaaaatcgtacacagaacatgaggaaggtaggatttacccttagcagtctacatgaataaatgagtgtttactgcttataatcaaaagagtacattacccgcgagttctgtaaaaaaattacaatatcccgtaattgaggagatgcaacatggcggtgacatccgtagctcaggcttgtgatttggtgatttttggggcgaaaggagacttagcacgccggaaattaatgccttccctttaccagttggaaaaagcgggttatatccatccagacacccgaattatcggagttggtcgtgctgactgggataaaaaagcctacacaaaggtggttgaggaagcgttggcaacgtttatgtctgaaaaacttgatccagaattgtggaaaaaattcagttcacgtctggagttttgtaatttagatgtcaatgaaacggaacatttcacccgactggcgaaaatactcaagcaggacagcctgccagctattcattatttcgccatgccgccaaatacctttggctccgtgtgtcatgggttaggggctgcgggattgaataaagagcctaatcgcgtagtgatggaaaaaccactggggacagatcttgcatcttccagagcgattaatgatgaagtggcaaaatatttcaatgaaagccaaatctaccgcattgaccattatttaggtaaagaaaccgtactgaacctattagcgctgcgttttgccaattcactgtttgccaataattgggatcatcgtacgattgatcatgtgcaaattactgttgctgaagaagtgggtatcgaagggcgctgggggtattttgaccaggccggacagatgcgcgacatgatccagaaccatctgctgcaaatcctgaccatgattgccatgtctccaccatctgatttaaccgcagaccgcatccgtgacgagaaagttaaaatactgcgttcattgcgtcgcattgatcagaccaatgtgcgggaaaaaaccgttcgtgggcaatataccgcaggcttcgtgcatgggaagaaagtaccgggttatctggaagaagagggtgcgaataaaatcagtaaaactgaaacctttgtatcgattcgcgttgatattgatgattggcgttggtcaggtgttcctttctacctaagaacaggtaagcgcttaccggctaaatgctctgaagttgtcgtctattttaaagagccttcattgaatttatttgccaattcttatcagcaattgccacagaacaaactgacgatccgtttgcaacctgatgaaggtattgatattgaagtcctgaataaagcaccagggctggagcataagcatcgtttgcagactacaaaacttgacctgagtttctctcaaacattcaatcagacacatcttgcagatgcttatgagagattactgctggaagccatgcgtggtattcaggcgttgtttgtccgccgtgatgaagtagaagaagcatggaaatgggttgattccatcatggacgcttgggaagcagataacgaaccaccgaagccttatcaagcaggaacttgggggccagtggcttccattgctatgattacccgggatgggcgctcgtggaatgagtttgagtaacttaataacaaaaagtaattaattttgttgtacaatcagccgggtttaatgtccggctgaatgactgatttttatcaattccaacgtgttgttgtcatttgtaatgaaaagcaaacaggatatttctgataatcacaaaatgttacctgatgaagaaaaatagatattatgtgaagcagaaaaataagaaataaaaacaagacattgctttctattttaggctatgttagaaatatacccacaattaacaccactaatatggagattcgtagtatatcatacagtgatcatcgtgtgatgaaagaataaaacatcatgaatagcgccaaaagcgtcacaattcaatacagcagtaaaattcaacgcagtacacatgttctttttctctccgctatcttatctagcgaacactactggtgcggtgcactttagggtcttctcctgctaaccggtttttcaccggacgattctagtttttcgccaaaatgtcaggctgattctgatatcacgtttttaaataatcttattggtattaatggtttggtgtcttggcatgctacatacagtatgttcaggagaaaaaaatgatttattggatatttcttgcactggcgattatgacagaagtgattggtactctgtccatgaaacaagccagtgtttcaggtgattttaccggcatgattgtgatgtattccatgatcacaacttcttatattttgctggccattgccgtgaaaaaggtcgctttgggcgtggcttatgccctatgggaagggtttggtatcctgtttattacagcctttagcgtattgtggttcaatgaatcactgtcacctatgaaaatcggtggattggctctgttgatagcaggaattgcactgattaaatccggtacaaaaaaagcctctaatcctcaactgaaggaggcataacatgttaacaccatttgaatggtggcatgccgctttccttgttttggcggttctgctggaaattgtggcgaatattttactgaaactgtccaacggttttcagcgcttctggataggggttttatcgctgatggctgttttggcagcattcagcgcactggctcaggcagtaaaaggtattgaactttccatcgcttacgcgatttggggcgcattcgggattattgccacggttgcagcaggttggattatgtttaatcaaagactgaatttcaaaggttggggtggcattgtattgctattgattggcatggttatgattaaaatgtcttaagtgctatgccttcaatggtgatattttaaatttaattaatagaatggcattgagtaagttgaaaggttctcaatgccatagcaaacctggaaaatgaaggttataaagctgcgataatcttgatttccactttgtattttggattcatcagttcagcctgaacagtgcagcgtacaggtgagcttcctgcaacaacccatgcatcccacgccgcattcatgccagcaaagtcggctttatttgccagaaaaatcgtcgcatctatgatcttgcttttatctgaacccagacgctgtaacatgatatcaatcgcagctagtgtattggcagtttgttcagtaatatccccatccagattttctggcacgctagtataatagatagtgtcattgtgaatgatcgcttctgaccagcgggtatctggatcaatgcgttcaatagtcattaaatctcctgttaatttatacagttttactgcttaattggctggtgattactgctcagtattggcataattctgccacattttattgtaaagagacggttcgtgtcagacgattttgcgaaaaatggcgtacttgccaaggcgatacaaggtttcaacccccgtgatgcacagcgggaaatggcttcatccattaccgctgcaataaaaaaacagcggcaattagtggtggaagcgggaacgggaacgggtaagacttttgcctatctggtgccagcactacgttcaggcaaaaaagtaattatttccacaggttccaaggcgttacaggatcagctttataaccgtgacctgcccactgtcgctgatgcattgaagtttacgggtaggatggccttattgaaagggcgctcaaattatctatgccttgagcgtcttgaacagcaatcatttggcagttctcagcttgagccggaaatgctggcagaagtggtcaggctgagaagttggtcgtctcagacagaagatggcgatatcagtacttgccaccaaatcgcagaagacagcattgtctggccattggtaacaagtactaatgacaattgcctcggtagtgattgtccacgctatcaggaatgtttcgtactgaaagcccgccgcaaagcgatggaatcggatattgttgtcgttaaccatcatctgtttatggcggacatggtggtgaaagataccggatttggcgaattaatccctcgtgcagatgtagtcattttcgatgaggcacaccagcttcccgatattgccagccaatattttggccagcaattgagtagtcgccaactgatggatttatcacgagatatcattatggcctaccgtactgaagtacgggatcaggctcaattgcagaaaagtgcggatcgtctcagtcaaagtacgcaggatttccgtctgtccttgggagataacagttatcggggcaatctccgtgaagccttgcagcagccacagatacagcggatgctggtacggttggatgatgcactggaactctgttatgacgtaatgaagctctctctggggcgctcggccatgttggatgctgcttttgaacgggcaacgatctatcgtaatcgtcttaaaaggctgatcgacgttgttgtacccaattatagttattggttcgaaagttatggacggcattttttgctggcactaacacccctatccgtatccgataaattcagtgacatgatccgtgaacaatccggttgctggattttcacgtccgcaaccttatctgtcaatgaacagcttgaccacttcacggcacgcttggggttaaaacaagcacagacgttgctcctgcccagccccttcgattatcagcgccagatgttactgtgtgttccgcgccatttaccatcaccaaaccagaatggcggggcaaaatggctggcacgtatgctgaaaccattaattgaaagcaataaggggcgttgtttttttctttgtacttcccatcagatggtgcgcggtctggcggaggaattccgtgctaacctgacattgcccgtgttggtgcaaggagaaacaagtaaaggacagctgttgtcccagtttatttctgcgggtaatgcgctactggtggcgacgggtagtttttgggagggtgtggatgttcgtggtgatgcattgtcctgtgtcattattgataaactgccgttcaccgcgccggatgatccgctgctcaaggcacggattgaagattgccagcttaaaggcggggatgcctttagtgaagtccagattcctgatgcagtgctcagcctgaaacaaggtgtaggacgcctgattcgtgatattgatgattatggcgtggttattatttgtgataatcgtttagtaatgcgcccatatggtgaaatttttcttaacagcttaccgcctgcccgccgtacacgtgatttatcgaaagcggtggaattccttaaatcacgtccaatagagtcagagtaaaatctcaggggttatggtagtatagcccccttatttcgaattctattcttgccggagttaaggcatgtccacgcggattttagctattgatactgcaactgaagcttgttctgttgcactttggaacgaaagtgtcattgaggcacagtttgaaatttccccccgggaacatactcaacgcattttaccgatggttcaggcggtattgtctcagggcaatttgagcctgcaacagttggatgcgctggcgtttggtcgagggcctggcagttttactggcgtgcggattggtattggcgttgctcagggtctggcgttgggagctgaattgccgatgctgggtgtttcatcccttaaaacgatggcgcagggggtatttcgcctgaaaggcgtgcaaaatgttctggttgctatcgacgcccgtatgggagaagtttattgggggcaatatacccgtaatttacaaggtgagtggcagggtgatgaaaccgaggcagttttgaagcctgaacaggcattggccattatgaatgccttaactggggtttgggcaattgccggaacaggatgggaagcttatcctcaattattggattctcatttagatttggtaaaaagtgacattactttaccccatgcggaagatatgcttccactggctgttcagatgtggaaagcaggagaagcaacggcagttgaacatgccgaacccacttatctgcgcaatgaagtgacatggaagaaattaccaggtcgttaaagtaaataaacgtaattatgtaaaactgatgcaacttgtgatgggaaatgatgtccatggatatagaagatgctcaggttaatttttttgcgtgatttttactgcgatggaggagcttatgcttaaggggacgcactatcgagccatgctgcaagtggttgcattggcgggagcaatgatacttacaggttgtgtatcagttcctgatgcaataaaaggaacgaccaaaacacccgtagaaaatctgctttctgtcaaagatacacctgaactatatattgggcatgaagggcgttttggtggaaaggtattgagtgttttaaatgaaaaagacagaactcggctagaaattttggctttaccactggcaagtaatgcggctccgcttttgaataaaccgtctcttgggcgagtttatgcctatgtgaatggttttttggaaccgaatgattttaaagatcagtatgtgacagtggtgggttcgattacagatctggaaaaaggaatggtggggaatagtccgtataattatgtcgtgatgagtgtcgtcggttttaaacgctggtatgaatctgaacgtgttaatctaccacctgttggtaactctgttttctggaactattatggttccccttattttccagacctgagccagatggcgagcatgaaggacgctttgtcggaaaggcattgagtgacttaagcgagactcaggcagtgcctgttgaaacgattttgaccgaatgatcctgtctgactgataaagtttgcagatacaaaataaatggcctcataaagtaagtggcgaggccatcctcaaggtttcatatctttgtttactattatcttcctaataattatactttattggtttattctgcttataactatttagaataataaagttagtttaagtcaaaaataattaaatcagtgtataatcaaagcattatacatccaagtattgattaattaagtaaccaattgataaataataaaaaaataaggcagcagaagctgccttattttttggcagcgacatatagtattaaattagtgatgtatatcgccaacctgaacaatgtttcttttcaaactggtacgctgagttaataatttgttaaatatacaggtctggtttttgtttcatggtcagtggttatacagcaattagatttcaggagtattcaacttggaaaaagtttggttaaaacattatccggcagatgttccggcagaaatcgatcccgaccgttatttgtcgttgattgaaatgtttgaaaatgctgtggcacgctatgccgatcaagtcgcattcatcaacatgggtgaggtgataactttccgtaaattggaagagcgtagccgcgcctttgccgcttatttacagaatggactggggctgaaaaaaggggatcgcgtggcattaatgatgccaaacttattacaatatcccgttgctctctttggcgtcctgcgtgcagggatggtggttgtcaatgtcaaccctttatataccccgcgcgagctggagcaccagcttactgatagcggaacatcagccatagttattgtttctaactttgcgcataccttagaaaagattgttttcaacactcaggttaagcacgttattctgacgcgcatgggggatcaattgtcccgtccgaaagggactcttgtagatttcgtcgtaaaatacgttaaacggcttgtaccgaaatatcacttaccggatgccatttcgtttcgcaacgtgatccacaagggttaccgtatgcagtatgttaaaccggatgtggacggtgatgctctggcatttttgcaatataccggcggaacaacgggggtggcgaaaggagcgatgctgacccaccggaatatgttggcgaaccttgagcagggaaaagctaattacgctccgctgatggctcctggacaagaattagtcgtcactgcgttgccgctttaccatatttttgctttgacggtcaattgcctattgttcattgaacttggtgggcaaaatctgttgattactaatcctcgggatatcaatggaacggtcaaagaattgtcgcgttacccattcactgccttgtcgggagtgaatacgttatttaatgcatggttgaataaccctgaatttcagaaactggacttctcctcattacgtttgtcggttggcggtggcatggccgtccaaagaatagtggccgaaaaatggcaaaatttaacggggtgtcatttacttgaaggttatgggttgacagagtgtgcacctctggtttcgggtaatccttataacctgactcattatagtggcagcattggtttcccggtaccttcgacagaaattaagctggttagcgatgatggtaatgaagttcctttggagcaagcaggggaaatgtgggttcgtggcccgcaggtgatgaaaggctattggaatcgccctgaagcaacggcggaagtattgaaagatggctggctggcgacaggggatattgccaatgtagatgaaaacgggtttttacatattgttgatcggaaaaaagacatgattttggtttccggtttcaacgtttatcccaatgaagtagaagatgttgtttcttcccatcctaaagtgttagagtcggcagcaataggtgttccaaacgataactcaggtgaaaccgtcaaaatatttgtggttcgtaaggatcagagcttaactgagaacgagcttaagacacattgccgtcgttatctgaccggatataaagtaccgaaactcattgagttccgagatgaattaccgaaatcaaatgtaggtaaaattcttcgcaaggaactgcgtaacgaagaattagaaaaagcgaataatgctgcgacagcggcaaattaatcgtgttatagatggtcgtcttaaagggagatggtttagccgtttatagccttaagaacgatttttaaaagggtaaaatagtttaagattgcctatcacatcaacaacgccggtttttaccggcgttgttgtacaagtcttatgaatggctaagagaatgatgttttgaattatcagtcaataaatagccaataggggaaattagcgagtagtttggggagaattgtgggcagatattggggatggtaacacctataagaataggtgttacgtcttcgttaatattggattcatttattaacgaatccattataattcatttttttgttcaagttttacaatttcccaacgtttcgaggcttcattctgacggtaagcaaagagaactccattattcatgtagggaataaaggtttcaaaaccatcttgagagtaattatcggagaatactagttttgttttaccatccggagttaattccaagaactgaatagctgcactgctagtattgatacaacagagatattttttatcaccatcctctagaatagttgcataatcataataaattggtgagctaccgctttcagtcgtgtgacccaatctaccgtctggtaatatttcttgaatgaaatgcttattaccttgggtttcggattgtccaaacataaatttcttgttatctatttcgtatattgccatcgcatttctatgatagaaattatatgcatttttatattgaattgtcgtaattgatatgctcatgttacacctcgattatttttatatgtaagtagtgttaattttaatgcttattatcctttcgctttattaactaaaatatacataggatgacataattattgtaaatttgtagaatatggaatatctgcgaatatattgatgcgacttacatagtagaagataaaaataaatactcaattccattttatataatgcatgaaaagaaaatcgtaattcctgattatgatgccagcttattgatggcgatgaatatattaaataataccctatgactctgtcatgtatttctatggattttgaaaaagacaacgtattgcgagtcagtcttgctaaatattgacgaagattcagattatgcctctatgcacctgaatggcacaatcacaaatagctactatatttaatggcaattgccaagtcgcgctgagttgactttgccagtttgagtagagtaaggaaaacgtcatgaaagtattgatagcaaagaacgaagtaggtacacgatatcacagtcattatattgagaatgccgtacacaggttggcggataaattaaccgatcgaaatgttgaggtggttattgccgattcatttgatgatagttacacgataattgcatccaatgagtcgttcgattgcttaatggtcagttgcgcattgatggatgatgaattatatcgggaaatacagcaattattaaataaattgtttgaacgccaggaaaatgtaccagtatttttattaagtgatcgggaaaaaactgtatttctgctaaatcatgaattgctggaacagttgaccgaatttgcatggatacttgaagactctgccgatttcattgcaggcagagcaattgcggcaatgcggcgttaccgtcaacagttattaccgcctttaatggccgcactcatgaaatatagccaaacctatgaatattcttgggcagcgccagggcatcagggcggagtcgggtttaataaaacccctgtcggtcgcctttatcatgattattatggtgaaaatctctttcgtaccgatatgggaattgagcgcgcttcgttgggatcgctgttagatcactccggcgcatttggtgaaagtgaaaaaaatgcggccagagtctttggcgcggatcactcttattctgttgtggtaggaacatcaggctctaaccgcacgattatgcaagcctgtatgaccgaagacgatgtcgtcatcattgaccgtaactgccataaatccatcgagcaagggcttatcctgacaggcgcaaagcctgtctatctgctaccgagccgtaatcgttatggcatcattggtcccatttatccgcaggaaatgcagacagaaacactacagaaaaaactgaaacagaacccattgactcaaggtatggccagccgtaaacccgcctatagtgttgtgacaaactgcacttatgatggggtctgttataacgccaggcatgtgcaggaattgctggataaaagtgtcgataggatacattttgatgaagcatggtacggctacgcgcgctttaaccccatttaccatgatcattacgcgatgcgcggtaatccgaaggatcatgcggggccgactgtttttgccacccactcatcccataagttgctgaatgccctatcacaagcctctttcattcatgtgcgcgatggtcgaaattccgttgatttctcaagatttaaccaagcttatatgatgcatgcgacgacttcaccgctctatgcgatttgcgcctcaaacgatatcgcggtttccatgatggatggcaatagcggttattctttgacgcaagaagtgattgaggaagcagtggactttcgtcaggcattggcgcgcttgcatcgcgatttcaacgaaaagggcgattggttttttaaaccgtggaatcaggaaaaagtcctcgatcccgcgacaggcaaaaaaattgcgtttgaagatgcaccaagagatttactgaccaaagaacaaagttgctggactatgcgtccgggagacagttggcacggttttgaagacttgcccgatgactggagtatgcttgatccaatcaaagtcagtatcttggcgcccggcatgggagataatggtcaattgctgaagcagggcgtgccagcggcgctggtgacagcgtggttaagtcagcatggtatcgtacccacccgaactaccgattttcaaattatgttcttgttttcaatggggattaccaaaggaaaatggggaacactgctcaataccttactttctttcaaacatcattacgacgctaatacgccgctcaacaaagttttgcctgatctggtgaatcaatatcaggaagtatatggcaacttaggtttgcaagagttgggcgataaaatgttcgcttatttgcgtcagaataatccgggcgataagttaaatcacgcttattctggtctgccggaaatggcgatgatcccaagggcagcttatcaggccattgtgaccaacaacgtcgaaatggtagcgatcgacgatcttcctcaccgtatcgccgccaactccatcattccatatcctcccggcattccgatgctactttcaggggaaaacttcggagataaaaccagcccgcaaatgagttacttacatgccctgcaaaaatgggatcacgaatttcccggatttgagcatgaaacggaaggaacagagattatcaacggtgtttatcacgttatgtgcataaaaaaatgagaacgggaaactaaattatgactacggtttctgagacgaaaaaagtcggattgatccccgttacgctgatggtcgcgggcaatatcatgggatcaggcgtgtttctcttgccagccagcctggcttccaccggaggtattgccattctcggatggctggtcacgatcatcggtgccgtggggctgtctatggtgtatgccaagatttcttcactggatgatagccctgggggctcttatgcctatgcccgacgtgcttttgggccatttttaggctaccagaccaacgttctgtactggctggcctgttggattggtaatatcgcaatggtggtgattggcgtcggttatctcagttactttttcgccatcctgaaagacccgataattctgaccatgacttgcatcgcgatactgtgggtatttgtcttcttgaatattatcgggccgcatgtcattaccagagtacaggctgttgctaccacattggcacttattccgatagtggcgacggctgtattcggctggttctggttcagcggtaaaacgtatatggatgcgtggaacgtgagcgggctaaatacctttggtgctatccaaagtattttaaacgtgacgttatggtcgtttattggggttgaaagtgcctcggttgccgcaggtgtggtcaaaaaccccaaacgcaacgtgcctatcgcgaccatcgggggcgtacttattgctgccgtatgctacatcttgtccagcagtgtgattatgggcatgattccgaatgccgcgctgaaactctcatcttcgccttttggtgatgcagcgagattggcactgggtgatacagcaggcgcggtggttgtattttgtgcggcggtaggatgtttaggatcgctgggcggttggacgttgctcgctggacagaccgctaaggctgccgccgatgatggcctgtttcctgctatttttggcaaagtgaacaaggagggaaccccggttgctggcctgctgatcctcggtgtattgatgactatcttccaattcagcagcatttccccgaatgcggcgaaagagtttgggttggtctcttccgtttcagtcatttttaccctgataccctatctgtatacctgcgcagccctgctgttactggggcatgggcatttcagacaggaaaagctgcgctacatagtgatcacctttattgcctttgcctactgtatttgggctgtgatggggacaggcgccgaacaagttgtatggacgctggttgtgatgatgatagtcacggctatgtatacttttaactacaacacaaaacatcctgctcctttcccattggagaaaaatgattgacatcagtttgcggtattacagggggctgaaatatcagccccttttttaggtctattgttggttggtttatcgatttttcgacgcaattatgcatggagttagtaacttttccgcctaatttcacatcaagatcgatttgtgataaaactcacattgcgattattaatggacgcatgaaagcgggattatttcaggaaaacattgagtttctggggaaagaacggcatttggttgcaaaagtcagccgccgtgatctgccgtttgtcgtggcagaggaaaaacacggggcgacaaccgtggcttcaacgatgattattgctgaaatggcgggcattgccgactgaacatctggaagcacatggagtgccacttgtgggatatcaaaccgaaaaattaccggcatttttctgccgtaccagcccatttccggtgagtgtgacgcttgaaaatccccggcagatagcccaagccatgaaagcaaaatggaattcagggctgagaggagggctggtgatcgccaatcccatccctgagccattcgctatgtcggaagttcaaatcaatgccgccattgaacaggctgtccgagagtcgcaggaacagggaattcatggcaaggagagtaccccattcctgctgaccagagtatcggaattgacgggaggcgaaggtttacaggcaaatatcgaactggttttcaataatgcgaaactggcagcgcaaattaccattgcttatcaagcaataaataagcatcagtaaatatcatccgatatatcttatccaatgttacaataaaataaatgccagcctgaaagagaaacatggtaatatcccttgggatttttttaggctggctaaaaaacaatgggaatataatgatggatattttacgcagtttaatgggaatagtaatacttcttctggttggatatttgttctctgtcaataaaaaaataattagcttacgtacggtggtcgctgcattattacttcaagtaagccttggtgcaataatgctgtatgttcccgccggtaaatggttaattcataacattgccaatggcgttaatgccgttatttattatagttctgctggcagttcatttatcttcgggagtttagtcgggccgaaaatgaatgaattatttgatggggcaggttttgttttcgcatttcaggtgctgcccgctattatctttattacttctttgatatctattctttattatattgggatcatgaaatgggtcattaatattttgggatatgcttttcagaaagcgatgcgaattagtaaagtggaagcctttgctgcggtaactacaatctttttgggtcaaaatgaattaccggcggtgttaaaaccttttgtcaataaaatgaaccgcaacgaacttttcactgtgatatgcagtggtatggcttctattgccggatcgatgctggttggctacgcggggttgggcgtaccgatagaatacctgctggcggcatctttgatggctattccgggagggattctgtttgctcgtttgctcagtcctgccacggagccttcacaagtacagtttgaacagatttcattcagtgagacgcgtccggccagcattatcgaagcggctgccggaggtgccatgctggggttgaaaattgctgttggcgtcgcgacggtggtgatggcatttgttgccttgatcgcgttgctcaatggcgtaatcggcggcattggcgagttatttggcctgacggggctgagtatgcagagcctgctgggttatcttttttcgcctttggcttatatcatgggggttaactgggagcatactgatctggcagggagtttgattggacaaaaattagcaatcaacgaatttgtggcttatgtgaatttttctccttatttaaaagatcctgcggttcttctggataccaaaactatcgcggttatttcgttcgcgctttgtggctttgccaattttggttcgatagcggttgttgtcggtgcatttacagcggtagtacccgaaagggcttcagatattgcaaggctgggtctgagggcactactggcagcaacactgtccaatctgatgagtgcaacaattgctggcttgttcattaatttggcaggttaaatgcctatctattaaccgttatcggcgctaacatgttgaggtgttagataactcacagtaagttatgctgaacccctctacaatcggggaatcaactaggcttggtatttgaataataggagcgtgcatatgtacagaactattttggtaccggtagatatttcagaagaagaactaacgagtaaggctgttcgctgtgcgcttgatatcgccagagaaacaggtgctaagttacatattctacatgtactccctatttcatccgcaattattaatgcttatgcattaggctatatggaaattaaagacaaagcgaccgtcaaggccgaaaaggaattgtctatgctggtagattccattgatttaccgaacgatcgcatttcctattcaatttcttttggctcaccacgagacgaaattacctccacggctgatgagattgaagccgatttgatcgtcattggttcaaggcggccgaatattacgacccatttgttaggttctaactcggcggggatcgtcagatatgcgaaaacctctgtattagttgtgagataacataggttattggcaataatggattaatgattgttactgttttttatggcggcttgattacttagaaaagcgtaatggccagtagttacattcgattgcaggggagtatgtatgtataaagcgattttagttccaatcgatattccagaagatcaactcactgataatgcgattaagcatgcagaattcttggcgaaaatctccggtgcaaaaattcacttgtttcacgccgttccggatatctcaaggttttctgtaaattacagctatcactatgatttgcttagtgcttttgctaaaaaagccgttacaaattctgaagaggaactcaaaaaagtcgtagaaaaaatcaatttaccgaaagatagagtatcgttctccgttgcttttggttctccacgagaaaaagtactctccactgcccgtgaaattggcgcagatttgatcatcgtaggttcaaggcggcctgatatttcaacccatttactgggctcaaatgcgtcaggaattgtttcctacgctaatatatcggtattggttgttcgataactatctggtaacatgcctaaaaccgtgcagggaattgcacggttatttatgtctgatcagtaaatgaattaagggtaatatctaattgatttttaccagcagtgataacttgaatctgtaagttattttttgagctgttagtcgtcattatcgtcactttttcattccctgaatatttccttacaacctccagcaactcttgctcaggttgtttaattttattgctaatagtcatttatttggttaaatttaattattattaagttggtttaatactactcaaataattagaattcaatagtttaataaacctgattattttatgaattaagtaatattaatattaactaagtcaaatagtgaatcagtttaacaataaatatcaatatacactcgacgaataaaatttgtcattttattgctttgtcaggcaggatagggcagatgttatacacaataattaaataggtatcattttgaatagtaaaattagcctgtgggcaagttattttttgtttttcggattaaccatatcttttaatgcatggagtgcgccgaccagctttgagcaagcgaaaatagaatcaagaaaaaatgtctatagtgaacaaaccaaatcagaaattggcacattgtattgtggctgtgattggcaatgggtaggtaagagtggcggacgtgttgatctggcttcttgtggctatcaggtcaggtcacagcagtcacgtgcggaacgtattgaatgggaacatatggtgcctgcatgggtattcgggcatcagcggcagtgctggcagaatggcgggagaaaaaactgtgttgagaatgatccgttttttcgcgtaatagaatcggatatgcacaatctggcgccttcgattggcgaagtcaatggtgatcgcagtaacttcgcttacggaatggttcccaaaaacatggcaaatatgtatggggcatgtagcagtaaagttgattttaaatcacgactgtttgaaccgcgcgatagagttaaaggcgtagttgccagagtttatttctatatgcacgaccgttataaccttgcgatgtctcgtcaacagcagcaacttatgatggcatgggatcgtcaatatccagtagatgggtgggaacgagaaagagataataaaattgcccggattatggggcaccataacccatttgttaccggaagccagaaatgggaactggggcataaaaattcaggccaggggttgagcgtacaaaatggtgtccaaaagcaaaatagctttcaagcggttggcaaccaggcacccgtcagaaacccgaccgtaaaaaccgcgcagagtgaaaaaattaaaggcaataagaatagccagatttatcactttgcccactgttctggttataaaactatagcggataaaaacgcggtctattttcgaacggaagccgaagccaaaaaagcgggatatcgtctggcgggtcattgtaaaaaataaccagaaaatgcagaattattaatttttcacgatgactgggtaatcttttatcaaaaaaaagttaaaaaatatttcagtaaaatttatttttttaccttgtcataactcaacaaccaccgactttagtcggtggttgttgagttaactttttgttttattttgataaaaataaagttattccactgtcatggttaataagttcactaataaagtagttttaggttaaatgatgacttgttgacgaattcgtattcggagggctttttaatgataaagctggaaatttgctgttatagcataagctgtgcgctggttgcacaaaatgcgggcgctgaccgaatcgaattaagcgcaagcccgttggaaggtgggttgacacctagttttggggcattacaacagtcgttacagcggttatctattcctgtgcatcccattgtgcggccaagaggaggagacttctgttataacaacatggattttgaagtcatgaaaaatgatgttgcccgtatccgtgatatggggttccccggcattgttttcggcattttgagcgaaaacggccatattgacagactccgtatgcggcagttgatgtcactgtcgggaaatatggctgtgacttttcatcgcgcttttgatatgtgttttaatccgcatgttgcgttggaacaactgacagagcttggagtgcagcgtattttaacatcaggccaacagcagaatgctgaactggggctgactctgttaaaagagctgatgcaagccagctgtgggccgataattatgcccggcgcgggtgtcagggtgagtaatatcagtaagtttctggaagccggaatgacggaagttcatagctcggcgggtaaaatagtgccttctaccatgaagtaccgaaaggcaggggtggcgatgagttcggacgatcgtgatgtagatgaatattctcattacagtgttgatggtgagttagttgagtcgatgaagggagtgatgaacctgattgagcggtaaatgtgatatcgcttgcgtcataaggaaagtgaaatcttagaaattaaggtgtgaactgccatattggacagttcactcattaatatttgttcaatattatggcttgcgggcaatgagaacagcacgcaatggggcagggtagccttcaattgttttattgtgatctgatgggtcaaggaaatctaccagtgattcggtcttcatccattctgtccggcgttgttcatcaggtgttgtagccgcatgatcgacaattctgacatcgacaaaaccacatttttccagccagactttcagcatcttggccgagggaataaagtagacattccgcatttgtgcatagcgttcacccggaatgaggcactgattttcatcaccctcaatcactaaactttccagcactaactcaccatcagacaccagttgatttttcagttgccacagatgatcaagaggtgaacggcggtggtagagcactcccattgaaaataccgtatcaaaggcttgtagttcgggtaattgttcgatgcctaatggcagaagatgggctcgttgatcgttccccagcaactttctgaccgcttcaaattgacagagaaaaagttgagttggatcaatacccacaaccaattgagcgccttcgccaaccatgcgccacatgtgataaccactgccacagccgacatcaagtacggtttttccttctaaaggagaaatatggggcagcactcgctcccatttccaatcagagcgccattcggtatcaatttcaacgtcatacaatgaaaaaggaccttttcgccatggcatcaatattttcaggatattgtggaggcgagctttttcaccttttgacagatccggctcatgagtcgcaatgacaccatttttcaggtcaaggtggcttggcttgatctcaggcaaattttccagaatttttacccatgagctgaactgaccgtgctgtgatgttttttgccagtggctcaattgtgctggcagactatccagccaatggcttagtgggtgcttggcgatcaattgataaaaattaccgaaatcgatcattgttcagttccttttattgccagtaatgaaccgaaattgaaacactggaaccagacttctacatgctggaaaccgacttctttaaggcgtgacttatgggtgtcaacagaatctgtccgcatgacattttccagcatactgcgcttttggctgacctccagctcactataaccattggctcgcttgaaatcatggtgcatattgaatagtaactcgccaattttctggtcttcaaaattgaatttttcagacagaaccagaaccccgccgggttttaatcctgcgtaaatttttctcaatattttctggcgatcatcagggggcaggaattgtaatgtgaaattcaaaactaccatcgaagcattttgaatgtctgtatcaagaatattctgttcgatcacctcaacgggtgtactggctttgaaagaatcaatatggcggcgacagcgttcaatcatagctggtgaattatcgatagcgataatccggcaatcatcagtattgatactgcggcggatggacaaagttgctgccccaagggagcaaccgagatcataaatttggctacctggcgtcacgaaacgaccggccagcataccgatcatggagatgatattggaataaccgggtatggaacgtttcaccatatcaggaaagacttcggcaacacgttcgtcgaagctccagtcacctaaattggcgattggggcagagaacaaactgtcccgttgattatgaggatcttgatttgacataacaacattagttttggaaacaattaagaagtgggcattctaacagaatgcgggaaggggcagaaagggataatcagcagaaacctcaggcggctggaataccgcccttggtaatgatgggctttcttatgcatgggtgtcatgatgtacattaaggtttgcatttatgcatgtaatttatacatatcgagtgtaaattacgcatagaaagaaaatatttgttcccaaggtaagtagtaaatgttggtgataatcattattatcattgatatatacgttgcacccattcccatacggcgccagcggatttcgcgatgacgtaggccaaagtagtgcagtatcctacccgaaagcaacaataggccacaaatatgtagcatccatacggcggctccattcatctccatcatcaacagcaatagcattgaaataggaatatattcaacagcattgccatgcacgcgaatggctgtctgcaattcgtaaaaaccgccatcgccataggcgactcgatattgtgttcttaacttgacgacatccagagacagcttaatcaataatagtgcgcccaaaacgatataaagcgagctaaccatttttaactccattgcctaacccaaaacggccgaatgatgataaacctcaaaaagaaaactgtcgctataaatcatagtatttaataataaatagtatgaatattatcagttagcaaaaaattgtcttgccaggaactgtgttatgcccttatctctggtcagaattttcagtataatgcctgccttttttgacaattcttcctaaagaacaatgccaaaatttccgcagcagaatgcataacgagctgagtaaaaggatattgtatgcgtactaattattgtgggcagttgagcctggcccatgaaggccaaaaagtaactctttgtggttgggtaaaccgtcgtcgtgatttgggcggcctgatcttcattgatatgcgtgatcgcgaaggtatcgttcaggtattttttgacccagaccaaaaagaagcatttgctcaggcttctgaactgcgtaatgaattttgtattcaaattacggggatagtccgagcccgtcctgacagccagatcaataaagaaatggccactggagaagttgaagttttcgcagatagcctgatggttttcaatcgttcagagccattgccactggatagcaatcagaacaacagtgaagaacagcgcttgaaataccgctatcttgacttgcgtcgcccagagatgtcactgcgcttgaagactcgcgcaaaagtcaccaattttgttcgtcgttttatggataatgcgggcttccttgatgtggaaaccccgatgttgaccaaggccacgccagaaggtgcgcgtgactatctggttccaagccgtgtccataaaggcaagttttatgcgttgcctcaatcaccacaacttttcaaacaattgctgatgatgtccggttttgaccgttattatcaaattgtgaaatgtttccgtgatgaagatttgcgggcagatcgccagccagaattcactcaaatcgatgttgaaacctcgtttatgactgcggaacaagttcgagaaatcatggaaaacatgatccgtgaattgtggcttgacgcacgcaatgtcgatttgggtaaattccccataatgacatttgcagaagcgatgcgccgctttggttcagataaaccagatctgcgtaacccgctggaactggtggatgttgctgatttagtaaaaaacgtggaatttgctgtttttgctgaacctgctaacgatccaaaaggccgtgtagctaccatttgtgtaccgggcggtgctgaactgagccgtaagcaaattgatgaatatggcaaattcgtcggtatttatggcgcgaaagggctggcatggatgaaagttaacaatcgtgctgccggtctggaaggagtgcaaagtccagttgctaaattcctgtcagcagaagtggtggaaggtttgttgtcccgtaccaatgcacaggatggcgatatcctgttcttcggtgctgacaagaaaaatgttgttaccgatgcaatgggagcgctgcgcctgaagctgggacgtgatctgaacatcactgatctggcgagctggaaaccgctttgggtgattgacttcccaatgtttgaagacaatggtgagggtggtctgcatgcaatgcatcatccatttacctctccatgtgatatgtcggcgacagaattggaacatgacccggaatctgccattgcgaatgcttatgatatggttatcaatggctatgaagtgggcggggggtctgttcgtattcatcgcaatgagatgcagcaggtagtattccgcattctgggtatcactgaggaagaacagcaggaaaaatttggtttcctgctgaatgccctgaaatacggaactcctcctcatgcgggtttggctttcggcttggatcgcctcgtcatgttgctgaccgatactgataatatccgtgatgtgattgcatttccgaaaacaacggcggcggcatgtttgatgactgaagctcccagttacgcaaatcctgcatcattggaagaattggcaatctcagtcgttaaaaaagagagcgaataatggattacaagcgccctgagtctgtattggttgtgatttatgcggctaccagcaaaagggtgctgatgttacagcggcgggacgatcctgaattctggcaatccgtaaccggtagccttgaagggaacgaaaaaccgtgggaggcggcgttacgtgaagtacaggaagaaattggcattgatattattaatgcgggttttgaactgacagattgtcaacgctgtctttattatgagattttttcacatttacgttatcgatatgctccgggtgtaacgcgcaataaagaacattggtttttgctggtgttacctgaggagcgtgagatcctgctgacagaacatttggcttatcaatggctggcggtcgaagaggctgccagattaactaagtcatggagtaaccggcaggcaattgaagagtttgttatttaatctattagacgttttatcggagatattttcatggcaggtcatagtaaatgggccaatacgaaacaccgcaaagcagcgcaagattcaaaacgcggtaagatttttactaaaattatccgtgaattagtaacagctgcacgtcttggcggaggcgatccggcttctaacccacgtctgcgtgcagccgtcgataaagcgctgtccaacaacatgactcgtgatacgctgaatcgtgccattgctcgtggtgttggcaatgatgacgcagataacatggaaaccatcatttatgaaggttacggtccggggggtacagcagttatggttgaatgtttgagcgataaccgcaaccgtaccgtttctgatgtacgtcatgctttcaccaaaactggcggtaacttgggtacagacggctctgtttcttacctgtttaccaaaaaaggtgtaatttcctatgcaccgggtctggatgaagatgcggtaatggaagctgctttggaagcgggtgcagatgatgtcgaaacttatgatgatggtgcaattgacgtttataccacaccagaatcttttggcgatgttaaagatgcactggatgcagcaggtttcaaggcagaatctgcggaagtttctatgatcccgtccaccaacgcggaattggatgcagaaacagcacctaaattacttcgtctgattgatatgctcgaagattctgacgacgttcaagaggtttaccacaatggtgaaatctctgatgaaattgcagcgcagctgtaattaccatcagggttcacagcgtagagaaagtgttccttatctcagggcactttctctaacgtttttatcccatatcacaggtggaataaatcgatatggcgattattcttggtattgaccccggctctagagttacggggtatggtgtgattcgccagcagggacggcaacttatctatattggtagcggttgtattcgaacaaaagtagatgatttacccaatcgtttgcagaggatctatgccggtattaccgaaattattatccaattccgaccagatgtttttgcgatagaacagattttcatggcgaaaaatgcggattcagccttgaaactggggcaagctcgtggtgtggcgattgtggctgcggccaatgaatccattcctgtatttgaatatgcagcccgtcaagtcaagcagaccgttgttggtactggggcggcagaaaaaagtcaggttcagcatatggttcgctctatgcttaaattgtctgctaacccgcaggctgatgccgcagatgctctggctattgcgattactcattgccatttgaaccaaaatttattgcgtgtgggtgatgtgcggttaaatttaacgcgagggcgtttgaaataaactatgctggatatacgtccagctttttttatgctataagctgcagcggaatgatttatttttattttcagggggtaaacagtgatagggcgtttgagaggaaccgtgttggaaaagcagccaccattagttttattagaaaccaatggtgtcggttatgaagttcatatgccaatgacctgtttttatgaactgcctgaaatcggccaagaggctactttattcactcaatttattgtgcgtgaagatgctcagttattatacggttttaatgataaacaagagcgcgcactttttcgtgaactgattaaagttaatggcgtagggccgaagctggcactggcgatcctgtcagggatgtctgctcagcaatttgtgactgcgattgaacaggaagccattacctcattggtcaagttgccgggagtcggcaaaaaaacggccgaaaggctggttgtggaaatgaaagatcgctttaaaggccttaacggtgatctgttcaaccaaagcaacgatattaatttacctgcggtggctaaacaagccaactctaatacggatattgaagcagaagccgcttccgcattggtttcactgggatataaactgcaggaagccagccggatggtaagtaaggtggctaaaccgggcgcagattgtgaaacgcttattcgagaagcgctgcgtgcggctctgtagttacaggagttaaatgatgattgaagctgaccgtctgatttcagcagaagttctgcaagatgatgaagtcattgatcgcgctatcaggccaaaactactgtctgaatatgttgggcaacctcacgtttgtgaacagatggaaatttttattcaagctgcccggcaacgaggagatgcactggatcatttgctgatttttggccctccaggattgggtaaaaccacgttggctaatatcgtagcgaatgaaatgggcgtcaatctccgcacaacatcagggcctgttctggaaaaggcaggtgatcttgccgccatgctaaccaatcttgaaccccatgatgttctgttcattgatgaaatccatcgcttgtctccggttgtggaagagatcctttatcctgcaatggaagattaccaactggatcttatgattggtgaaggcccagccgctcgttcaataaaaattgatctgcctccatttacgttagttggtgcaacgactcgtgcggggtctttaacctccccattacgcgaccgatttggcatcgtacagcgccttgaattttataacgtagatgatttacagagcatagtttcccgtagtgctcgctatatggggttgggcatttcagaagagggagcaaggcaaatagccatgcgttcccgtggtacacctcgtattaccaatcgtctgctgcgtcgtgtgagagatttctctcaggtaaaaggggatggctctattaacggcgacattgcagtccaagctctcgatatgctgagtgtcgactcggcaggttttgattatcttgaccgtaagctattaattgcgattattgataaatttatgggtggccctgtgggggtggataacttggcagccgcgattggtgaagagcgggaaaccattgaagatgttctggaaccatttctgatccagcaaggttttatccagcggactcctcggggaaggattgctaccaatcatgcttatcggcattttggactgagtaaagaagcggagtagaaatatttcaatactagctcgggttggttgctaaaagctggaatgtgtgcgccattcgtcgcggtaacagtgctgaaatcagcctaaaagccagcatacgacgaaaaacgaatatggctaatatgagcagtgagtatttggacaaggtattaattgcaggctttcaggtgttgagtgagaaataaacactcatgctcttgccctggttaaagccgccttcttattagaaggcggctttttattattattgttggtcaaaaaatcatataaagatataacatggaatagtcataaaattaatatccaattaattttgatttagatcaactttaaatatttagtagatgaaataataaattcattaataccttgttttgacaaaaaatctttaaaagatgtgatctgtcttggatcacaaagatagacaaacaggtatatttttggctgatttaaaaccatataaatgggatggataatgaaaaagatttctgcgcttgtattggctgctgctacattagctccgtcattgacctttgctcatgaagcaggtgacttcctgttccgcgcaggtacagcaacggtaagaccgaatgctggatctgatgatgtgttaggtcagggatctttcggtgtaaataataatacgcagctgggtttgacttttggttatatgatcaccgataacattggcgttgaattattagccgctacacctttccagcatcgtgttaatttaccgaaagccggtgatgtggctaaagttaagcatttacccccaactttgatggcacaatattattttggcgccaaagaaaataacttacgtccttatgtgggggttggtgtgaattacactacattctttagcgaaaaatttaatgacaataatgcaaccgttgaagcagcaaaactaaatagtctggatctgaaagattcttggggtattgctggtcaggttggtttagattatcagttggataaaaactggatactgaatacctcattgtggtgggtgaatatcgaaactgacgtgagattcaaagctggtgatgcagaacaaaaatataaaactcgccttgatccatgggtatttatgtttggtgtcggttataaattctaacagattgatatataatactttgttagatggtaatagagtaagtaagttccgtatgtgtttgacataagagagaagcaatggagcctaatctggagttgtgcggcggaatcccagatttttccgtcactttagcttaaagtgttatttcgttccctaccggaaacgactcttcctaggtgaaagccttgttgtatcttcgatccgcaatggcgatatcgccattgcggatcgaagcaagtagactttctcacttgattgtctcgctatggaaggttttccaatagaaaacggatttgattctcacccatcagtttagcaatcctctctggatgtgcgccatttttcagtaaagcgtcagtaatactaacgaggccagtagcgtcgaagggcatctcaaccgcaccgtcaaagtcagatccaagggctacatgatcatcgccggcgatattagccgcataaatctgcgccttagcgataccggtgggagtaggatcgcacactgctttgtcccaaaaaccgataccgatcagtccacccattgcagcaatccgcctgagttggtcatcggacagattacgaatgttgtcacaagtacctttgacgccagtatgagaaacgaccacgggtcgcgtcgcgattaccagtatgtcatcaatggttttggtcgaggcgtgagccaaatcaatgatcatactctttgcctccattcgccgcaccatatcggcaccggcagcagttagcccacctttttcaataccatgggcagatccgccgaactctgtatcgaagaaatgagtaggtgccatcatccggtagccggcttcgaaaagcacatccacattggttgggtcgccctcgagaacctgtgcgccttctgaggcgagcagcacacccacaatctttgggtcactcctgcgtctttcaaggaaggccttcaaatcagcacggcttttgatcaccaccagtttcccatttgaacgagcggcagcctcatgcaggcgtgctgcttgatagagtgcccgttcttttaaactgaacagagttcgccaaggccaacattgtgccagagcaagcaaagtcacatcgtcagtttcggcgctattcttctcgatattcaacccacgtggtgacttagaaacaacagcaaagacctgcacagccacattgccgtctatcaaacgcggtatgtcgacttgcccacgcgtcgatcgatccaaaaggtccctgccccagagcagcgtatcggcatgcaagtcggcgatcagcagacgcttgtgcaagtcaaccgcggtttgtgttgctacatcagtaaccccgatcacacgattcatccgtgtttcaacgagccttggcaggacgaaaaagaaaatcagggcacaaacaccaataattatccctactcccgtactcgtcagaatgattttttcgcgtcgtgtcatatcctatctctcgacttattgagccagcaacatacacccgataacgccaatttgtcccatttttacgtttgtggatatataggttctaacggattatcgaagcttgattgaattaatcacggtattgacacccttaatgcctctagtgatttgtattgcacgtgtgacgtcttcaggagagctaacgaatccacttaactgtacacggcctttgaaagtttctacactgatttccctggattttagattgttggcctcaagtaatgctgattttactttggctgtaatgacggtatcgtcaatataattccctgtactttctgttgttgctgttggagcacatgcagagatcgtcatcgccataacagcagttacaaaaaacgtagagaccacttttaatagtttcataattatgctccgttgttctcaataacaatgtttatttatcgaaacattattctcatttttactttaagtatcatgccattgtgtcatacccgtactcagaaagtattgttgaaaacaggaaaatctacaaatgatagggggaaatatttattttcggatggtgaaaggttggcggcaatagcttcccccatcatctattgatgagggaagggggaaaattaacgttgtgtcgcggttttcatggtgcggacaaacgtctccagtttttccagcataatttggggctggtttaaattatcttcaatgatttttaccacagcggagccggaaatagcgccagccgcgccgctatcgagtactgatgtgacttgtgcaggctctgatatgccaaaaccttgtagtgcaggagcggcatgatactctttgagtttattaaccagatgcgttagtggatattcagcccggttctgagttccagtgatcccggctcttgacagcagataagtgtaaccccgcccacatactgctatttcacgcagtagatcatcatctgcatttggtgggcaaatgaatatcggagcaatgtcatatttcagtgcagctgagcggaaattacgcgattctgataacggtacgtcagcgatcaaaacagagtcgacgccggcatttttacagcagcgataaaattcatcgatcccattgtgaaaaaccagatttgcatacatcagcaatccaatcgggatatcaggatatttggttcggatttgagacagcagctcaaaacacaatgcagatgtaacattggaagataatgcccgtaaattcgcattttggatggtagggccatcagcgagaggatcggaaaatggaatgcctaattccagcgcatccgctccgccagcgataagtgcatcaataatctccagagataactcaggattaggatcgcccaaggtgacaaaaggaacaaaagcgccctggttttggttttctagttttttaaatagctgctcataacgttccatcagatttcccccctggattgcaaaatatcgtgtacggtaaagatgtctttgtcgccacgaccagataaattaacaatcaataattgttctttatcaggagcctgatggatcattttcaaggcgtgggcaagtgcatgtgaggactctaacgcgggaatgatgccttcgttgtgcgacagagccttgaatgcgtcaattgcctcatcgtcagtgactgaaacataatcagcgcgtccaatattgtttaggtaagcgtgttgggggccgacagaaggaaaatccaggccggcggaaatagagtaagattcttcaatttgcccgtcttccgtctgcatgatcggagatttcatgccgaagtagatccctagcttgccatgtttcaatggcgcaccatgttctccggtttcgataccatgtcctgccggttcgacaccaatcaggcgaacattagtttctggaatgaattcagcgaacaggccaatggcatttgagccgccgccaatacaggcgataacggcatcgggtaaacgcccctctttttccataatctgtgccttggcttcctcgccgatcattcgttgaaattcacgcactatcgttggataaggatgggggccggcggcggttcccagcaaataatgggctttgtcatagcaaccagcccagtcacgcatggcctcgttgcaggcgtctttcagggttgcggcaccactgtgaacaggaatgacttcagcgcccatcagacgcatacgaaagacattgggggattggcgttcaatatctttggctcccatgtaaatacggcattttagccccaaaagtgcacaggctagtgcggttgccacaccatgctgaccggctccagtctcggcaatgatttcgtttttacccattcgctttgccagcaatgcctgtcctaatacctgattggttttgtgcgcaccaccgtggagcaaatcttcccgttttaaatacagacgactttttgtgcctttggtcaggttctggcataaggttaaggcggtcggacggcctgcgtagtttttcagtagatcttgaaaggtttgttgaaattcaggatcgttttgcgcctcaataaatacttcttctaactgatcaagtgcggggatcaagatttggggaacaaactgcccaccaaagtcaccaaaataaggattcagtttactcattattcgcatcatccgttttctgtttgtaaggttagtgataacagcgtaattgttggaatattagtttgattttttgactgtttttgatgccaacgcttgtttcgacaccagaattaaaatctagtccataacatcctagcgctgctgcctgttggcagttttcaggatttaatccaccggccagcatgctgttacgttgaaaacgctgatcgattgattgccagtcaaaggttttccctgttcctcccgccccattatccagcaataaatggtcgatattggatatttcggaaaattctgtagcctttgacatatcaatagctttccaaatctcacaatattcaggtagtaaaggacgaagtgcattgatgtagtttttatcttcattgccatgcaactgaactgcattcaatgaaagttgtcgggcgataccactgacaaaatctaatggttggttttgaaatacgccaacatattgcaggggagcttcattgatgatctgctgggcttgttgcagattaattttgcgcggtgatttttctgcgaaaattaagccaccataaacagcaccggcctgtaatgcagttttggcatcttgtggacgggtaagaccacagattttattgtcacccagaatcaaccgacgcaaggcgagatctaaatctgactgtaccattaaagcactgcctatcaggaaaccgtgggcaaatcggcttaattcacgtacctgttgatgctggctgatgcccgattcgctgatgataatggtgccttctggtaaatcagttgccagcctgcgagtgcgatctaaatctatggacagatcacgcagatctcgattgttaatgccgatgacttttgctcccagcacaattgcccggcgacgttcatcttcggtactgacttccgtcaatacgcccatatcaaggctgtgtgccagtgcggatagttcacgataagtctcatcattaatcaccgaaagcattaacaaaatggcatcggcctgataataacgagccagataaacctgataggcatcaatgatgaaatctttgcacaaaactggctggtgtaccgcagagctaaccatgcggagaaaatcatagttgccctggaaatatttttcatctgtcagcacagaaattgcggcagcgtaaggttggtaagttttagcaatgcgaaccggatcgaaatcggtacaaattaatccttttgaaggggaagcttttttacattccagaataaaaactgtttgcttatggctcagtgcctgataaaactgacgatggctcggcacaagggaatcaataaagctttccaatggctgctctgctttgcgtttggccagatatgctgccttatcatcaacaatcttctgtaatatgttgttcttcatgattaaatccttgccgctaatgcggtcactttttcgtaggcttgaccgctgtaaatcgtatttaatgccagttgagtattttcccgtagattttcttgtccgtggactttcatcaagagagctacatttgcggcaacggcatcaacatgcgctttttgtccacgaccttgtagtaatagtctcaacatatcgcaattttcttccggtgatccccctttcagtgaagatattggatagttcggtaatccaaaatcttttgcggttaattgatattggataatttcaccatgatttagctccgcaacgagagtgggggcatgtaaggcaacttcatccattcctccactatgcacaactgcggcacgctgatagcccaatacctgcaaggtatgggcgatgggagccaccagttcggggctgtaaacgccaatcagtgtcagcgggggacgtgccgggttgatcaatggaccgagtacattaaataatgtgcgaactttcaactgttggcgaacctgtacaacatggcggaatccactgtgatattgtggagcgaacagaaaacaaacaccgatttcatccagcgcactgcgtgaatcctcggcactggcatttaatgcgatgccaaacgcggtcagtaaatcggatgatcccgaacggctggaggtactgcgatttccatgttttgctactttaaggccacaggctgccgcgacaaatgcgctggttgtggaaatattgatgctgtttgtcccatctccgcctgtacctacgatatcgcagaatgtgtaatcaggacgtggaaagggtgaggcattcgccaataatgcctgcgccgcacccgcaatttcttgtggctgctcgccgtgcagtttcatgctgaccagtacagccgccaattgagcgtcactcagttcaccgcaaacaattgcggtaaataattgctggctttcttgttgtgtcagtgtttgggcactgaacaatttttcgaaaattaactgcattttcctattccttattattcctgtacccatgccagagtttgttcaagtaatttagctccctgtgtggtcaggatggattcaggatggaactggaacccacagactttgtgcctgtcatgacgtaccgccatcactgtatcaccacaagaagctgagaccaccagcgtgtcgggaatatttatccccgtaagggaatgataacgggcaacgggcagagggttgattaggccggaaaacatggcctgcccatcatgagtggccagagtagactttccgtgcagaatttctctggcggcagagattgttccaccataagcttcaataatcgcttggtgtccaagacatatcccaatcacaggaatttggctaataatacgtttgagtaactggggcatacagccagcatctgccggctttcccgggccgggtgataacattagaagcggtgatttcatctgactaagctgtgccatgattgtttctgttgacaccgtattgcggtagataacgacctgatgatcaccgacacgcagttgatccacgaggttataggtaaacgaatcaacattatcgagcagaagaatatttgccattagaatatcacctccgctttgtgtgcctgaataatcgcacgaataacggctctggctttactgtgagtttcatcgatttctgattcgggaatggaatctaaaacaatgccagcacctacttgaacgacagctatgccgttttctacataggcagagcgaatcacaatgcacgtatcaaaatcccccttaccagtgaaataaccgaccgcaccaccataactgccacgtcgttcaccttcatgttgtgcaatgagttgcatcgcccgaacttttggggctcctgtcaatgtgcccatattcatgcacgcttgataagcatgaaagacatccagatcgtggcggagtgtgcctacgacacgagaaacgagatgcatgacaaacgaatagcgatcaactttggttaaatctgccacatagcggctacccggttcacaaatgcgtgctaaatcgttgcgagctagatcaaccagcattaagtgttcagacagctctttggcatctgtacgcatttccagttcaatccggctatccagatcggcatccagtgtgccgttggcattgcgtccacggggacgtgttccggctattgggtagatttcaatctgacgactactggtatcatatttaagggcgctttctggagaagcaccaaacagacaaaagtcctgatcctgcatgaagaacatgtaaggactagggttttgatgtttcagcgtttggtaagcattgagtggggaaggacagggtaaggtgaaacgccgtgacggaactgcctgaaaaatgtcgccttgacggatggattgctgtaattgttgcacgatatctgcatattggtcatcactttgattacaggcaatggtcatgtctggtaatttcacagattcaagtggttggccgggttccaaaatagcagcagttaatgtggtcaggcggtcatgaagacgctgtttttctgaatctgattcaccaaacagtgacgtttgtaagaatgcgtgtttatttcgatggtcgaccactaatagcatttctgcgagataaaaacagaaatcagggcaacgttgatgagttttgaccttgggaagcggttcaaatcctgcaactaaatcgtaagcaaacagtccacccacgaaaattgcgtctggagttccagaaagggaggataatgtcattagtgcccgcaatgcatcgaaaatggaatcggcctttaagcgactgtcttcatccagattgtgcctggtggcgggaaactgtgcttggagaatatgtaatccaacatgtagttgggcttttgctgagagtaaatcggtgagtataggtagtagatttcggccattttcggtgagggcctcaaaagtgacttgttgttcgttggctgtaattctcatggcactgtcgatgattaacaggcttttcaaattcttcttgctgcttatttcagccgattccagcaataacgtggctgaacgattaccacaaagctgattgaaaagtagagttgggtctgtttggtaaacagtgtctacttgcttgattgaaatcttaaggtttagatccgtcatactttccccttttccactttcatccacataaacatagttataaaaaaacccgctttttagagcgggtttttgcactttcgtatcgatacttatgtgcgtgattcaaccgccctgaatgggaagttttgccaccaacggattgctttcataagtatgatcatctccagcgcctcatttgttaaatggaataatggccatgtgttcctgccaaccttcgtactagtaaactggatcaaaattcgcttgtcaatcatttttactgaatttcttatttctttctgtggccatgtctgtgtgtcatatccgtgatatcttttgatggaatatggaatagatggctatgacacgaaagtattaatggaagatatacaaaaatagggtgttggtgctaaagatcctgtttataaaccaaattaaaaagatagaatgaagtgggatagaataggggctgctgtaggattgaggattagagggtgatgaccgtaaccaatgacatgataaagcgctatgatttacatagccatacaaccgcttcagatggagttttatcaccagagcagcttgtggatagagcggtttctatgggtatcaacgtactggcaatcaccgatcatgacactacggatggtattccgcctgctcgtgtatatattcagcaacagaatttaccactgtcgctggtggctggcgttgaaatttcgacattatgggagaattttgaaatccatattgtcgctctgaatatcgatactgattgcgtttttttgacaaattttctctccaatcaggtaacgttgagaaaacagcgtggtattgaaattggacaacgccttgctaaggtgggtatccctgatgcctgggaaggtgcctcccgcttggcaaatggagggcaggtcactcgcgggcattttgcccgttatttgattgaagcgggagttgaaccgacaatcccgaaagtattcaaaaaatatctggcgaagggaaaaatcggttatgtccctgctcaatggtgtacaattgagcaggctattgaaactattcatcaagcaggggggcaggctgtgattgcccacccgggcaggtatgatttgtcgatgaaatggctgaagcgtttgatagcctggtttcaacagcatggcggtgatgcaatggaagttgcgcagtgtcagcaggcacctaatgaaaggcaacaacttggtcaattggcaaaggaatatggacttaaagtatcattaggatcggattttcaccaaccctgttcatggatagagctagggcgcaatttgtggttacccggtgatgtaataccgatatggcatgattggtcacgctaggggctgcataaagtaagaggttatacttgtgagccagtttttttatattcatcctgacaacccacaatcccgcttaattgggcagagtgtagatatgttaaaaaagggtggggttgttatttatccaactgattcaggttacgctattgggtgctgccttgaaaacaaggatgccatgacacgcatatgccgtattcgtcaattggatggacgccacaattttaccctgatgtgccgtgatctttctgaaattgcgacttatgcgcatgtggataatcaggcattcagattgataaaaaataatacgcccggtaattacacttttattttacaggcgacgaaagacgttccccgtcgtttgatgaacgaaaaacgtaaaactatcggcctacgtgttccttctaatcctattgctttggcattactggaaggaatgagagagccactgatgtcatgtagcttgattttacccggaaatgattttgcggagtctgatccagaagagattaaggatgtactgggtaaacaggttgatttaattattcacggtggttatcttgggcagcaaccgacgacagtaattgatttgaccggagattctccggcggttctgcgcgaaggtgaaggggatgtaacgccttttctataaggtgaatgattcacatttttattttatgacacgacgcctgtgaaggcgacaacagaggttgctcaatgagcgataaaacacaaaaaacgcaaaaaacagaaagaacagaaaagttacaaaaaattctcgcgcgtgctggtcatggttctcgccgcgaaattgagggctatatccaagaggggcggattagcatcgatggcaagaccgcaacgttgggtgatcgcatcgaagtcaaaccttccataaaaattcgccttgatgggcgtatcttaagtatcaaagaaccacaaaaaacgatttgtcgcgttctggcttattataagcctgaaggtgaactgtgtactcgacatgatcctgaagggcgtccaactgtgtttgatcgcctgcccaaaatgcaggatgctcgctggattgccgtagggcgtctggacatcaatacttgcggactgttgctgtttacgacggatggagaactggcaaaccgcctgatgcatccaagccgtgaagttgagcgtgaatatgctgttcgtgttttcggtgaagtagacaatgcgaaacttcggcagttgacacaaggcgttcagttggaagatgggcctgcctcctttaaaacagtctcatttaagggtggtgaaggtatcaaccagtggtacaacgtgacattgacggaaggtcgtaaccgtgaagtcagacgtttgtgggaagctgttggtgtacaagttagccgcttgatccgtgtccgttatggtgatatcgatctaccgaaaggtttaccacgtggtggatggacagaattgggattggagcagactaactatttacgtcagctggttgatttaaatgaagaaactatgtccaaagttgcggttgagcgtgaccaacgccgtatcaaggccaatcagatccgccgggcagtaaaacggcattctcaggtcggttcttcccgtccagcggggaaacgccctgcaagtagctctcgtcagaatgcaggaagaaaagcggcacctaaaggtcgttaatgttccggagtcgctgtttcagtgttatatcaaggctggaacagcggctttttatctatcttaccaatcaacccctttctgagcttttattcccgcatcaaacgcatgttttactgggcgcatttctgtaatagtatctgcaagttcaagtaattcacgatggcagccccgtccggtaataatgacagactgatggataggacgttgtttaagtgcggtcagtacatcgattaggtcaagatatttgtaactgaccatataggtcagctcatccaaaacgacaagctgcaatgaggagtcggataacatcgtcagggcatgttgccatacagcttggcaggctgcgatatcagtttcacggttttgcgtttcccatgtaaaccctgtcgccatgacatgaaactcaacaccctgttgtgccagcaggttcctttcgccgctttcccaagttcccttgataaattgaataacaccagcacgctgaccatggccgattgtacgagtgactgtgccaaacgcagcggttgttttccctttaccattaccggtgaatattatgacgatccctcgtttttgttgagccgcctcaatacgggcatcaactttttctttcaggcgctgttgtctttttttgtactgtccgttatccattggcattatttggcaggccccgctttacgacccggctgagcatcaaagctgatacctgaatcactcaggctgtcatcacccatcagatagaggtagatcggcatgatctcggccgggatttttaatttggtcgcattttcatcaggaaatgcactcgcacgcataccggtgcgtgtccctccaggattaatgcagttaatacgcaagccgatttcttgatactcctgcgctaaaacctgcattagaccttctgtcgcaaatttagaaacagcatatgcaccccagccactccttcctacacgccccacactggaactggtaaataccagagagcctttgggggattttaataacaggggaattaacacctgagtcagcatgaaagtcgcgttgacattcacttggcatgacttcatgccaaagctgaacaggttgttctaggacaggtgcgacaacacccagcagacctgcgttgtgcaataccccgtccaaacggggataacgttgagtgagttcatctgcaaaggcctggcattcttcggccgtcacggtttaaaagatctattgtataaatggtaaccgggtaagccgccttcgttttcgatttgctgtttgaccgctttccagttttgctgttgtgcgccccagcaaaataacctgtgcaccgtagcgagcataagttagcgccgcttcacgaccaatgccgtctccggcaccggtgactaaaatgattttctgttgcagcagatcatgattgggttggtaatctaacatctgactatcttcctgttttttaaagctattacttaaggcgtgtacatctgccattttaggctgacacatgaagtctgtcatcagaacaaaacttaatgcccccgtcaaatttgctcaaggtagacagaaaagaacagagctctgatgagataggatgcaagtaaactgttagagcacagcctccggtttttagttagaatgaagaatattgttcatcataattgaagataaggtggatctgtggagtatttgtctctatatggactgttcttggccaaagtagctactgtggtattagcagtcgtcgttcttgcagtattttgtattggattgggtgtacgtaaaaccacgcagaaaggtgaattgcgtctgaccaatctgggtgaatcatacagggaaaaacagcgccagatgcagcaggctcggatgaatgatgcagagcagaaaatttggcaaaaggcgttaaaaaaacagcagaaaaatgatgccaagcagaaaaaggcagaggctaaagcgagtcagaaagttttacagaaatcgaacctttatgttctggattttaaaggcagtatggatgcccatgaagttgattctctccgtgaagagataagtgccatactcgctgtggcagatagcaaagatgaagtgttactacgtttagaaagccccggcggtatggtacatggttatgggcttgctgcatctcagttggctcgtttgcggcagaaaggaatacgtttgacgattgccgtggataaagttgccgcaagtggtggttacatgatggcttgtgtggcagatcgtattattgctgccccttttgcgattattggttctatcggtgttgtggctcaactcccgaatatccaccgattgctcaagaaaaatgatattgatgtagaactgcatactgccggggaatacaagcgtactctgactgttctgggagaaaatactgagcaaggacggcagaagtttcaagaagatctgaacgaaactcatcaattatttaaatcatttatttatcagcatcgtccatctctggatgtggaaaaagtagccactggcgaatattggtatggtacgcaggcaaaagaaaatgggttaattgatgatgtgggtgttagtgatgatttcctgattgaacagatcgaacactgtgaagttattggggtcagctattcccgtcgtaaacgtgtgatagaacgtttcatggggagcgcaatggagaatgttgataaattgtttatgcgctggtggcaaagaggcgaaaagccattgttctgataattcaggtataagctataaccgttagatatcaatttgttataaaacaataaagggtaataaggtggcagtttggatctcccttattacccgcacaataatgaataatctgttagagattacctgatcaaatttatcgtctgctaaatgatatttttcggataatctatgtgctaaatgtttaaaaatattaaacgcaacggtgcttttcacagtagacaaattgtcactattcaaaaaatattcccccgttaaaaacgagcattttacctttttattctatatcatctgtatatattccctgaatgaaatcgtcgtatttcctaatgatttcatttactttttcctgtaattgttagcacttaatggacaatgtttcagtttgcatagattatgctcctctgagaaataagttgttgcgcatcgttttttatcaggtagagtgtgggcttttcgtcatgcagatggaagattttgtttacaactgttaaatcatacaattgcatggcatgtgctggtatataaaataccttaaatatttcaaaggtttttgcgcttgagcaaagtacaggataaaaattagttgatatcttgcaaatctatcgcaatataaaaaagagaatttattttatatatcgcaacataacgccgtgatttccgccatctgaaaagaagataattaggtaaaggtaactatgggtaaagctcttgttatagtggagtccccggcaaaagccaaaacaatcaataaatatctggggaatgactacgttgtaaaatccagtgtaggtcatatccgtgatttgccgaccagtggagcagcgagtcaaaagagttcgaactcatcaactgataagaataaaaagaaaaaggatgagaagacagcgctggttaaccgaatgggagttgatccctatcacggttgggaagcggattaccaaattttgcctggtaaggaaaaagttgtcgcagaactgaaaatgcttgctgaaaaagccgatcatatctatctcgcgacggatcttgaccgtgaaggggaagccattgcatggcacctacgagaggttattggtggaggagaggctcgtttcagtcgggttgtatttaatgagatcaccaaaaatgctatcactcaggctttcgacaatcctggtgaactgaatatcgaccgtgtaaatgcacagcaggcgcgccgttttatggatcgcgtcgtgggttatatggtttcacctctgttgtggaagaaagtcgccagagggctgtctgccgggcgcgttcaatccgtggcggttcgccttatcgttgagcgggaacgtgaaatcaaggcctttgtgccagaagaatactggcaattacacgcggacttaatggctaaaggagacattgatcttcatatggaagtcacccatgaagggggaaaaccattcaagcccattaacgcacagcaaacacaggctgcggtatccttgcttgaaaaagccagatacaaagttcttgatcgtgaagaccgcccgacgtccagtaaaccgggcgcgccattcattacttcaacactgcaacaggctgccagtacgcggcttgggttcggtgtcaagaaaacgatgatgatggcacagcggttatatgaagcaggacacatcacgtacatgcgcacagactcgactaatttgagtcaggatgcactggacatggttcgtggttatatcaatgatcaatttggtgacaaatatttgccaaaaacggccaatatctatagcaataaggaaaattcgcaggaggctcatgaagctatccggccttccagtgtagatgtcatggcggaagaactaaaagatatggaagccgatgcacaaaaactgtatcagcttatctggcgccagttcattgcctgtcaaatgatgccagcgaaatacgattccactacgctgacaattcaggcggggaattttgaactccgtgccaaaggtcgtacattgcgttttgatggttggactaaagtgatgccagcattgcgcaagggggatgaagatcatactttaccagtggttgaagttggcactgaacttgatttgaaacagttgagcccaagccagcatttcacgaaaccatcggcacgtttcagtgaagcatctctagtcagagagttggaaaagcgtggcattggtcgcccatcaacctatgcatcaattatttcaactattcaggatcgtggttatgtgcggggtgaaaaccgtcgattttatgcggaaaaaatgggtgaaatcgttaatgatcgtttagaagagaacttcaacgaattaatgagctatgattttaccgcaagaatggaagaccagctcgatcacgtcgccaataacgaagctaattggaaaggggtactggacgagttttttaccaatttcagtgaacagcttgatgttgctagcaaagatcctgatgaaggcggtatgcgtccgaatccaatggtgagcacttctattgattgtccgacgtgtagtcgcccaatgggtattcgcacagcgacaacgggggtatttcttggctgctctggctatacgctatcaccgaaagaacgttgcaagcaaaccatcaatttaatcccggaaaacgaaattctgaacattcttgaaggggatgaggcggaaactaatgcattgcgtgcccgccatcgctgtaaagaatgtggtacagcgatggatagctatcttattgataaccaacgtaagttacatgtttgtggtaataacccagcatgtgatggttatgaagtggaagaaggcgaattccgaatcaaaggttatgatggcccaatcgttgagtgtgataaatgtggttcagaaatgcacttaaaaatggggcgtttcggtaaatacatgggatgtacaagcgaagagtgcaaaaacacccgtaagatcctccggagcggagaagtcgccccaccgaaagaagatccagttccattgcctgaactgccatgtgaaaaatcggatgcctattttgttctgcgcgatggtgctgccggcgtatttcttgcagctagtacgttccccaaatcgcgagaaacccgagcaccgctggttgaggaacttgtcaagttcaaggatcgcttgccagagaagctatgctatctggccaaggctcctgttgctgaccctgaagggcataaaacagtagtacgttttagccgtaagacgaagcagcaatatgtatcttcggagaaaaacggtaaggcgaccgggtgggcagcattttttgttgatggtgcttgggtagtaaaagaaaagtaatgattttagtgataggttagtatgttagttcattgaaatatattcagatagatatttcttttttttactaacagcataattttttttctaaaaagccagtcctaattgactggctttttttgtttttatatggaattaaaacataatatttctgcaataaatgtatgataatcgttatcatctccaattatttgttatataaatatacagcaggtgatatagtagttatatacccataaatatatattctttatagttataagaaaataaccattagcaatatagaacatgtttagactacaaaacattcgtacattttattattagggacagtgctgatatgaaactacagcaattacgttatattgtagaggtggttaaccataatctgaatgtatcttctacggcagaaggattgtacacctctcaaccagggatcagcaaacaagtcagaatgcttgaagatgaattgggtatccaaatatttgctcgcagtggcaaacatctgactcatgtcacaccggctggtgaagaagttgtccgtatttcacgtgaggtactgtcaaaaattgagtcaatccgttccgtagccagtgaacatacttatccggatcgtgggtctctgtatattgcaactacacacacccaagcaagatatgccttacctcctgttatcaaaggttttattgagcgctatcccaatgtttcgcttcatatgcatcaaggttcacccactcaaatcgcggaagaagtctgtaagggcaacagcgattttgcgatagcaaccgaagcacttcatctctatagcgatcttattatgttgccttgttatcattggaaccgttctgtagtggttacgaaagatcatcctctggcggccaggcaaaacgtaacgattgaagaattggcggaatatccgattgtgacatacacctttggttttacggggcgttctgagttagatgttgcctttgaccaggctggtcttaaacctaaaatagtattcacagcgacagatgctgatgtaattaagacttatgttcggttagggctaggagttggcgtgattgccagcatggcggtagaacctgttcaggacagtgatttggtgcgcattgatatgcgtgataaattcagttatagcacgacaaagattggtttccgtcgcagtagtttcctgcgtagttatatgtatgattttatctggcgttttgctccgcatttaacacgagatgtggttgataaagctatcgcgttgcgatctaatgaagaaattgaagatatgttcaaggacatcgaattaccgatagcataaagaatctataatgaaaaaatcagaggaaggcagctgatgttatcttcctctattctttatttaaaaattaataatacagtgttgatacatgaataaaagagcaggctgtacaggatattgtcagatacacgaatctttttgaaaataataacttactgtaataatcagataagtaattttaactgccattcaaattacactttaaattcaccgttgaaaaaattatcagaattttctattgatgattttttgttattatgaatgaatagatcaaaggatgccttaatttcgggatcttccaatgcttgataatcaaataatgaaacacaggaagagtaagtgaattcgacattgatattatcattggaagcacaatttgaagcaatttctgaattgcttctgtcaaaattcactttgtacagtttcattttaggaatataaatcacttgatcttcaactccaatagcttcaatgacactggctaaagtcagagtagaataatgatcgttattcttcttcaacccaagcctaatggtatctccttgtttttgcagaaattgagaaaaacttttcatgctggaagaatttgtattcaaaacaatatccatgataagttgcagcaagttcgtcgcgattgaaaatcctttcattacgtggctgtaggtttggctttctatattcctgacgctcattaatggcagtttctctatgatatcaccccaaaattgcacgtcagttctatattgttggccgtgggtattagcatatttgatgatgtaatcagtcgcaattgaggaaagagaaatctgtgttctctttatttcatttaacctttgtatcacgccggatttgtcattgatttgtgaagtaatgacaaattggacaagtccatctatatcactgaattggtggtctgacaggggaaagttattctcaattccatcggaaaaaaattgttcagcctgcgctatatggtttaaatagtgttggcggtttttatcgacttttatatccataattcatcctccggtatttaagtaatgatattcagtaccgcatgtgtgctttagttatgaataaaacacatgtgctttcgggatgtcatcactaaaatttgtcaataaatgaggatttacagccggttagcaaaatatgtggtaactgaataacaaacgtccgctagtatgttatgtttaatggtgtagctgaccataataagaaaggaggagttatgtcgtttaaattgaaaacggactgtgcatcaacactctccattggcagtaaaatatatcattattacagtttatccctgttatctgaacgattgggtgagatagcccgtttgcctaagtccatgaaagtcctgcttgaaaatctcctgcgcaatattgatggcgattctgttgtggaagaagatttgaaggcattagtggaatggcagaaaaacggtcatgcagacagggaaatcgcttatcgtcctgcccgtgtgttaatgcaggattttaccggcgttccggctgtagtggatcttgcagctatgcgggaagcggttctgcggcttggcggtaatgttgaacaagttaatccattgtctcccgttgatctcgtgattgaccactcagtcatggtagataaattcggtacagagcaggcgtttgaagaaaacgttcagattgagatggaacgtaactatgaacgttatctatttttacgttgggggcaaaaagcctttaatcgtttccgcgttgtgcctcccggaacaggaatttgccatcaggttaaccttgaatatcttggtaaatcggtttggtatgaaaaccagaatggtaaggattttgcctatcctgatacgttggtagggacggattctcatacaaccatgattaacggactcggtgtattaggttggggtgttgggggaattgaagccgaagctgcgatgttggggcagcctgtctccatgctgatcccagatgtcgttggttttaaactgaccgggaaattgcgggaagggatcacggcaaccgaccttgttttgacggtgacacagatgctgcgcaagcatggcgtggttggcaagtttgtcgaattctatggtgatgggctgtctgatttgccattggcagatagagcaactattgccaatatggcgcctgaatatggcgcaacctgcggtttcttccccgttgatgatattacactgggctatttgcgcttaactggacgcaataaagatgaaatcgccttagttgaagcctactgtaagaagcagggattatggcgtaacgcaggggatgaacccattttcaccaacaaccttgaactggatatgtacacggttgaagtgagcttggcagggccgaaacgccctcaggatagagtagcacttggcgatgtaccacatgcattccaagctgccatggaactggacatccataaaatacaggagcatcgggcggacacgccagtcactcttgataatcagacttttgcactgcaagatggcgctgtagttattgctgccattacttcctgtacaaatacatctaatcccagtgtcttgatgacagcaggtttactggccaaaaaagcgattgaaaaaggtttgcaacgtcaaccgtgggttaaaacctcgctggcacccggctctaaggtagtaacgggttatcttgaactggcaggactcatgccatatctggaaaaattgggtttcaatctagtgggatacggttgtaccacttgtatcggtaactcaggcccattgccagagccgattgaagtagcgattaagcaatctgatctgatggttggcgcagtgctttccggtaaccggaattttgaagggcgtattcatcctctggtgaaaactaactggctagcatctccaccactagtggttgcctatgcactttctggcaatatgaaaaaggatctcactagggagccattggggcaagaccaacaaggccatgatatctatctgcaagatatctggccggatagccaagaagttgctgaagctgttggtaaagttaggacagagatgttccacaaagagtacaatgccgtttttgatggtgatgaaaattggcaatcgttggaagtggaaagctcagaaacttattcttggcagcagaattcaacctatattcgccttcccccttttttcagcgatatgacgattgagcccaaaccgataactgatatccatcaagccaatatacttgtgattttgggggattcagtcacaacggatcatatttctccggcgggaaacataaaagctgacagcccagcagggcggtacttgcaggagcatggcgttttgccgaaagattttaactcttacggttcaaggcgtggcaatcatgaagttatgatgcgtgggacatttgccaatatccgtatctgcaacgaaatggtgcctggtgtggaaggaggatacactcgccatattccatctcaggctcagttggcgatttatgacgcggccatgctttatcaggaagataagacaccactggctattattgcaggtaaagaatatggttccggctcaagccgtgattgggctgcgaaaggaactaggctgttgggagcgagggttgtgattgcggaatctttcgaacgaatccaccgttctaatctgattgggatgggcgtgttaccactggaattcccacaaggtgtcagccgtaagacgctaaacctgactggtgatgaacgaatcgatattgtaggattggggcatatcgagccagggcagatcattgcggtgaaaatcaactatgccaatggaaaagaaactgtcattgatgcccgttgtcgcatcgataccaatacggaactggcgtatttttataatgacggcatcttgcactatgtgatccgtaatatgctgaaataatagtaaccgtatagttcatcttcaggaatatgaatatttagaaaaaaactgcgtctacactgacgcagtttttattcttaactgaaaaccacctcctgcggaggtggttagcaacaggttggctctgccaataatgctactcatgggaaaatccgaatccgttatccccataacagagaaggatttaaccatgagtagattcaagaaagcatcgcatgtgctttggtgttgtcaataccatatcgtatggacacccaaataccgatttaggatcctgaaaaataatgtaggaaaggaaataagcagataaggatttccagtgagcagctcggaatagaaattgtggaattgaatgttcaaatagatcatgtgcatcttttagtaaaaattccgccaaaattatcagtatctcaagtgcttggtcatctaaaaggccgaacagctattcgtctatttaataaatttccctatttgagaaagaaaaagttgtggggaaatcatttttggtcaagaggctactgtgtagataccgtaggtataaatgaagaaatgataaggaagtatgtgaagtatcaagagaagcacgaacatgaggacaatcaattatcgttgaaagggatgtgaagtgaaggctctcagagtctgaactaatagcgcccctttggggcgaaatcaatgcccccttctatgaagggggatttttacttttttgtagagataaacagagaaatttcagtttgattgggatagtagatgtcccatccggctggctttggtatccagataataagcgtttttaggattacgtcctacaaccagtggtacacgctcgacgatattaatgcctgcgtctaccatgatttcaacttttttaggattatttgttagaagacggattgcattaatacccagcaatttatacatatctgagcatagagtaaaatctcgttcatcagcagcaaagcctagttgatggttggcttccacggtatcaacgcctttatcctgtaatgcgtaggcgcgaattttattcagcagaccaatatttcggccttcctgccgatgatacagtagaacacctttaccttccttgctgatttgtgaaaaagcggcttctaactgaaaaccgcagtcacatctcaggctgaataaagcatcccccgtgaggcattctgaatggatccgtgataaaacaggctcattaccggaaatatcaccgaaaacaagagcaacatggtcacgacctgttttaatttcttcaaatccaatcatcagaaattcgccccatggtgtgggcagtgtcgcttcagctactcgttttagctgtgttttagtattcatatgttgatttagcccgttataaatattgtgatacttagaacaataccggtttagaaatcagctaaaactacgtaaaaaattttttctgattacagcgtatatacgctaacggattataacagaaataatacgcctgtccgtatataaaatcatcagatgaatggatgaagggaatgttaacatactaaactataaacagatttttgcagatatacacaggtgcataggatgtcgctatttgagtcaaaatgggtgtatttgtcggcaaataaatagaataatgtgacaaaaaagagcaaatcaacatttgttgaaataaattgcttcctttgcgtggacgagaaatgttaatttaacgaaccactatgcctgttatttggcataatcaattagcaacaatcgataacaggaaagaatgtgaaatattttctaattttattactggcactgattgtttttgtcatctcagtaactctgggagcaaataatgatcaggtagtgacatttaattatctgattgccaaaggtgactactcgatatccacactgctgtctgtattgtttgctatcggttttatacttggctggggtatctgtgggggtttttacctgcgcgtctgtgtgtcattgcgacgtgcgaaacgtaaaattaagcgtctggaagcccaattggaacagcctgctgagtcatccgtaaagactgcatcgcctgtagtattaaccaaggaataattctccatgttagagctgttgtttctgttgcttcctattgccgctgcttatggttggtatatggggcgcagaagtgctcaacaagataaacagcaatctgctgaccgactctcacgtggatatgttgatggtgttaattttttactttccaatcagcaagataaagcagtcgatttattccttgatatgctaaaagaagatagttcagcgtttgaggcacatttaacgctgggaaatctattccgttcccgtggtgaagttgaaagagctatccgcattcaccagtcacttatggaaagtgcatctctgacatttgaacagcgtttactcgccatccaacagcttggacgtgactatatggctgctggtgtgtatgaccgggcagaaaacatgttcattcaattggttgatgaagccgatttctgtgagaatgcttttaactccttattaagcatctatcagtcaaccagtgattggaacaaagccatcgatgtttctgagaagctggtcaaactaggtaaacatcattttcgggaagaaatcgcccatttttactgtgagttggcactacaatacatgggcagtgatgcttccactgaagcagtagggtatctcaacaaggcggctcaggcggacaaaaattgtgcccgagtgtcaattatgttcggccgtatttatatagcacaaaaggaatataccaaagcggcggagttgctgaaacgtattctcgaacaagataaacagttggtcagtgaatctttgcccatgctggaagaatgttaccagaacttgtctcaaccggaagaatgggaggcttttgttcaatgttgcgtggaagaaaaatgtggcgccattgcagagctttacctggctgatattatcgagaaaaaagaagggcgtgatatcgcccaaaattatattaaccgccagttggaacgccatccaactatgcggctgttttatcgcttgatggactaccatttagcagacgcagaagaagggcgtgccaaagagagcttgctccttctgcgtaatatggtgggtgagcagatccgcactaaacccgattatcgatgccataaatgtggtttcacttcccgctcactttattggcattgcccatcatgccgttcatgggacactatcaaaccaatccggggtctggatgggcagtgacagtgtcactattatgagtggcaatatctgcgtgttttcattaatacatgtttcattacggacatgtttacttttcattagtaaattaaaggctgaaaaatgacatcccacacagctcaaactttaggtaagcagattgattcacctgttattgtcgcattggattatgacaatcaggacgcggcgttagcatttgttgacaagattgatccgcagtcctgccgtcttaaagtgggtaaagagatgtttacgctgaatggcccgcaatttattcaggtattgcatcagcgtggcttcgaggtgtttttggatctcaaatttcacgatattcctaatacaacggcaagagcggtagcagcagcggctgaattgggggtttggatggtgaatgttcatgcctgtggtggtgcgagaatgatgaccgccgctaaagaggccctgctgccatatggtaaagatgcacctttgttgatcgcagtgacagttttaaccagtatggaacaatccgatctgctgggcgttggtattgatatgacaccagcacagcacgcagagcgtttggcgatattgacaaaacaatgtggtttggatggtgtggtatgttctgctcatgaagcacagcaattgaaagcagtctgcggacaggaatttcaattggttacgcctggcattcgtcctgaaggcgcagaggctggagatcagcgccgcatcatgacaccgccgcaagcagttcaggctggtgtcgattatatggtgatcgggcgtccgattacccgggcagaaaatccagcattagcattacagcagattaattactctattgggatcgttcatggataataattctcgcttggtttattcgacggatatcggtcgagtccaagaagaaaaaattaaaccttcacgccataaaggcgatggtatcgtgcgtatccaacgccagaccagtgggcgtaagggcaagggtgtttgtataatcactggcattgatgctgatgaccaaacgcttgccaagctggccgcagaattgaagaaaaaatgtgcctgtggtggctcagttaaagaaggtgaaatcgaaattcagggcgataagcgtgatttgctgaagcagctactggaagcgaagggcatgacagttaaactggctggtggttgattcgtttctgttttttaacaggctatgcataactggattgtatagcctgttaagtcatctgtagtaaatgggtgttttgtgtgtttttttatctttcttgcgtcataatacgtgcagctgcggcaagaacatcaggatgtgcctcggcgtctttatcatttggttgggtaaaataagtcaccagaatcaagggagccttgtttttatcaggccaaatcaccgcaatatcatttgtagaaccatagtcgcagcgacctgtcttatctcccacaatccaattatctggcaccccggcacgaatgctggcaccgcctgttgtgtttcctttcaaccactcaaccaattgtgcgcgttgtgttgcagcaagtgtgttacccaatgccaatttatacaggctgtcagccatggcctgtggggttgtcgtgtcgcgttcatcatcaggcgtaaccatatttaactcaggttctttgcgatcaaggcggaactcgttgtcaccgatagatcgggcgaatcgtgtcacatcatgcgtaccgcctaattgatcaattagcagattcatcgctgtattgtcgctgtattggatggttgcggcacttagctttgccagtgtcatgccatctttgaggtgtttttctgtaatggggctgtattcgacaatgtcagattgctggtagtggatgcgctgatttaacaaaccctcattggtttcgctttttttcagaagagcggataccgccatcattttgctggtgctacataatggaaagcgttcgtgtgcacgataggtgattgttgaatggtctgcggtgtctattaatacaacaccaagacggccattggcatttttttccagagccgaaagttgattggtaatttgattttgttgagtagtagcatgtattggaaacgttatcagggcaccaagtagaggaaaaatcgttgctgatattcgtgtaagtcttaatgaggaaagtagcatataaggtatttccttaaggtaatggaaataatgtttacgggaagctggattgagcaaattatttcgtgctgattataaaactgccgcttgttattggcggcagtttatttactgtctatttgtaatatcaggcaacagggcgtgccacaatattacgggtttccattctgacttcttcaatgcgtacattaataatgtcattcaaacgatgaacggcttcacccttaataagaacggaacctgtctcttgactgcattgaagctcatcacgcacagcatgcaggaatgatcctggaacaaaagcgatagcaccattgtcaaccagacggatgcgcaggccaccacgggtaatatccacaatctcagcagagaaagttttatctgtgccagcatgaggatgtagaaaacgcgcatagagccagtcgcctacatcgcgttctgccatgcggtttgcacgccgacgctctgtcagttgcagacagacctcttcggatggtttttcttcttcggtttgctgaatgatggcttttaacaaacgatggttaataatatcgctgtatttacggataggagatgtccaagttgcataggcatcaaaacccaatccaaagtgtggacctggttcgggtctgatttctgcaaacgtttggaagcgacggatacggctatcgaggaattgagtcggttgttgatctaattcacggcgtaactggcagaaaccatccagttctagcagtgcatttgcttcagcttcaataccattttcctttaaaacgtccacaacttgatcaatttgtgttggttcgaagccagtatgaacgttataaatgccaaaacctaatttgtcacgcaggatcttggctgcacataggttcgcagtaatcatcgcttcttcaacaatacggttggcagaacggcgttgatcaataacgatatcaacaacattgccacctttatcaaggacaaagcgataatctggacgctctttgaaaaccaaggcatattgatgacgccattgattgcgacgttcgcacatctcttgtaatagagtgatttgggtagtgactgcttctgattctggtttccagccggtttggtgttccagccagtcagaaacatcatcgtaagccagtttaaatttcgattctacccatgcagcgaaaaattgcatgtcgtcgcctaattgtccatcttccagaatggaaacctggcaaaccagtgcaggacggcgagcttttggccgcagcgaacataaatcatcagaaagttcgcgaggcagcataggaatattgaagcctggcagatagttagtaaagctgcgctgataggcaattttgtctaattcactgtcagccttgatataggcagttggatcggcaatggcgatggacaatttcaggctgccatcattatttttgacgatatgcagtgcatcgtccatgtcctcggttgtcgcactgtcgatggtgacaaaatcgagagcggtcagatcgatacgctccagcgaaccatcatccaactgacaatcgggcattgttggagcttcacgttgcagactatggcgtgtcagagttacccaccaaggtgcatagtgatcatcacctttgataatataaccagtgatttcagcctgaaacccccgatctcctttcagtggatgacggcgcatttcagccactgcccaatcgccattctcaaaattatgggtgacttgattagcaggacgacaaaggatgtatcttttactaatgcatgatccggaataaccctcagtcggttgtcgttctctttcttctggactcttcctccaaaacgggttagaaatgcctcaaccaaggcttctggttcagcgattctttctctttatcggcgtgaatggcagcggtaatacgatcgccatgcatcactttcttcatctgtggtggtggaatgaaatagcttttctggccatcgacttccaaaaatccaaagcctttttcagttcctttaactaaaccttctacgcgtagggtctgagagtagagttgctgttttagctgtgcaagcagcggattgttttgaaacataataatctggggaatatggagttattatcgataattttggataacagttttacgcgaatcaggggtatggagcaagtaacatcttatcaaaacacgcaaaactgcctgaaaaggtcaataattacccagcttatatctgctgaaagcgagtccctttaggcgattgaccaatgtcatcaaatcttgttgtgggcggatccttcctgcaactcatggtcaagcgtgtgatagacagttgttggctggagaatggttcggccagatcgctgattaaggattttcccatacaatatatgagcttatgggtaatatatttatgtcgctgttctacttggtattttgtcactcggttttatcagcatactcacacagatcttcaataatacaagatccacagcgaggtttacgggcaatacaggtatagcggccgtgtagaatcaaccaatgatggcaatcaagcttgaattcatccggtacaactttcagtaatgttctctcgacttcatcaacgtttttccctggggcaaattgggtacgattgcagacacgaaatatatgcgtatcgacggcgattgttggccagccaaaagcagtatttaaaacgacattagcagtcttgcggccaactcccggcagtgcttccagagctgcgcgatcttccggtacttcgccctggtgtttttctaacaaaatgcggcaggttttaattacgttctcggctttggtgttatataatccgatggtttttatatactctttcagattgtcaacacccaaattgaggatagtctgtggagtattggcaaccggatacaactttgtggtcgctttattgacgctgacgtcagtcgcctgtgctgacagtaatacagatatcagcaactcaaaaggagaattgaaagccaactcggtggttggctgtgggttgttattctgtaagcgggttaaaattgctatccgtttttgttgattcatacctaattacgtccttagcttttcgtaatatggctgccacagcctttctctacgttgtcatagcgacgtgcttgattatcagcccgatttttgatgcgtttatcaatgatatattttcctgccagcatcaagcctaatccgatgaatgcacccggtggcaggatggctaacaggaatggagagtccatatgcataatttcaaggcgtaatgattttgcccaacttcctaataacagatcggcaccatcaaaaatggtgccatttcctaaaatttctcgtatggctcctagtacgaatagggaaaaggttgcgccgagccccattgcaaggccatcaattgtggaattgtagatcgaattttttgatgcgtaagcttcagcacggccaatgacgatacagttagtcacgatcaaagggataaatattcccaatgattcatataatccgaaggcgaatgcattgattaacatctggacggcactgacgacagaggcaatgatcatcacataaataggaatgcggatttcatggggaacccagtgtcgtaaggcagacaccgcaacattggtacttaatagaaccaatgttgtcgccaatcccagccccagagcattggtggcagtagaagagacggccagcaaaggacaaagccccaatagctggactaatgcggagttgtttttccataacccttgagaaagtagttttttggtttcactcattattcagttccacaagttggtagtgaagaaagttgtgcgggaatggttttcagatagagggttgtccgtttagctgcatttatgacggcacggggcgtgatggttgctcctgtaaattggtcaaattccccgccgtcttttttgacagcccaatgagggtcgttgtctgaaatgacttttttgtcagaaagagaatagatccaattggaaatacgtgtgtcaattttatcgcctaagcccggtgtttcatgatgttcagttacacgaacaccgaatacattgcctgaaaaatcagcacctaccaataattggattgcacctgaatagccatctggtgcggtactttctatcgcagccgcaacaggagagccatttttacgggcgagataaagtctatggggttgtttgttgcccaatgcatcagctgttaccacatagcattcatcttgcatattgttgttatacagtgtgggagggacaacttgatcgagcagtatcttgtgttgtagtgcagcttgctcggcaatccgatcttttgtcaaagaatagacaatagcagtcagccctgtagtgcaggccgcaaaaattgcgagggtaatcccgtgacgtcgcatggtttctaacatggaatccccttatttatggccgtacgcacgaggttgggtgtaatggtcgatcagtggcacgcagatatttgccaataagacggcaaatgctatggcatctggataaccaccatatacacgaataacccaaatcaacataccaataatagcaccgtaaattagccggccttttgatgtggttgatgcactaaccggatcggttgcgataaaaaatgcgcccaacatagttgcaccggaaaaaatctggagcaaaggtggtgaatagcgggttgggtcgataagccaactgagtaaagcacaggtgcacagcgctaaaataaatgcggtagggatctgccagctaataacttttctgttcagcataatcagccccccaaccaggtaagcaacattgacccattgccagccaataccgaccaaagtgccttgtaacattggttgctgtaatacttcatcaatattgtgggtcaatctgccggttttaaagctgtccaaaggtgtggcttgactgagcccatcgataccttgttgcagatgaatcaaagtagaaccatcaggcgtatgccctgtaaagatcaccatcaggcaatcccaaggggtcaacgtgagtgcctgaaaggacactggtggcagccagcttgtcatctgtacaggaaatgagataagtaaaacgacataacccaccatggcagggttaaatgggttttgtccaagtcccccatacaggtgtttggcgatgataatcgcaaagaatgtgccaagtacgatcagccaccacggtgctaaagggggcaggctaattcctaatagtaatcctgtcactagcgctgagttgtctttgaggaatggagctattacctgttttttcatggaaatggctacagattcagcgagtaaggcggtaataacagccagcaagatctggaatagggttccatagccaaatagataggtttgtaccgcaataccgggtacggcggctaaaactacccacagcatgagctggctggtacttttttgattgtgtgtaaaaggcgaactagcgacttttagctggttattgtcagtttttactggcctgaatttcatcgataaatatcactattctgttggagtttcttgtttttctagcgctgcttttttggctttcacacgagcaatggccgcagcgacggcagctttgcgtggatcaatctcttccggtacagcggtaatatcttcttgctgtggcgtaggttcggactgattttgcgcggcttttttagctttagcgcgagcgatggccgcagcgacggctgccttacgtggatcttgtttatcatccgcgttatttggtgaatctttttgtgacgttgtcaccacttcactttgagtcgcttttttcgcttttactctggctattgcggctgcaagtgcagctttgcggagatcatcactttcagttggtgtggcgggttctgtatttacagttattgttgctggtttctctgcctgacgagtacgcaattgttcttttctggccttacgtgctgcaatagctgcttcattatcaggcaatttcccagcttgaacattgatagcttcacccgcatttttctgtttttccttcactctgctaagagccgcctgtatagcgctttgatctttgctatccacttgaacagccgattttttatggcgttcctctcgagccagtttttcttgttccatacgcgattgtttggcttcaaagcggattttggcttcagccgaacggcgtgtttctgcatctatggcgcgtatttctgctttttcctgacggtagtattgaaccaaaggaatattgcttggacatacgtaagcacaggcaccacactcaatacagtcgaacagatgatgatttttggcttttttatgttcctgcccgcgactgaaccaataaagctgctgaggtaatagccccgccgggcaagcttcaacacataagccacagcggatacaggcctcttcaaccgttttcggttccatttcctgaatggaaggggcaagaatgcagttactgattttgacgacaggtacgtttaaatctggcagggtaaagcccattaatggccctcccataataaccatttgttctgacttggctttgaatcctgcttgttgcagtaggaattgaacgggagtacccagacgcgcccagaagtttccgggtgcagtaacggcttctccagtcagagtcacgatacgttcgattaacggttctccatcgataatagctcgtttgatggccatgactgtgccgacattctgcatgagaacaccaatatcggaggaacgcccgccagatggtacttctttacctgtcaggattttggtaagttgctttgcaccaccagacgggtattttgtgggaataacacgtacaacgatggagtcgtcaccattaagagcggtattcagcgcatcaatcgcttcaggcttattatcttcaataccaatcaacactcgttctggattgagtaagtgcatcaaaatgcgtataccttcaatcacttcgttggcatgttcctgtatcagacgatcatctgctgtgatgtacggttcacactctgctgcattgatgatcaacgtttttaaatcatgccgactaccttgtagttttgacgcggtagggaagcccgcaccacccagaccggcaatacctgcctgttgaatgcgttgcaataaagtgctggtattgagggaagtgtaatccgtggtttgaatacgttcacaccatttatctttaccatctggatacaggcggacacataattctttcagtccggaagggtgagcagtgacacagggttcaattgccgtgatagtccctgacgtagatgcatgaacgggcacggtacggcctgtaccaaccgtcaaaggttggcctttcagtaccttgtcaccaactttaaccagtaattcaccttctgggcctaaatgttgttgcagaggaataattaattcatccggtattggtgcgtagcgtaatggggtacggctggattgcagtttcatttctggtggatggataccaccctcaaaatcccagattttatttttgttaagcaagttgaacagattaaacattagctttaacctcaacaggcttagtaggagaaacaaagattggattaatcggaatatttctgactggaatggaattcaaatcccatttccagtttgatgtagtagtagcgacagggatcattgtgatgcaatctgttggacagggtgcgacacacagatcacagccagtacagagatcttcaactacagtgtgtattgcacggtttgcgccaataatggcatcgaccggacatgcctgaatgcatttggtgcagcctatgcagttctcctcatcaatgaaagccacctttcttgccggattctgaacactgtcatcgccatccagcggctgagggtcaacacccagcaactcggccattttgagcattacctgctctccgcctggagcgcatttgtttatcatctctccattattggtaattgcttctgcatacgggcgacagcccgggtagctacattgcccacattggctctgaggcaacaggttgtcaattttctcaacaataggatcttcttccactttaaaacgacgggcagcaaaacctagaattaagccaaaggctaatcccagcaggctcaacacaccgatagcaatccataatgacatcattagaatttcaccaaaccactaaagcccataaatgcaagggacatcaaccctgcagtaataagccctatcgatgaaccacgaaaaggagcaggaatgttggcaactgccagacgttcacgaatggcggcgaacagtaccatcacaagggaaaaaccgactgcggcgctgaaaccatatatagctgattgcagaaagttatgtgattgattgacgttcagcaacgcgacaccgagaacagcgcagttagttgtgatcaatggcagaaaaattcccaataaccgatagagcgccgggctggtttttcggacgaccaactcggtgaattggacgacaacggcgataacgaggataaaactcagtgtgcgtaaataaactaaatccaatggtacaagaataaaggtgtttatcagccatgaactgatggaggcgagggtcagaacaaatgttgttgccagccccatgccaatggctgtttcgagttttttggaaacgcccataaaaggacataagcccaaaaattttactaaaacaaaattattaactaacactgtgccaataaataaaagaaggtattcagtcattgctatacctgaaaataatatatttgaaagtaaagtactgtttatagtcaatgtaaatgacagagattgccccaccttgcgatgaaacaagcggggcaatgataacaatcgattgtgggggatgttatcgatcttgtgtgaaagtcattttcacccgatgggaacgcttgatataaggaacgaaaacagcggcagctaatagcggccataacagcgaacgaatagccatctcgtcagaaatgggggaaaaggcgaaggtttttatggcaattagaacagagaccatgagccagataataaagattcgcgggaatctttttgaatgaataaaaagcagctttaatacccaaagagtaaaacaccacatcattgcagtggttaatacggatatataccacatagtggtgaagtttccgtctacttggtggatagcttcgtttctgtagatgagcgttattaaatatagcaacagcattaaactggccgcaataagtgtcataatcagataggcggcgggagccaataaccagccgttaatacggtaataatcattggattgatacataaagaatcttcactccatgatgagcgttttgatataggaaaaagatagtaacacaggaactttgattatttgctaattggtgaaaagtggtgatattttctgacctcttgatactcgttagctgtattacaaaaattttgagaggtggttatgagtgattttttaaaagttggcttagtagggtatggttatgcaagcaaaacgttccatgcgccattaattgcaggtacatctaatgttgaattagctgcgatttccagcagtgatacagaaaaagtcagaaaagattggccgactgttactgtagtttcctcgccggaagcattattcagtgatccaaatattgacctgattgtgatcccaacgcccaatgatactcattatccattggcacagaaagcgctagcagccggtaaacatgtcgtagttgataaacctttcaccatcacagtagaagaagcagaagcacttaaggagcaggcggaagaggctaacttgttgctgtctgtcttccataatcgtcgttgggatgccggttttttaacagttaagtcattgattcaagaaaatcgattgggaaaattgaaatattatgaatcccactttgaccgctaccgtccggtggttcgtcagcgctggcgggaagctgcgggagctggtggaggaatttggtacgatctggggcctcatttattggatcaggcggttcaactctttggtaagccacatgctatcaccgtgaatttaggtatgattcgtcctaatgccgaggcggtggattattttcatgctcagttgaattatccagatttgaacgttgtattgcatgcaacaacagtcgcagcggcagagtctccgatttatatactgcatggtatggaaggtagttatgtgaagtatggtttggacacacaagaagagcgcttgaaagcaggggaaagaccaccacggactgattggggatacgatatacgtgatggaagcgtgacaatgtcacaaggagacgatttgataacgcaaattattccgactctaccgggcaattatggagcatattatgcggctatccgtgatgctattgtggctgggaaatccaaccctgtgacggcagacgaggctattttgatcatgaaactgattgaagccggtgaaaaatcggcaaaagagcaacgcacgatccttatcgactgggaatgatagagcaaggggaacaatagtgatgagctggtggcagaagttaagaatcgacccttttctggtaacactaattacagtagtgatcatcgcaacgcttttcccctgtgaaggagaatcgaagaagtggtttcaatatttgacgaccgcggctattgcacttctgtttttcatgcatggagccaaactgtcccgtggtgcgattttagcgggaattgggcactggcggctgcatctggtgattttcttgagtacctttgttttgttcccgatattgggaatggggctgtattttattgtaccggaatggctgtcgccaacggtctatatgggatttctttatctttgcgctttgcctgctactgtgcaatctgctatcgcctttacttcggtagcaaagggcaatgtcgcagcagccatatgcagtgcttcggcttccagtttgttgggggtgtttgtttctccattattggtcggcttgttgattcagactaatgatggtcatactgatacgtggaaagcaataaaagatattatcctgcaactgatggtgccatttattgtcgggcatctatcgcgcccattaattgccagttgggtggaaaaacataaaaaattagtcaactctactgaccgatcttctattttgctggtggtgtatgttgcattcagtgaggcggtggtggagggtatctggcataaaattgatgcttactcgcttatgattattggcgtcgtgtgctgtgttttattgactatgatattgatgattaatgtatacagctcgcgtttgtttgggttcagtaaagaagatgaaattactattgtcttctgtggctctaaaaaaagcctcgccaatggtgtaccgatggctaatgtattgtttcctgctccaatggtaggtgtgatgctgctaccgttgatgatttttcatcagattcaattgatggtttgtgcagtacttgcccggcgttatgcaaggcgtccaaaaaaggcagattaattttctgccttctcaataaagactgctttttagcagtcttctagcgatttgcagccttggttttcagcgcttgtttttctgcttcactgaggaatgcagttttcaacccattaatctgtgcttgtcggatttgttcgggtgataacccagctgcaggagcagcaacgttatattcgtggtgaatttcgatcccttcaaccgctggatcatctgtattgattgatgccagaatgccatgagcaaggaattgtttcagtggatgggttgacagggaatttactgtactggtttgtaggttcgatgtcagacaagattcaataccgatgccgtgttttgccaggtaatccatcaatgcgggatcggtaattgctttcacgccgtgaccaatccgggttgctcccaattcacgaatagcatgccaaatactttctgcaccagcagcttctccagcatgtacactaatgttccaacctgcatcacgtgcttggataaaatgctgctcaaacaaataaccagggaagccaagctcatcaccggccagatccagcgctgtaatgtgttgcttatgagcgagaaggccagacagttcctgagtacaggccttttcgccaaacgttctgcttagaatgccgatcagccggatctgaacatcaagttgctgactggcagagtgaacaccatcaattacggcctcaaccactccttcaacagggagctgatgtttcatcgccatgtagtaaggtgagaaacgcagttctgcataatcaagcccagcattgactgcatcttcaacattttcaatggcaacgcggcggcaggcatctaaatctgcgagtaccgttaccccccaatccagtttttgcaggaagctgataagattgggttcgttttcagtaatctggacatgaggacgcaatgcttccagctcataagccggtaacgggatattatactgacgggcgagttccagaatggtttcaggacgaatgttgccgtcaaggtgacggtgtaaatcggtcaatggaagccgtatatcaatcattttttatccttattatcaaatagatatatacaaaaaagccagtcaacacattgactggcaagaaaatgaaagtactatcgaagtttttgcgatctcgtatatataatcaaacgggtctgtctgccatattaggagccgattaagtgattatcaagcaagaattgatgcaagtcggattttttgtcattcaattcaactttatcactggcatagtggagtttaaggccaatcacgttattgtcatcggtgaggattttaaacgaaacaccttggctggctatcatctgtacttcttgagttgcctcggcttctgcggcttctttcgtttttccatcaagtatttttgcttgggtgatggattctatcaacataggtttgggtatcttaacatccaaagatagctcttgaaggagggtacggatcatttcttccggtcccatggagatcagcgagtctttattttctggtatgtttttcaatgcgagtttgaagtttaccgagctttcgcctttactgtttttccatgtcatcggctcaaggctgaattgcggactattattaaacagcagatgtgcgttttcgataactttattagacaccgaatcggtagatagagcctctgaagttagtgattttgccgtggcatcgttataagcctgactaaatttacggattgattgaccatccagattattcataccgataaccaattgacctgagccaagatccatgttcttgagtttgaggccatcaatgccataagagacattcagattcaggttcttgtccgtttctcctaccttagaagttattttcattcccttgagagagaagctgtcatcactcgttgaactcaaggtgatttcatcaatattataattttgatcaccaagatacaggtcaaatttaccttttttgttatcacccttaaagccaacgcctttaagagtcagttcttcgtgtttggaaggagaactgaaaatcagcctatcgctgttcacattaaatttgaaattacttaaatcacgggcaatttcagcatcgatttttgcacctgaaaagaccagcttattgccatttttcgctgtgtaatcaacaggaataaaatcaatattagtagaaaggctactgctataacctattttggtttccatggtgagcagggatttacctttggtagcttcaaataaggtttttgttactttgctctgttctagctctgaatggatagatgccatttttggaaccagattaaattttttcaggtcagaaatgggtaacgggccatgccctatactggatttgaagataatttcttcatttggtttgatgtccgcatttttcacgccatctttgattttgaggatcaagcggacatcagaactgaatactccacgttgaaaatctttcgtttgcaattcaatagcactttctggaaatgattttgcaagttgagtgtttacagtcttaatgatgttattcaggcggccttcaatttgtttccctgtataccatgatgcgccagtccatactgcacctaacgcaacaataacacctacagctactaacgattttttcatgtggaaattccatcctttttatgcatacaacattatggaagtatgcgttctgtctttaatatcgatatgggtctaaactcattaattagatactttagcaattttcccattaccatgaacagtcaagtttttttctatagcagataagaaaactgattcacctgagaataatctcaattgttgttgctgttcatccgagctgataattatttgaccttcaaagcaaaatagaactgaagcagaatcattttccagtgttattggctgttctgaaacattataaacagaaaagtaaaaatcattgacaggaacagggtaattcagagcatctttttcctgttttgggagagtcagtagagtatctgcgggtttggaaacaaaatccagattagccatcaattcggcaacatcaatatgtttgctggttaagccggcgcgcagaacattgtctgaattagccatgacttctaaggccacaccttcgagataagcgtgaggtgtacgggcatagagaaacatagcttggcctggtttcagttcaactatattaagcagcaggggggtaaataaaccattatcatcgggataaaaggcagccacttttctgatggtatcccaaggttctccctctcgattgttcagcactgatttcaaaacggcgatcgccaaacgtttttgttcgccttgcatagtcagcaactgggaaaagagaaacgatagatgcgattcagtcggattatggataaatgcctgaatatcgggatgtgcagcagaaacatggccaagtaattgagcaatgtctgataaaggccgaaaggcattcattgccttgaacggagtcagggcatacaccaattcaggcttatgattatcatctttgtagttgcgctggggtgaatttaaaggaatacccgctgcattttctcggtcaaatcctgtttctgctgatgatttgtccggatgtacttgaatggaaagtggctgggctgcgcataatactttgaacaagaatggtaaccgctggaattgttcaaacactttttccccaagatattttcctggctcttgggctattagtgcattcaatgcgatgatctcacctgtttcgggatctgtgacctgagaactgcatttcggatgtgcacccatccatagttctgccattggctgattatttggattcttaataccgtagatgtccgtcagggcggttttactaccccagtcataatgttggatctggttggtcattttcagcatggcaagacttcctataataaaaaactaaacttatttatatgacaacaatacaataaacacgattgggtcgcattatggataataactttatggcatgataatagaatgccgactaatttatctgcaaattttgatccggcgtattcaattattctgtgtgctaaggagatagtaatggcagccactcgcattgaaaaagactcaatggggcctattgaagtacctgctgaccaattatggggagcgcaaactcagcgctcactggagcatttccgcatttctcaggaaaaaatgcctgttgcgctgattcatgctcttgcattgactaaacaggctgcggccagtgtcaatatggatctggggcttttgcctaaagaacgtagtgatgcaattattgctgcggcgaaagaggtgctggaaggcaaacacccaacagagttccctcttgctatctggcagactggttcgggaactcaaagcaacatgaatatgaatgaagtgttggcgaaccgtggtagtgagatccttggcggtcagaggggtaatgaacgtctgattcatcccaatgatgatgttaacaaaagccaaagttccaatgacgtttttccaacagccatgcatgttgcagcagttattggattgagtgagcagctactgcctgagttgaaaacattacaaaaaaccctggcagataaagcggcagcatttaaagatatcgtaaaaattggtcgtactcacctgcaagatgcgactcctctgactctgggtcaggaagtttccggttgggcggcaatgttgactcataacctgaaacatattgaagatagtattcctcatgtatgtgaattggctcttggcggtacagcggtaggaacaggtctgaatacgcaccctgaatatgccgttcgcgttgcgaagaaaatttctgaattatctggccaacctttcgttacttccccaaataaatttgaagcactggcaacttgtgatgcattagttcattcacatggagcattgaaaggtttggctgcatctctgatgaaaattgctaatgatgttcgctggttagcttctggccctcgttgtggtattggtgaaatttccattcctgaaaatgagccaggtagctcaattatgccgggtaaagtgaatccgactcagtgcgaagctatgacaatgctgtgtgcacaagtgatgggtaacgatgtggcaattaatattggcggagcatctggtaactttgagctgaacgtattccgtccgatggtgatcgataatttcttgcaatcaattcgcttgttagcggatggtatgcgtagtttcaatgatcattgtgctgttggtattgaacctaaccatgatcgtattactcaattgctgaacgaatctctgatgctggtaacggctttgaatacccatattggttatgataaagccgcagagattgctaaaaaagcacataaagatggtctgacgctgaagcagtcagcgatgcaactgggttatttaaccgatgctgaatttgacgcatgggttcgtccagaagatatggtcggtagcatgaagtaattctgactacccagtgacaaaattaagtcactgacgatataagccggaggagaaatcccccggttttttgctttatatttcccgataaagatgtaagcgtgggataactaattcaagtggtttggctttgggtttatatcggtgtttgatggcgttggcattataatttgataatgtacctatcttcggttttatttcacaatcgtctgtataaaaagcaataattggcaatggacaggcatattgtacctgtttttgcaattctgaataccaaacgcgggtaatgggttgaactttgacaggtcgtttgatttttaatattacgtcatcagataatttcttaatatccgtaatttctaatgcaaccaatgccgcccattgatcgctagagtagggaggaaccgctcgtccagaattataacttttttccaactgttcaagaacttgttgcttggttattttattaatgatgttcttattagcccaaccaaaattgatagagtctggatttacaaggggagtaatagtgcggtaggcattcagggtgattaaaccgcgtagatgatcatggacaaattcaaatctttgttctttgttgacgcctgactctttggtgacgatattttccagttcggctttaagctggttaacttcattgatgacgctcatcgctgttttatattgctggtggctaacagaaaaacataacgcaccaggtaaccgacttgcagctttgctgctgatattggggtggttatggtgtatgaatagcttttggtagaaatgtagtcctaagttgagagcgttatttccctgtaatggattgactgcaatttcagtaatctgctcatgttcttcgcctttttcaatttgaggtaattcaaacacccgcgcatcaatgagcggatagtccattaataacctaacgagttcagccaatttttcttcctgttttttgaagctggacgtaagtgattctattgaaaagtatttattcataaggactctcagcgatagacgatgtggcgtttacaaactatatttagttacaacatacatattagtataacaacaaaaggagcagatcttcaacaaaacatacaaaaaagcctaataaacaacaaaaagaaaaacgtctgttgcgaaacatttcactgttgtgataaaaatcaaaaaggaattactgattttctaaaaagtctcaataaatattcatgtaacacatataagaaaaactgttcactttatatcgttgataaagtgggggcaaacacagcaccagggttgtttaagatgaaaaaattagtcaaaccagtgaattcctttgaaaaagtggttgatacgctattaccgtattctgaattaattgcttctgatttaccgacacaaggtaaattgcttagagttgaaaatgaattcgctaaactttttttattgcagcaggggtatgtaaatatacgaagggtagatgatggtttaatcattgcaacggttttttcaccttatattatagggttatctttttactctggctctgatgtctattattctattgaacttggacctcattgcaggctatatcaactccctcgtattaatgcttttaatgctataaaaaaacatgatctttatagagaatggatgaggataatttcatacaagatggcttttttgtatgcaagagatgtcagtatttttcgtcctggtgccaaagaagttgtgtgcagtctattatcacgacttataactctgcctgctgaatttcacgaaaacacatctgtcatcaaatatatagaacaaagatgtacgctttcacgcagctgtatacaacgtgtattatcatcgttaaaaagagaaaattatattgagatggttgatgggcatttagtaaaaattaactcattaccgattcattcttattattaaagtgaaagggtaaaacaatttaatgaagttagactttatctggtgaaaaattgccggaatatatttatggataccggcaattttattttatcatttttcaagttttttgagttttaaacctaaatacagtgcaatggttgttagtaatgacataaatatggctacaccattccattgaaaatacagccagaatacaccacctaatgttccagcaacgctggagcctgcgtaataacagaataaataaagagacgatgcctgagctttagcccgcttagctcgccatccgacccatccactagcaaccgaatgagcagcgaaaaaccctgtagttagcaccatcatgccaagcataactgtccaaatagaagaacatatcgtaatgaaaccaccaatcaacatcatactgatcgcaaccagcagcacctttccacgtccatatttatttgtcaaaataccggcttttgtcgcactgtaagtgccggttaagtagactatcgacaataatccaataatagtttgattataatggtaaggtgcacccaatagccgataaccaatgtagttaaacatagtgacaaagcagcccattaataagaaagcttcagcaaacaataaaggtaggccttgatcacgaaaatgcaattttagattgataaacaaggtcttgggttttaatgaacttgatctgaaatttttagagggtggtaacattttccaaaatgcaatagctgaaattagtgcaaatgaacccaataaaatgacagcgaaccgccaaggaaaataatccgcaatcacacctgtaatcaaacgcccactcattcctcccaatgaatttccactgacgtaaagcccgatagacaacgcaacataactgggatgaatctcttcgcttaaataggtcattgcaacagcggcaacaccacttaatgacaacccaattagtgcacggacaaccaaaagcccattccagcttgtcactactgtactcaagagtgtaaaaatggcagcagtagccaatgacattaccatgacatttttacggccaagagcatctgataaaggaccggttatcaataagccaagagataacataccggtggatagagatagcgctaagctgctgcttgctggggaaacattaaattcctctgataagatgggcaatataggctgaacaaagtaaagtaacgcgaatgttgctagtcctacggcaaagaaggatagggtaacacgaagatatacggcatcatctcgttgaatatagcgttgttctttttcacgtcgttgattgattttaacatcactttcaacgtcaggaactgctgattcttcactgacgcttggggctgtattcacgttacttccttaatttatgtaaaaatgctagcgatttgattttgatcaagaataggaattcatgaatattttgtctaatatattaatcatcatgaatgatatgtttaaagtattaatatggtgataagtgatgagtataaacattgaattaaggcacttacgttattttattgctgttgcggaagaattgcattttgggcgtgcagcggaacgattaaacatctcacaaccgccattaagccaacaaattcacgctcttgaaacaaggatcaaggcacagttactggcgcgtaataaccgcaatgtcagtcttactcccgctggaaacatgtttcttaaggaggcataccagatacttacccaagtagatgcagcagcaactaaagccgccagaatgcagcaaggtgaactgggagaaatatctatcggctttacatccaccacacccttcatgcgtaaggttactcttagtttacgtcaattccgtgaacattattctgacgtagccattcatatgcatcaaatgaacactaaacagcaaatagcacctttgcagacaggtagaattgatatcgggattatgcggaatacgttattgcctgatagcttagagcatcgattacttttcagcgaacgctttatgctagcggtatatgatgggcatcccctgctgaattatgctgacgaaggtatcagtttggaaatgttatctggctatccactcgtattttttgagcgtgatgtaggaacagccttgtatgatgaaattatttctctgctagccaatgctggagtcactcctatgatttcacaggaagcgggggaagcaatgacaatacttggattagttgctgcggggttagggatcagtataataacggaatcatttacccggatgaagatcgatggtgttcaatatctccatttagcaaatgcacctgcctgctccgaagtctggttggtcaatcacaagaatcgacagaatagcgcagcagtagaccgattaaccaatctcttaatttcaaacattgttgatgaaatttgttaattaatcgtaataatcacgagaagttcgtgtgaacgatcacatttctattgtaaacggatatcttctaatttaaacagggacataatcgttactcattatttagagtcacaaattaaataacgggaggtgaagtgagtgtcgatattcagccgagacacattgaccagattaaacagaccaatattggtctggtttatcggttaattgatcaatatgggccaatctcacgtatcgcactttctaaaaaatctcaactggctcccgcaagtattacaaagattacacgggaactgattgatgctcatctgataaaagaagcagaatttcccgatctgagttttcgaggacgtcccgctgtagggttgaaaatcgatagtaaagggtggcaattcctgtgcatacgcattaacaaaggaagtgttgtctttggtcttcgtgacttaagtaataacttgagaattgaagaagaacgaccgttctcattttcccttaatcaatcttttctggattgtatcgttgatgaaattgatgatttcttctttcgacatcaatcttgtcttgaacgcctgacggccattagtattaccaccaatgcgattatcgatcccaacagtgggattattcacagttcaccgtattatgatattcaaaatatcccacttggcacattcttgcatcagcgtactgggttaccgacgtttctgcaacatagcataaccgcatggacaatcgcggaatctttatatggtgcgggtgaaaactgccagaacattatccagatcgtcattgacgataatgtaggggcaggggttattacagcggggcagatgcttcatgccggaaaccatagcgttgtggaaatagggcatactcaagtcgatcctgatggtgaacgttgttattgtggtaatacaggttgtctggaaaccgttgtcggaataaaaaacatcttggtgaaagttcatcgcctggcagaaaaccatcctgactcactactttattcaatatcaccattgacaattgattcactttgtcaagcggcgaatcaaggcgatcttctggcaacaaacatcattcatgatgtcggagaacgaatcgggcgcatcatggctattatggttaatatattcaacccagagaaaatcttgatcggttccccactaaatggtgcacagaacattctctatcctgccattcaacaacagatagcccaactttctctccctggctatagccaacaggttaatattgttgccacccaatttgacaataccgggacactgccagcggcatcattgattaaacaatctctatatagtggtgagttactgatcgaactcatgcaaggatagagcacatcaggcaaaacattgcgctaacgcaatccctatctcaaacacatatcctaaactttaagtctgctcgctaaagagcaaccggtcttctgtcattatggaaaaatgaatttatgttaacgcgcttatttgttacaggcacggataccaacattggtaaaacagttgttacccgtgcattactacaagtatttaatcgtgaaggaacaaccgccgtgggatataaacccatcgcgacagagaaacaagaaacaccggagggaatacgtaatcatgatgccttagtcatacataaatcttcaccggttcaagtctcttatgaagagattaatcctattatttgggaaagcaattatgaagaagggaaccagattaattttgttcaaatgacaaaaagcctgaaaaatttaagccaaaaagccgatcgtgtgattatcgaaggtaatggtggctggcgtttattgctacaagatgactcattctactcagactgggtggtacaagaaaagctgcctgttattttagtcgtagggattcaggcgggatgcgtcagtcatgccatcctgaccgcccaatctattatcaatgatggtgtcccactgattggctggatagctaaccgtattaaccctgggcttgcgcactatgccaagacactggataggttacggtatcatataccggcaccacaacttggcgaaattccttatcttttgaggcctgaagaaagagatttatcttgctatttggatgtttcagcaatattcaagtttgataactaatcattagaaaaggggagccagacatgctccccagtttaattttaataatttctcatttttgagcttcttttgcatcgctagtagcgtgagaacctgtagtgtgggaaagacggatatagacgattttctgttttccataatcacagctaccgacaactttcccagagccttctacaacttgatcattaggaacaacttcaagcctaaaatcttctttagagacatgattatcaatgatcttttgcgaaattatttctctcaggctttcacatgttgtcttttgtgaggcttgtactgcaaagggagcaagcgcaaaaaacaaggcaccagtcagtaggatctttttcaccatcatctccttatttattgatgtcggtgtttggtctatcaaggtttgatcggaagacctgtattgagatccagacaacgttttgtattgggttcccaataagcattcacgttggtacttttcaaacaggcatctcgattatcaacgtccacctcatacttatcaaactgtttttcttcacgtttgttaatttttttgcgaaggcttccctgttcattccattcttctttttgttgacgagccatttctttgctcatcgaattctcaccgcccccattaatggttacgcaagtactactcgatgtacaaggcgcagaaaatgctggagtttgccacaataatggcaacaacagagcaaccgcagaaacagtcttagctatcaaagaattatggacattcatatttaaacctctgtcacaaaactatcaattaaagttaccccagaataatagtgtattttgaacacaacttgtatttgggataaaaataacacttataaagttaacagttcatcaaaagacaattacgaatttctatgcacacttaagcctgcaaatgactggcaaactggcatcatttccaatgtattaatattgacgcgagaaggcagggttgcaacccaaaaaacggcctctgcgatatcatcaggagtgagagcctcagcaccgtcgtaagttttgctgactttttcatcattacctttaaagcgtacttgagaaaactctgttccgccaacaagcccaggctcaatatctgtcactctaatattcttgccttgtaaatcagcccgtaatcctaaactgaactgcttaacaaatgctttagtcgcaccgtatacattaccaccggcatatggccagtttgctgctgtagaaccaatattgataacgtgtccatgattgatttgtaccatattaggcagcagggcgcgtgtcatgttcaccaaccctttagtattggtatcaatcattgtttcccaatcatctgggtttgctttatgagcaggttctagtcctaatgctaaccccgcattattaactaacacatcaacatttcgaagtacatcaggcagttcctgtacaactttctctattgcgttacgatctctcacatcaagttgaatggggtggaaattttcgcctaattcggtttttaacctgtccaatcgatcctgcctgcgtcccgtagcaatgactacagaaccgtgtttaatgaatctccgcacaatagcttcaccaaaaccggaagtggctcctgtcacaaaaacaatcatagtcatcctcttcgttaccaattgttaccattaatttcatatcagtagaaaaagttcttcgtcattagtcaatgagtgaattctttatccactattaacattttgtttttttagtgtcagattaacaatgacaaaaatcctgaaactctgcaactatagaggaatcactatcatgccattgaaactctacattggttcgcacaatctatattatgttaaataagttatatcgatcaaatttcacctatcttatcagaggaatttaatatctccccagcaagcagcagcttggctgctatctcttgttgtgacactgatacagaacgagaatcgctggttttattcttgaattgaaactgtacataaacaattactatgtgttgtctattggaatgccaatagattttgattgaacaggtttaatcttcgaaaagtaataccttatccatagcgaaataaataccagaataataaaaaagactggtacagatagagtaagttccttaaaaataaacctgctcatatttatccccgatacttcccaggataaaaataatgctaaagggcatgttaaaaaacctgagataaacccaataccaatcagatggtaaagttttcttttgttcattttttgaacgcttagatccaattttttctgatatcgccagtacttcatggtgaggtacaataatcctaataacgaactgagatgctgtagtattttatatatacttatcccctgcccgttggtaatggaatgaaaaacgcggaactgtagtagaggaattagctcgacaaaaaaacctttatcatgtgtgaatgcatcccagccaatatgagttacagctcctataaataacgacaacacaaaagcaactctgtccttatagtctggtttttcataacgagcaaaggatattggaaaaaggacggataaaggatatgacaatagacgtacaatcaaaaatatcaataaacataaaggaaatgcggtataaaaccatccgggtaagtgatgcgcaaccgttgcaacatcatataacccaacagagtaaaagaaatcaggagacaaactgccagtaattagcgcaggcaaatttaacaacctcccccccggaaaactcttcaaaggaaaaacggctgctggatgtgaaaatgtccatggcattacgaaaaatcctaaaaaaatgttaaagtctgcgatagggaatataccacggatgaataaggatagtttcctccttattaaatgtatgatctcagacctgagctgatgagatggacgtattgcatgacgtcggctgtccaaaagttatgaagttggattaaaacaacaaaaaggaaccgatatgtatgactatatgatccagaatttttgccatcttcctgacgagatactttcaccactggatttactgagatatgcgtaaaaacgatcattttagtggaattattgcctttgtgatgacagcacaattaggcagttttactgctgcggctgaacgacttggactgacgaaatctgcggttggaaaaagtctaaatcgccttgaagaacgattggggcttaagctttttcagcgttctacaagaagcttgagtctaactcctgaaggtgatatttttctgcaaagttgccaaaatgcgatagcgattttagaacaagccgaagcggggatagcttctcatatcacttcaccaataggtcgattacgtattgatctccctgctgcttttggacgccaacgcattcttcctatcttgttaaatatcactaaggaataccctgaactcacattgtcagtctcttttagcgagcggtttgttgatgtgattgaggacggtatcgatttagtgatccgtattggtgaattagcagatagtagtggtttgattgctagacgcctcacgacccaaaaattagtaatttgcgctactccagactatttacaacgtcgaggaatacctacaagttctgatgaactaaatcaacatcattgtattgtcgggtttcggcgtcatcagcccttccactggtgtttaagaataacgaatagtaataacaaaaatattacgcctccacctacttacgaattggcggatggtgatgcaatgcttactgctgtgttagcgggttgtggattggcacaattgccactatggatggtgaatcgatacctaaaaagtggtgaattaaaaactgttttacctgaatattcgggggctgaagtaccaatcagcgccatttggccaaaaaaccgtcatctgctgccgaagatacgttacgttatgttgtcgatactcttgttgcagcagcagaaaaaggtttattggatgaataataatgaattattaaataatcgttttatctgaggtttggttggctaccgttgcacgattttttatgtaaatactgaagaaagaaaatattaaaaacagaattcccgtcagtacaattgaatgtacaccgtagtgtgatataacaaatccaccagccattgcgcctaaggttattcctaaattagaaaaagcgatatataggctgttggcaaactcaggcgcttcacttgcttcatgcattaaccatgtttgactgacgattaaccccgatgagtgaaaaataccccaaaatataatcaatagtaccattacaaaaggtgaaaaacccaatagccacactaataaatagaccaaaataaataaaaatgtataagcataggtagttctaactgtgtttttttgtaatagacggctaaagataaaattacccatataaccactagcaccaaataaaataaggaaaatagcaatcatactattactgagataggttacttttgtaagataatcagaaatatagctaaaactagaaaacatagctaaaactagaaaacatagctgaaaaaataaaagtaacagttgcaatgcttatccataactttgtttttttcaatacagttacttgttcaagtatattaatttgttggttaacaggtaatgacggaataaaataaacaacacctataaatgcaattaaacatgtcacagaaccaaaataaaaggccgcactgagtgaaatatattcagcaataaaagaacttaaaggcattcctagtaccatcccaagtgcaaccccggaaaacacagtcgctaccgcatcagcgctcttctctttaggtactgagtttgctgctataaccagtgctattgaaaaaaatagggcatgagttaatgcaggtaagatccgaaaaatcagtattatattaaatgtattttccgtggcgtaaataatgttagatgcaataaagataaataaaatgcataataaaacatactttctattatatcttaataagagtaaagtaataacagggccggcaatcgcaacgacaattgcatacacactcaccaaataaccaacttgaatgggagttatatttaactgacgttctaattgcggaagtaaccctataacagaaacttccgttgtaataactccaaaaacggcaatcgttaaagtcattaataagaaaaatgatttatttgtcatgatcgtatccgcacgatagaaaaactgtcgtgattaatgagatgttatctacaataagatttgtactaataaattattaaaaataatgtcttatgcagtacagtaagaaagtttgcagataatgacaagatttttttcaaaagagaagcctactttcgtctactgtttgtagaaaaaaagttgtcagttagcccagttatcgttccgatattcgggctaactttcatttgaattactgtcagtctacaaatacgagtacatttcaacctcacttaagactatctctgccgctcaaggcactagaggcggctgatttgcaacagctcgctgaactgcttaatgagttagagctggtctgataaatcgcgttgctgtcgctaataatataacggcgacttcactggagttatccagcggagtcgttataagatgagtaattatctgtgggtgttttaattcttctttctaactcttttgatcagaaaaaaccatgagatagtaattccctgctagcccatctgagcttttagctttcttgataaaaccgttgaattcgtagaaattaatcgctttatggtttttaaccaaacattttaaacttaattggtgtggatatttggatttgacgaaatccagtagttgagtgcctatgccacaccgatgatattcggtagaaacataaagatgatggataaaatgattctgtgcccaaacagagataaaacctagaatcttaccgttttctacggcaatataaatcatctcaccttcagtatctttatcgaaatcagtaagttgatagttatccgtattcagccaagtaaaagtgacctttcttgattccaagtaaagaattctcagtgcctcaatatattcagggaaaaacacggttatttccatcagttatagcacctcaattaccccaaactcgataacaacaacttccatatctggagaaaacgttccttctcgctcaaaagaacacttatgctccatccgccaacgatgtagacttctatcaccctcgccctccttccaagccagttcggttgtcattgctgaaaattgggttaaatgaacagcagttactctaacaacacaaaccggaaggtttttaccatttaagacaatatactcattgccaatttcgatctcttcattaacctgtttataagcatgatatgaacaactcgttgctgttttagtgcctttggcaactaaggcagaaagcttgtcatacatttcgattgagtcaccaaatacccaactttcagcagcaggatatttattttcaattacttccatgagttgatgaattttcatattatctattgagcattatgggttcgtgaataacccactttattaacataacaatgctgctgttaaccaccacttctaaccaactctatgatcttcctcttattctaagtatagaaaaatatgagcggtgtttttcaccgctcataagtcaaattttactgagtaagaccgttgatcaccaaccaactcgtatccagttcacacaaccccattaaccgtcaaaaatgttttaacaaaaccggaagaaatgcagtaagattgacacccaatcgtgggaattgacatggatcattagcttgttatcgctttttcgtctatcacaacgccgaatacctgctttgatcgcctcactggcgattttgatgttgttcattggaccagtggtatcaaaaactctggagcatcggcgtgacagcataaaaagcgaagcccaccacaacatgccaatgtctggcatgcaaaatagcaataatcatcattacgcatcatcggtaaatggtcatgatatgcatcatggcgcttcccatacccatacggggttgatggatgatattgcctgtggttattgtcagcttctgattaacctgccattgctgacgtgggtgtttattccgtttatctggctggcactgactatctcccgcacccctccagtccggttttttttgggttctgctattcagctgttttatggcgaatcgcaaccgcgcgccccaccccttaattaatctatttaattgaaataattcatttattttccttgctatacgctgtttgtaaggcaagtcaatattttttcaagcaaatttaaaaacaggatttgtttttaattaagggatatttttttatgtctactacacaattatttcgcgtatcacctctgacagccgctttagctgtcattctctttatgcctgccagtagcttggctgcaacaggtgaagataacaacgacaaagagataaaagacacacagacagttaatgatagagaatctgtgataattgtgaccgctccggcaatttcaccactcactatagctacctcacccaaaacacctcgtcagcctgtacccgctagcgatggttcggattacctgaaaactattcctggtttttcccaaattcgtaacggtggtactaatggtgacccagtatttcgtggcatgtttggctcgcgcctccgtatgttggttgatgatggtgaaatattgggttcttgtccgtcacgtatggatgcaccaagctcctacatttcacctgaaagttatgatgttctgagtctggttaaagggcctcaaactgtactttggggtgcaggaaactccgcaggaacggttcgttttgaacgcacccgtcctcagttcgacaaactgggtgctcaaggtaatatcagtacggtagcggcttccaatgggcgttgggatggtaatgctgacctcagttttggtaatgaactcggctatgtgcgtttgagcggtaataaatcacgctctaacgattataaagatggtgatagtaatcgcgtaccttctcgctgggataaatggaataccgacatcgcagtcggctggacgccggatgatgatactttgctggagttaacagctggtcagggtgatggaaaagcacgttatgctggacgtagtatggatggctccaaattcaaacgggaaagttttggtgtgcgttttgaaaagtccaacatcagtgacgtgttcgacaagtttgaaaccaatttttattacaattacaccaaccatattatggacaactattccctgcgtaccccttccccaatgagtatgggaggacatggtagccatggtggtggaaaacatggtggacatggaatgggtgccatggaactggatcgccgtactatgggcggccgtatgatggggacttggatttgggaagattttaagttacagagcggtgtagatactcagtccaatacccatcgaaacaaatatgacactgtttgggtgaaagatgctcgctaccgtaattatggtattttcagtgagttaacttgggacgccactgaacagagtaaagctatcggtggtgctcgcctggatagagtactcgtggataattacgttaaggcagcagaacggacagccactctaccttctggcttcattcggctagaacataatctgacggaagtaccgttgatgttttatgctggcgtgggttataccgaacgttttcctgattattgggaactgttctcatcaaaatcagggaataacgtcttcagagatttgaaaaccgagaaaaccactcagttggatatcggggcgcaatatcatggccaatattttagtggttgggtatctgcttacgtaggtaaagttaatgactttatcctgttccgctattccccaacagataggacaaaaaataaggcgaataatgtagatgccactattatgggtggagaaatgggtgccagctatcagttgagcgaccattggaaaaccgacgcaagtctggcttattcttgggcgaagaatacttccgatcatcgcccattgccacaaactccaccattagaagcgcgatttggactgacttgggagcatggagactggacaagtagcggtttgcttcgtgttgttagcagtcaaaaccgagtgtcaatcaatgaaggcaacgttgtcggtaaggattttgatcgtagtgccggatttgctatcctgtctgcaaacaccacctataaagtgactaaaaatgttcaggttagcgccggtattgacaacatttttgacagaacttacagcgagcaccttaacttagccggaagtaacaattttggttattctggcaatacgccagtaaacgagccgggtcgtacttattgggctagagtgaacgttaaattctaaacctacttttcgccctgacacattagtcagggcgaattttccgtctttattaagtgcctttcattaaagatatattttattgaatctacttttatatctttaaaataagatacttttttctatcttcatttctcggaaacatttcaagtcgcagattcattggtgagtaaccaatggcgtaacaatatggtaatctgctcttgttcttcttccgtcaatggctggagaatagctctttcgttctccaaatggctttcgacagcattatctataagtgtttttccttcaggagtcagaaaaactttgcagctacgtcggtcttcttcattggcgatacgctcaattagccctcgctgtaccatatgttcaatacgggtactcattgcaccggaagtcagcataactgattgatacatctcagttggtgtaattggcgtgttataacggcgaagtgtagcgagaatatcaaactcaatggcactcaaaccatgcgctttaaaggcatgttgcagacgctgttcaatgattttgtttacacggactaacctcccaatcacacccatcggtgaaggatcgaggtctggacgctgctgttcccactgtattagcaaacggtcaacgtgatcgtacttcattctttttccctattaatttattccaacaaaaagatacttgataaaaatcgtttaggctattattttaatttacctttaaataaagatactttatattgagttaaaatcctcaaaaaaggaaattttcatgcaggaaacgagaatacacagtaatattttgcttaccgcactagcgcccatcgtatggggcagcacctatattgtcgccactgaaataataccgcccaacatgcccctgttggcttctaccgtcagagcgttgcctgctggcatattattattgttgatttgccgcaccgtgccaaaaggaatgtggtggctgcgtcttaccgttctggggttacttaacattggcgcttttttctatttccttttcgttgcagcggggtatcttcccggaggtatggcgtcgttaattatgtcttgtcagcctgtgattgttatattcctaagtgcttatttattaagaacatcactgacaagaaaacattttttttcggcaatactggggcttattggaatcacattactagtaatgaattcagccaccagcctgaactggcagggcattatcgcagggtttgctggttgtagctgtatggcattggggattgttctgaccaagtattggaaccgccctgttaatctatcattactgagttttacgggctggcaattaacactgggtggattgatgttactaccaatcgcaatttacacagaaggtgtgccacaacagctcacaccaactaatatcatcggctatggttatttgtgtctgattggtgctgttttagcatacatcatttggtttcgtggcattgaaaaacttcccgttgtaagcatttcattcttgggatttctgagtccattatcagcctgcgttctgggatttgtttttctgaaacaaacattttccttgctacaatttttcggagcctgcaccatcattgtttctgtctggctttctattccccggaatcagacacaaaaatccaataactctacaatctaataaaatagtaaaaaggatgaaaagaatcatcaatgaaacttacccttatctctggtagtcaacgtccggattctcgtagtcaacgtgttgcatcatacttgcaagaattaagtcgtgaatatggatttactgatatatatctccttgacctgtctaatgtagagcttccatttcacgatggttacacaacggatatatcagcagaatcgcatccttggcaggctttcgctccgaatctaagagaaagtgatgcatttatttttattactccagaatggcacggtatggcaacgccggcactgaaaaatttcctgttgtattgctcagtgacagaactgggtcataaacctgcgctattggccagtgtttccgccagcatgaacggtgtttatcctcttagcgaattacgcatgacaggctttaagaacaatcacgtctgttttctgcctgatcatttaattttccgccaaagtgaagacctgatttcgacagatttggcttgtggtaatgctgaatttgaagcacgtgcgaaatatacgctgaaactattgaaggcttatgctgaagctttgaagcaagtacgcgaagtcattggagaagaaagcaaaaattacccttatggtatgtaaaacagataaaaacaacaacttgcactgatggataaacctcggctcaactatctgagccgagaataaaactgaatggacatgacatttttctatcttccttcatgtttttgatgccgaaaaacataataactgtataaaaacacagtacaccgtatttttggcatttttgtttaaaaaacagactttcttggatttaaaaatagccataagtatcaaaaattcagcatttaaatagatgctagggtttcctaccctagagtgctttaacttaatgtaaatggaaaagccattccttttgaatatacgtcaatggttattgatttagaaaagcatctgcgtttaattatttatgcagaaatctgagagaaaattccccctcaactgggaaaaaacaacatccacagtgatatgtaaagtacagagttacgggatattctgagcagtgttatgacataatttttttacaattgttttaaagtttttttaaaaaaataataaaattaattattgtttaagctaatttttcttttttaaaacaaatatcgtgaaaggagaaatagtaaattgtgggatggttagaattgattgttggtaaagagaaaatcccatctcctccgaaagagttattaatttgctaaaagaccaaaatgtatcattaaaagtaaactgttcccctgattttgtccgcatgctgacaggtagtgcctctccatcatggtaaattttaccctcttctcctgttttgaatgtcccgaagtctactcctatcgcattcaagttaaaactaaaaacgatatagtaaccatgttcaataagagcatcattgacttggcgtagcagtaacttaattgaatcttcggtatttagagtgcaaagcaaaaaagaacttatgacagcgtcgaatttactattattattaatataatttggtagttcgcttgcgtaaataaacgtagctccgctatttttatgcttttctcttgcattttctaaagcgtgttctgaaatatcagcaccaactacctgagaggcgatagatgtaagaaaaggaatcagttcgcctgaaccacaaccgagatctaatactttatttattgaacgatgttgtttaatgaaattagaaatagcagtaaatccatattgctcctcaaggatattatcgtactgtgagaataatttaaatatatctttttctttccactgactcataaactcacctcaagaattattaataagatacataattatcgcacctacaactataagtaaaattccaaagtgtgactatgttatttttgtaactaaactgttataaaaaagttaataagcttcttgcatttcgggtttaattattatgctatagcggatgtgggcgaaggataggtattgctattgctgggaatgggcagcggcatcttagtcagaatgatcagaaattggcaccgccttctctataaatttatctcacttttcttataaaaactttctgaagagcagtatgaaagacagcgaactgaaagtcactactttccgaaaaatggaagcacttttatgaaaaaaaacaatcagttacggcctatttttttagggataacattgttattttggcaattacctactggttcggtaattgctgccactgaatatcacgaacagggtaaaaaaggtgtacctgatagttggttgtcagatgaattcaaaaatcaatggggattggcctctatcggtgcccattatgcctatgccagaggttatacgggtaaaggcattaatgttggtgtattagatcagtcagttaccaaccattctgagtttgctgacaaactaaagataatcgctccatccgacatttggagctatagttatgatccctacagcgatctgatcagctttggtgcacatggcaatcatgtgtcaggaaccattgcggcgaacagagatggcaaagaaatgcacggagtagcatttgatgctggcttggtcaccgcaaagtttctgcaaaatgattacaaccgcacagaagctatgattcaaagcgatgctcgcatcattaataacagttggggagttcgtccgcgctattttgtgggtagagacggtaaacctatccgatggcctgatggaactatcgcttactatccagttacactgaaacaactaattaattatgtctcgccaattaaagaaaaactaaacgagttaagccgctccccgctccctgtgacaggggaaccgttagccagtgatgccggcatgttacgtgctgctcgccaaggaaaattaatggttttcgctgcgggtaacgcgaataattataacgtgacttggttacacgcggggatgccttatttcttccccgacgcactgaaaaactaccttagtgtcaccaacctaaaagaaaacgatgtgattgcaccgtcgtcaactagctgtggatataccgccagttattgcctggctgcaccaggcaccaagatttacagtagcactggcgattttgtctcgaagagtggtggcaaaattgatgaggacgctttaaagaaaggcgagctggagattgatcctacctatgattcttacacaggtacgtcaatggccgcgccgcatgtggcaggagccgccgcagttctgatgcaacgtttcccttatatgactgcggcgcaaattgccgatgttatcaaaactaccgcgactgatttggggacgccgggtcttgatgatttatatggttggggaaaactgaatctgaaagatgctatcaatggccccaaaatgtttattactaagcaggatattcccgctaaatattacattgaaggttcgtataccgaaacacagtttatcgctaatattgctggcatcggtagtctgattgagccaggcaccaccgtacaacgagtatgtaacagtattgagtgtgcctacgactattggagcaatgatatcagtggtcatggtggcctgactaaaactggcagtggtgcgctcctacttaccggagccagtacttattctggtccaacatgggtgaatcaagggctgttattggtaaacggttcgataacctccgacgtgacagtgcaacgcgatgcaaccttgagcggaaaaggcacgattggctcactcactgcttacaatggagctaacgttgcaccgggtaatactgacgctgctctgaatgttgatcgcgaagtcatttttgaaacaggctcccgctatcaggtgacactaatgctggatggtaatagtgatcgtatcctgagtaatgatatggcagggttggaaggtggtgaagtgcaagtaactttggaaaaccggggtaacttgctgtcgcagcaaaaggtacacagtttgcttggccagcaatacaatattttgcaagcgagaaatggcatctatggtcaatttgacaccgtatcacaggggcatctgttccttgatatcccgctcaactatcaatctgatcgagcgttgctggatataaaacgcaacacaaccgagtttgccagcctggccacaacggctaatggacgttcagttgccaaagcggctgatatgttgaattcagaccatcctgttcatgaaagtattctgatggtaaattcagccgcacaggccagtcaggcattcagccaactttcaggacaggttcatgctgatattgctgctgcacagatcaatagcagccgctatctgcgcgatacattgaatactcgtttgcgtcaggccaatggcggtgccacttctcaggaaatcaaagcggatacagatggtgcctgggtacagataatgggtaactggcagcgcgccagcggcaacaatgaagtcagcggttatcggatgtccaactacggcgtgttgttgggtgtagataaagacttgtccagcgactggcggcttggtgtggctaccggctacactcgttcttctctacatgggggcgataatgcgtcagcacgcagtgataactatcacttggctttatatggcagcaaacagattgatgctctggcattacgtgctggtgtagcctacagttggcatcgttttgacaccgagcgctcagttgcttttggtgatcagtccgacgatctgaaagctaaatacggtgcacgtactggacaattatttaccgaggcgggttatggtatcaaaacctcttggctgaatttggaaccgttcgctaacctaacttatgttaacttccacagcaatcgtattaatgaacaaggcggagccgctgcactacacggcgacaaaaaatcgcagaatgctaccttctctacactgggtctgcgtgccgaccaaaaatggaaaatcgaacgcgaatcccaaagagaattgcatgtgggtgtatatggtgaactgggctggcaacatcggtttggtaacattaatcgtggtactaagttaggcttcagcaatagtaatacgatgtttaccgtcaacagtgtttcggcggggcgtgatgcagcagtggtgaaagcaggtactgaattagatatcggcaaaaataccacgctggcactgggatataatggcgttttatcaggcagtcataaagataatggtgtgtttttgaatgctaattggagattctgatcagtaaaaattgcctgagtatattctcaataaaaaattcactgctggcaagctggcagtgagtttttttcatccctgaatagggaaatgcatctaggcaccaacgtcattgatcttggttatgaactcttattcttacaccatgaaataaaaagattcagtgtccctccacaaaaaataccatcaagaaggccgcttaatagcccgaagaataaattataatgtaatgagtgtagcaatattgggtaaatacttaataaagcagtcataataaacttacttacaaaagtaattatgatcactatcaatgtcaaaggcgtacctgggcgaataattaagttgctgtgagttttttttcttaatcgtggctgtgatctccatagtatccaaccaatagtagtaccgaaaatcagaccgattcccatcatcaccagtgataaatttgagaagtaggtttccgtgagaacactatgtatcccccagactaaaaatacgctaggcagcaagaaaatgcgccatatgctcatttcacggcttgaaagagctttaattcctcttatgacaagaaatacaagcagaatccagacccatataggtgtgtcttttataatggtgatatattgtggcatgttgtcactcatgagtttttttatatgaaaagtttatcattaaggtgatttttctttctgtaagaattcctcagcaaaaacaatagtacttaaggataataaactggaatgcgactttgatataaaatataacctatgatccccttttatccatcccctacccagctatctaatgtggtaactgtcacatttatttcaccaaggctatacattttccctattttcataaaaggaggccagagtatgccgccacgttttattctgtctgtattggcactcgctgtatttttcattggtacaacggaatttatgttgtctcccatgctcaaaccactggccggtgtatttaaaacaacgcttgataatgttgcttggctcgtatccggttatgctttttcctatgcgcttgcagccccttttttcggctggctttctgatcgtgtaaatcgacgcagattgttactgatatccctgctgtttcttatgtttgatggattggcgttaacatttgcccaaaatttgagtactgctattggattgcgtattttcggcggcatcgcttcagcggcactaatcccaacaacgtttgccttgattgcagaacttttcccactccaaaagcaagcgtcagccatgggtctggttatgcttggcatgacagcgggtattgctggtggcccaatatttgcggggattttaacggaattatttgattggcgggcgccatttctggttaatgctgcggggtgtttgctggtttttgtcttaggcaggacatgtattccaattcaagcacctgttgagagaataaagcaccagatggttacatttaaatcaatgtttcagtgggtgcgtcagaaaaatctaatgatttttcttattgcaaaagggttttggaatggtacagcggtgtctgctttgatattggctggagaggtattacgaaaacactatgagataggaacaggaacgattggtatctcaatttcgacattcggaatcggtcttggtttgggcaatttgtccgtcggaatggtgaaacgtctgggattaagggatgaacttatattgttactggcgatcgtgttactttcctcagcgacgactgcgtttatgctgatgcctttatctctgccctttagcctgagctgtttgattgtatggggaagcgcccttggccttgctgcaccgatcagtaccgttattctggcaaatcgagcgaaacagcataaaggccaagtactggcggtttcagaaagcttgaacaatctgatgattttgcttttgttcccgattgctgcaatgctgatgactcatcatggcattgcagtgaccatgctaatgttaggattcattttaataataagtatcgtgctgacaataagagatcttttgagtgacactgtcacttaatgaaaattgtgaaatcatccactctgccaaggcataagtaaaagaaacgtcattcatttttacgaaaaaattaagtataaaaccactctaaaaaataacccctagctttcgttaagggttattcaatctaatattttttatggattcatatgcgtagtgtgtgcaaaattttgtgactcaactattttgtttattctcgacgaccttattcagtaaggcgtcttgtatccgatacaccacacatctttggactggataaaggtaatttggattgcattatttcctgatgtgttttaactggatcaataaataacttattaatttcatccagttgcagatcagatagatagccagtatcaataccctgataactatccggaattgtggtggtggtaggaaaagaaagtttttcggggtataaacgcccactccagaattcatcacctttctccagaggccttacattatgaggatcgactaattcagaaactttggcattatggggaaatctcaaactgttctctgccgcaggatagtcattttctaccatccactcgacaatattattctgacgctccatcaaaacgatatctttgaaaaaagtggtcaacacgataggaatgacaatgccaccagcacggcgataatgttcaatcacaccgagccgcaaccttaattgctcattggtatccaacgcactgactgagactctgacttccgcttttgcagcaactaaacgttggatgatatcgtcaggcatttttctaaatgctttggtgataaatatcatcaataatcccgcctcacgtgccaattcagccattcttgtagaaactgaccagttccatgaaggatcactgttccacccacacctgacatacttttgtgagtgaggcaatgcattaaggtcggtaacaaaaacggtttcatccaattggttatcgacccgtttaccaaaatcgataccgttttcccaactggatatagcagcgaaacacattccatagcaggccatactttccggtaaacaacctactaccacatcggtagttaagctattaaatggaagaccacctgctatccctgcacggatcaacatgggtttagctggtttaagctcatgacccttggtgtattcagcattactttgtctgacgagtcgtttaattcgattttcttgtcctttctcgatatacatctcaagcctccttaatttcccggccaggtatttcggattggtagtgaacatcaggatagatcttcagtgctttaataaatctgtcgccagtaaaacattccctgcgatgtaaaagttgactgttatcgtacagcagtaaatccccatcaacccattgatgtgaatagatattatcggaggataatattttttctaaaatagcttgtttaagtgcttctgaatgcggcagtggctgatcgttgtcgaggaatttgatggcgttttcactgatatatacatactgcttttttgtttgcttattttcgattatcactggatgagcaacagtaatatgaggaacattatcatgtgagacagctggttggcgagttgaccacaatgtgtttagcgtggagatttcatcaatggagtatcccagatgagcggccgaagttgatgcaaaagaggtattacctccctggcattttacagactcaccataaagtatgctgacggaggcgggattgattcgaaattcttggtctgagtgccagaagtccgtattgttgccagaaaaacccaatttctctcccttttcatcacataggtttgtcagataagcaatatgttttcggttatcggtcagggaaattttccgtgcaggctcttccagtcttccatctcctacgcgcagggcaaaattaacaagcgcatcatcatccattttctgattattaaaaaccagcagaccataaacagatatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggtagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtatatgctgaataatattattttaatcattagatattcaaataagtcaaaagataatttttgttgataaaaattatcaaaggatattttaagcttttaaatatcctttttagttgtaaatccatatttaagttgattgtaaaaactcaatcagaacattatgtttatttttaattaaattattttattttattttattttattttattttattttgcaattttaataaatattttaatttttcatgataagttaatttcctaatatattattttatttactagattataacagtgattttcatgaaaaattaagatttagggcagttaaagtattaaagctggcatggtatagtttattatccgatgtaatcaagtaatcaagatttttaagccaatgaatgggaataaaattgcctctttcatgtatcgctactgtcagtgggggagtttttagagcccccattaaaaaccatttttaatgatataaataaattatatattaatatggaaatcattactccggtaacatattttctaatttagcaattaatctgtgattgatccttgaggagatagaataatggttgctacacatgatgatattcagacccgttatgccaatatttcagttctcgatactggtggaagtgggctgccagtgctcctgatacatggtaattcaagctgtaaagaaatttttcgtcatcaaattgaatatttaaaaggggactatcgggttctggcattggatttacccggccacggtaaatcttctgacgccagcgatccgcgtgaagcatactcaatgcccggttatgcccgcaccatcatggaagtactggataagatggacattgataaagtcgtagtctttggctggtcactcggggggcatattgggttggaaatgctggcactgaatcctaaaatgatcgggctgatgatttgtggcacgccgccagtggccgttgggaaagagaatatagcccgtggtttttgtcagagcaagcagatgagactgaccggtaaagcggaatttactgacgaggatgtcagaaactttgcctgtgagacaaacggcgtcaatgcacctcatgaaccgtttatgatagaagccgtggcaagaacagacgggttagctcggcaatatatgtttgaagcttttatttcccctcaggcgacagatcagaaattattggctgaaaccagtgaagttcctttggctatcgtcaatggtgtcggtgatcctttcattaatcacgattatattaatggattaaattatagaaacctttggcaaggtcaggtgtttaacttgtccggtgttgatcatgcgccattctgggaagcaccagatatttttaacccgattctggctgaatttttaaaagatctttaatagcctgatgagagccagagcgggaatttttgttttatttaaagaaattcccgctattacaggtatgttgttttttatttaaagggtgatgctgtttctaaatattattttatttaatcacatttaacgccattcggttaaaaagcaccatttgtgccgcgccatcagggtctttgagtgatagagcgtcttccctaaaagtgacatccaatacccaatgcagcttgttttccaccgaccagtgccttcttattgtcttggcggcaatttccgcatctaacgggagagagctgacataccagcgtgaatcacggcaggaaggttgatctttcacacttcgtttactgacgacttcaatcacactttgtattgaaggccactgttgctgaagttgctcaggtaatgcagcacggatttgcatgacatgacggaattctttccgtccatgactgctatttttctctgtaaattcagcccgtttatcgtggtcataaggtgcagcaaaatgcggtttaacaaactcatagaatttttttgattacctttgaggccaacaataaaatccccgcctcgttggttaatcaacccaagggtttctttctgacaatgtagggcatccatggtgacaagtgcaccatcaagagcaagtcatttaatcaattgcctggcaaccgagccttccttacctttgctttcggcggcacaatggtcgagggcaacacccgattcaacatcataatgctacagccgtaatccatattgtgccatgatagggcttttggaaaatctaggttttagtcccgctctgtcctgacgattgactgaatagaatagtcggtttcgtgcatggcatcattcccgatagattgtgatagtccgttagtatatctatatctatatctatatatatctaatatcatttgcaccctgaatagtattggattgtttttagtgagaataatctgaattttctcatttttatttgtttttttattttaatttttaattgcaaattccacattctatttgtttagtgtatctttattagttcaaattttgtcagatttattcatttagtttatatgctattttttatggataaatttatatttatttcttaaatgctcaaaaaatacattctcaaggataattaatattggtctaattatggataaagaatatagaaaaaatagcatcctgaaacaaggcgtttttattcgtcgtgttgcatggtttaatattgtattacaatcgttttttcccattgcgggtagcatggtgccagttatatctgcacgtgctgataatgaaattcagagtataccttctgattttgacagccgatggcatattattcagaagaatgaatcgttggaatatattgccaaaaaatatgattcgacagtcaatgaaataaaagaaaataatctgtattttgtttctgctgagaatgacatgccattaacagtaggaagcaagctgcttattccgcctaaaaataaatggctgaattcaccgaatcatcaaaatgaatcacagatcaaggaaaaccaattcgcgaatattgcaacacaggctgggcggtttttacagaataatcctaatcgcgactccgctgttgagctggctcgttctgtggctacccgtaaagtgaatgccgatattgaacaatggttcaggcaatttggtcatgcccgtattcagctaaataccgataagaacttttcgttaaaaggttcccaatttgatctgcttttccctctgtgggatcaaaaagaaaaccttgtttttaaccaaacgagtctgcaccggacggataaccggactcaggccaatttgggtattggctggcgtcattttgagccggattatatgttaggcagcaatactttctttgattatgatttgtctcgtcgtcatactcgtgcaggtttgggggttgaatattggcgcgattatttgaaattgagcgcaaatagttatttcaggttgtcagggtggaaagattctcccgattttgaagattaccaagaacggccagccaatggttgggatattcgcgccgaaggttatttgcctcagtatccgcagttaggcgcaaaattggcttatgaacaatattatggtgatcaggttgctttatttggtaaagaaaatcgtcagagccaacctcatgcatttactgccggtttgacttatacccctgtacccctaatcaccattggcgctgaaaagaggcagggaaaatcgggaaaaaatgatgatagattaaatttgcagataaattatcagttcggggtaccgtggctccagcaaatatcctctgatgccgtctcacggttacgatcattagccaataaccgctacggattggttgaccgtaataaccatatcgttctggaatatcagaaaaaagaggtcatctggtttcacttggatcaaacaatcagcggctatgccggtgaagaaaaaccgctgaatatttcggtttctgccaaatatggccttgaacgcattgattgggaacttgctgaattaacggccagtggtggcaagattgaaaatgacggcggtcattaccgtattttgttgccagattatcaatacagtcatgccgatcccacctctgtggctgcgacggatgatcataaggtcaaaaatacctattctgtttctgccgttgctattgataaaaaaggcaatcgttctaattctgtgcatatgcaggttattgtttcatccgctgcaatcaatacggctaatagcttattttcaccagaaataagtgaattggcggcagaggggaaaagtacgcaaaaactgacattaaccatcaaagataaaatgaatcaaccggttgatgttaatgtcgaggaaataacacttaagattgaatccagtcataaaacccgcgattctcattccagtcaggtttctgatttccaacgtattgcggttgggcaatatgttgtcaccgtaacggcaggtacacgaactgaaacattgacactgacgccttccgtgagaaatcaggcgcttgcagcgactaaaataacggtcaaagctgatgttaaaaccgctcatatcagtgagaatcaactcactattgaacaaaattcagcaaaagcggatggtcagagcgaaaatcggatacaactggttgttaatgatgagtttggtaatcctgttcccgattatgaggtgaagttcagtagtgatgacgatgtagacattggcaaaagcgcgatcaccgataagaacggcagaattacgatgcctgtgaaaagcgaggtagccggttccaaactgattaatatcacggtgggagaacatgtcactcaagctgaggttatttttgttgcagatagtgataccgcctctattcaaaacagtgacttgatcattactcccgcattgtctgttgcggatggtcagacaaaacagactattacggcaaaagtgacggataaacaaggaaaccctgtttcgaatatcaaggttattttcgaggctgataatcaggcggtcattgcaacgcaggaagtcataacggatgagcagggaattgcacaaacaacgatgaccagtttgaaatccggaaccgtcatggtgacgggaacggtgaatcataaccaaaatcagactcagagaaaaacggagttagtggggcacaaggctacggcattaatcaaagaagtgaagacagaaagtgacctgtacgttgctgacggtaaaacatcggtgactgtgaatgctgttgtgactgatgagaatggaaacccgctgcaatcagtggccgttgactggaaatcaaatcgtgatagcaattcggttgaaattcatcaatcacaatcttttactgatgaaaatgggattgcccgtacgaccattaccagtaaaaaagcctatgaggtgcaaatcacggccagtacgaatgcaacttccggcacttcgacgcctattttattcaaagccgatcctgataatggtgaagtgactgacttgtcgcaaggattgcaacatgtggccagtcctggcagtaagacagaaattagcaccagaattaccgatcaatttggtaaccctcttccgggcgtagaagtccgctggagaactgacagccctgatgcccatgttacgtctacaagcatcacagatgagaatggcaaagcaagcacagaattggaagcggataaagcaggagatataaaggtatgggcaagcttgtccaatggcaaggaggttagcacagagataacgattgtcgcagatcagcagacggcggttgtcacattggccagcgagggcaataagatgcaagccgttgctgatgatcaggacagtatcacgctgattgcgaaagtggttgacgccaatcagaacccgttgaaaggcatccctgtgacttggcactcgttatccgcgaagaataaactgcgtgacaatgtcagtgataccaatgatgcaggagaagcacgtaatgtcatctcaggcacacgggcaggcacgacgacgattgaagcggtactccagaataaaggtaaaacggatctgaaggtcacttttaccgcgattaaactgggtgaaaataacgttaaccaagatgatttccaaattaacagtagttttaaattagtaaatcaatctattgttgcggatggctcaagtaaggcacaagcgatactggtattgaaagataagtatggtaacccggttccgggctataaccagaaaatagcttactcttcatcgaataacagcagtatcacattccacaatcagcaggagtcagaaccgggtatttacactgtgctcattgccggtaagcaggaaggaacatttcctattgatgcccggcttgggtcgctcgaatttagtgattctctgggttttgtcgcaaatcagacgacagccgaaatcgataccgtgaccgtactgaggacaacagcacttcaagctgatggtctggaaaacgttacgattcaggctcaggtgaaagacagtaacggcaataccgcgttgcctggtgtttacgttggctggcagacttcattgggtacgttgtcttcaccattgagtccgaccaacgagaagggcatcgctgaaattacgctatcgagcaggcaggcagggaatgcacgagttactgcggtgctgggcagcggtcaaaagacagcagataacccggtaacgtttattgcgggcggtgtttctggcgataaatcctcattagaggtttccaaatctatagcggtcacagatgaggatattgttcaggttaaagtcattgccagagatgagcatgataatttgctgacgggattgcaggataagatcgcaatgagatccacgtccgatttacagataaccgacgctccggtatttaaagaaattgagtatggtatttatattgctgatattaaaggcaagattgcaggggatacgcaacttattgcagagattggtggtactggggttaaacagcaagccgaactgacgttgactggaaatagtaaaacggcgaaacccaaggatgctgaaaacgctatcgacgtaacatcgaataaaatcattgcaggtaacagtgtcacttattccatcacgctaacggattctaatggtaattcattaggcaaagggatccctgttttttggtcggctgatgcagccagtacgttgttgcagcaaatgactacaacagatgagcagggcgttgctcaagtgacattgcaccgcgataaggcaggtacggcgaaggtgacggcgttattgtcttcaggagggcaatatttggcaccggcagtggagtttactcccgctgacattgacccggcgcattccacgtttatggcagataagaggcaaattggctctgatgctaaagaacaggcaatactgacagttaaactggcagataagtttggtaacgccatcagtggtaaaaccgtcaatattcacttgccgaatccgctcaagggctttgtggtaacgccaaccctgatgcaggataacggtgatggcacttattctgcttcagcgacggcgaagaataaaggaagccaggaaattcaggcggctgtggaaggaaaatcaatcggtcagtcattaactgtctcagtgggcgctattacgccagatctccgttttgccaatgccacgcaacaggtgacttataccaaacgttatgctcactcccagaaagtagtagatggcgggataccggcagggatacgtcagatgtggacgagttctgcggatgatgtcgccaccgttgatgatagcggtaaggttacattgtggaaagccgggacagcgaccatcacggtacagacaggaacgaatggtcaatatcattcgtctacagccagctatacattgaagttaagaaggcaacacctcaattgcagcatcagatcaagcagattgtcgctgtttggaatgatggcaaaaattatgccgtcacgccaagttttgcaaatcaggatgtggatgctcaggccttattgcaacaggcgaatttctccagtcacaataatggtgtggtgaaggtagataagcagggcaacctcagcatggtgaaacctggaaacaccacaataaccatcaaaacaccggaaacaaatcagtttacggcatcgactgctgatgttgcgtatgtactgaataagggcaaggtggatatttcttttgatgaggctgttgttcaagattgggtagctggaaatagtaaaatacaacaaccattccagttacctgtacatgccaaggagcgttgggagagtggtaataaagaagtcatagaagtatcacgagacgggttgtggagtaaaaaaggtactggtagtgcaacaatgactctatatgtagaacaaaatgattactatatgtccagtcatggtggttatgatgttgaattatatgataaacctgaggtggatataaaatcggtagaatatcctaatgagggaaaattggtctcagtgtcttcttcagagaactggactccagctttcaccgatgatgggatatctataacgtggaatgcactaaattcaaacaagtataaaccgataaataagatgagagtggagatggaagatgctaactctgggaaattgcttgattataaggattacacttatcaggagatttcatcttcgaagttgcataaaactacatttgttcctaagcctgaatattttggaattagtgttcgaataaaattaaccgcgaggggttttattggacttaatacggtagtcagtagcaataatttacccgtaagacatcttaagccacaccagatatggtcatcggtagaagtcagctcacggtacaacatttttgctctatttttcaatctttcagaagtgaaaacatgtcgaagtctttttattgacagggcacattcaatatatcttgatgtaattgatggatatattgattttggagggaaaaagttacttgtaccaatgtatgtttcatataaagccactattaggaaatttaaggactctgatcttgttacacaagatctggataaggctaatctttctgggaatgccagtagggcagcttataaggctaaagtgattgatggaaatgacaataaactactacctgcgcacagattgattcatggtgattgttggatgaaccattcaggtggataccgaattaatctgcatgttaaatatgcaggggaagaatataaatatttggctaaacgtacccatggatatggagggaatggggatggtgtatatgattctgatgggaatcgtgacataaatatagataacgagttttatttggaatagataacgagttttatttgaataagcctaagccgtaattgaagatgcttgatttttcattgtaatccttaaaccacctcctcgggaggtggtgattgttcctgtgaggctacatacatgcagtgatctgcgaccaagcgcaaagtgaaattcctttggctattgtcaatggtgctggtgatcctttcattaatcacgattatattaatggattaaattatagaaacctttggcaaggacaggtgtttaacttggccggcgttgatcatgcaccattctgggaagcaccagatatttttaacccgattctggctgaatttttaaaagttctttaatagcctgatgagagccagagcgggaattttttgttttatttaaagaaatttccgctattacaggcatgtttattttttatttaaatgctagtactgttgaaagtattattttgtttatgtttatatttatatttatatttatatttatatttatatttatatttatatttaatagataatatataaatatatttttatcatagaataaattggattataggttattttattttaaacgtttgagatttcatatttttgtctcagtagttaaatcagtcatcagagaagcaaataaaaagagcgtccgcttttgcgaacgctctttaaatcgattaatgtcctcttggggtcgtcatggctgaaagtaatacttttccgacatcttggatatggggctgctccatgatggattcatgagaaccgttgatcggaatgacagtcagccgttccttcggtataacggcttcccagccaagggcatgactactctgatcattttcttccgttgctctgaacagggtgacgttaaccgccgctgtagagggaatatagtgataagcagcgacagaaatgttgtgataaaggtgtaattgttgcctgatattctcagaagcaggtaataaatcgttctgttgagcaagcattaatattgcagagcagtcatggttgttcgctaatctctgtatctgatcatgcagagaggccggcatattttctggcagtacctcaagcaatgtggctgtttcattaaatggcagaccggcctgtttttcttccagagaaaatgcgtcctgatagctggcacctgaatcaaacagaccgacaaaattgacggcttcacccgcggctgtcagttggcatgccatttcatacgcaatggttcctccaattgaccatccggccagatcataaggcccctgtatctgcatctgacggagacaggtaacgtactcttcggcgattttgctgatggttaactgggcattttcttccccgaaggtatcactggcgataatcccataaattgactgagccttatcatcaatataaggggcaagatcataagcatactgaacgtcacctcccgccggatgtatgaggaacaatgaggaatttccgtttcctttacggattgtgacgatatttttctgttgagccagaggggcactcaatgaatttttcgcttgaagataagcggctaattcgctgattgtcgggtgaataagcaggtcgcgtatggcgatatcaaggccgagcgcctgacgtaagcgtacgacaacctgcaatgtcaataaggagtgaccacccaattcgaagaaatgatcatgcctgccgacacgttcgaggccgaggctgtcttgccagacgtcagcaatgatattttctgtttctccgacaggcggttcataaccgatttgagcaataaccgctgagtcgtccggtaatggcaacgcttggcgatccagtttaccgtttggtgtctgcgggaatgaatctagtgtcacgaaagcattcggaaccatatagctggctaaactggcctgtaacgtttcacggagtttctctagattcagggacgtttccggttgtaataccagataggcgaccagacgcttatcattagcggtatcttcacgaaccataacaacggcttctctgatatcggcacaggcgagtaatctggcttcaatttcccctaactcaatacggaatccgcggatcttgacctgaaaatcattgcgcccgagatagtcaatgttgccgtcgggaagccaccgtcccaaatctcccgttttatacatgcgtctatcagccgatgtattcgcttcgtcactgaatggatcatcgacaaaacgctctgccgtgagatccggacgattaaaatagccgcgagtgacaccaatgccgccgatataaatttcaccggcgacacccaccgggacaggatgaccgtgtttatcaagaatgtagatctgtgtattggcaaccgggtggccaattgtgatctgaggcgtggtatagcggctctctggctccgtctgtagattgccggatgctgttgaacagatagtggtttctgtcggcccatacaggttccacaatccgctgactttttcttttaaacgctgtgccagttcgtgaggtaatgcttctcctccgcttgtcgctttgatcgcggcacctgtccagccggaatcaagtagcatacgccaggtcgtaggagtcgcctgcatgactttgatgttgcgtgcggcgatcaattccgctaattgctctggatctctggcggtcaatgatggtgctatgacgcaggtactgccgttgcataagggtagatacagctcaagtgcggcaacgtcaaagccaattgtggtcgcggtgagcagggtgtcatcgacagagatttgcagccggtctttcattgataacagcaggtttaccaccccaatatgctcaaccatgacccctttggggcgtcccgtcgaaccggaggtatacagcacataggccagattgtgtgacgtgatacctaaatcggcggctggcaggttgcactcaggttgatgaatgatatttgcctgatattcatcactatccagtatcaatattggcgtattggtctcagataaacgggtttgcaggctatgctgagtcagtaatacggagggctggctgtctgacagcatataagacaggcgttcagcggggtattccggatcgagaggaatataacccgcccccgctttcatgattgctaataagccgatgaccatctccagaccacgctctacacaaatggccacccgatcatccggacgtaccccaaacgcaatcagagagtgtgccagttggttggctcgacggttcagctcgtcgtaactcaattgattgtcatcataaatcagtgcagttgctgtcggggagcgctcgacttgttgttctatgagctggtggattagttgatcctgtgggtaagcctcacgggtgttgttgaacgttcgcagaagctgtgtgcgttcttcctgcggcagtatgttgagttgcaggcaagtctgttcaggcgaatttttcaggctttcaactaaaccctgcaatacggtgttcatgaaatgattaatccgcatgggatcaagttccggaacacattgtgcgaccagtgtaaagccttgtgcggtgtcatcgacagataaactcaggggatagttggtgcgctcatcgacatttaacagcccgatgccttcccaggccgtgagggttgtctgctgggtatcatcctggttgtgacgataattcaacaggctactgaacaatggcagaggcggggtcacaccactgcaattttgagccatcgccagcggtgcctgctcatgttccagtaattcactcaataagcgataagtctgctggacgacctgctgtacattgaaggtactcagcttgatccgtatgggtaatgtattcataaacattcccagtgtctgatcggcaccggcaaccccttgtaaccgccccaataacactgtaccgaagacgacatcatcccgtccgctgcattgtgccagtacctgcgcccaggcgacgtggaacagtaccgctgcactgacgccctgctgacgggcgcattcccgtagtgtctgcgcaaacgaagtatccagatcgaattctgcttctaggatatggctatcttcaccatagacttcctgtaagccgaagggcagggtgggttcatccacatcacccaaaagctggcggaaatagtcctgatgtttttcaagcggtacagcgcgggtctgggcgataaagttacggtagggcagcgacggtggcaaatcgtcgctctggcctatcatgattgcctgcacttcgttgaatatcatctccagcgactggtgatcacacaccagatggtggtgcagtaatgccagaaaccaggtttcactgtgcggatctttggcaaagctggcagacattaacggcgcttgggtaatatccatccgtaccgagcggggatcaacatagcggcgtagttgctgttcggcatcttcctccggcgacagggttagctctgtgacggggatcggtgcctgccgataaaccacctgcaccggctgcggcaggtcatcccagagaatcgcactgcgcaggatatcgtggcggtggaacacctgttgcagcgcgagtaaaaacgcatccagacgcgggcggctgtcaaaggtcatcaacaggttgtccagataagtatcgccttccgtttccagtaagtggtggaacagaatgccttcctgcaatggccccagtgggtagatatcctgaatattactgatcccgtcggggacttgggtaacgatttggttaatgttggtttgcgtcagtgccaccagaggcagcatctccggtgtaatggcctgacaatcgtcggtgatgaggttcggtggtacgcttacaccggtagatccatcagaatctgatgcggtcagacgcaccgccatcgccgccagtgtcggcgaagagaagacgctactgacatccagcatcaggttgcgttgacgcagttgttcaatcaggctgaccaccagcagcgaatggccgccgagttcaaagaagttgtcatgacgcccgacctgttccagccccagcagagtctgccagaccgtggcgagttgttgttcggtttcaccctgaggcgcctgatattcacggctgacggaggcggcgtgatcgggtgccggcaaggccttgcgatccagtttgccattcgggttcagcgggaaggtgtccagtatcacgaatgcgctcggcagcatatattctgccagatgagtgctcaattgttcacgtaaatcggctgtatccagcgtgacatcggactgtggcacgaggtatgccaccagacgtttatcgccgctgccttcttcatgcgccatgactacggcatcactgacccctgcacaggcggccaactgagcctcaatttcgcccagttcaatgcggaagccgcggattttgacctgaaaatcattgcggccgaggtagacaatcgtgccatccggccgccagcagcccagatcgcccgtccggtacatccgtgcgtggggttgttcacggaatgggtcggacacaaaacgttctgcggtgagttcaggccggttcaggtagccccgggcaacccctgcgccaccaatatagatttctccggtgacaccaatgggaacgggttgcccccgcgtatcaagaatataaatgtaggtattgatcagaggatgaccaatcgacagggtgtccatgccataggaagcagggtcatccagtgccagcgcagtggcactgactgtggtttcagtgggtccgtaggtgtcgatccagcggcagtgccgggtttccggcatcgattgccaggtgacgaaatggcggtgttcggctttttcaccgccgaccgtgaccgaacgcaggtgggaactgaaaccactgcggccggctttcatctcctgtacccactggtgccagaaagcggtgggcagatcggcgacgctgatcgcctgttcctgcaagaactggctgaaagtggcatccggtatgcgaatatgtgccggacgcaggatcagggttgcgccaacggccagtgtcgggaaaatttcagacacggcggtatcaaatgaaaccgaggcaaattgcaggacgcggtcagtggatttgagctcactggtctggcactgggcataggtgaaattcaccacgttatggtgctcaatcatcacgcctttgggcaggccggtagagccggaggtatagatgatataggccagatgatggggatgcagccccaactggcgtggatcagggttatcggtcggttgcggtgccacggtatttaaatggctggcctcatccaattgccagacggtcagatcttctaccggcaatcgtgcctgtaaatgctgctgggtgagcagtaatttgggggcgctgtcggacaggatataggccagacgttcggcagggtattcagggtcaagcggaacataacccgccccggctttaagtatgccgagcattccaatcaccatatcgagattgcgctcaatacaaatcgccacgcggtcatccggctgaacaccaaaggcaatcagggcgtgagccagttggttggcgcgctggttcagttcggcataactgagttgagcgccctcccagatcagggcaatggcatcaggggtatgttccacctgttgctcgaataactgcgccagcagcttgtcctgcggataagccacggtggtattgttaaagtccaccagtaactgagaacgttctgctgatggcaggatattcaaggactggatactttgttcaggctgattttgcagcgccgccaccagccctttcagggcaatatccatataagcgttaatgcgggcaggatcaatttgctggctgcattgtgcggtcagcgcaaaaccatcatcgaaggcgtccacatccagcgacagaggataattactacgctcttcaccactgagggtctggatgccttcccaggcgagtgatagatcctgctcgtcatcatctgagctgtgacggaaattgagcaggctgttaaacagaggcagggaaaccggaataccactgcaacgctgggcaactgccagtggcgcctgctcatgtgccagtagctggctgagttgctgataagcttcctgcacggtttgttggacactgcgatcctgtaaggtgatacgaacgggcagggtattgataaacatacccagcacccgggtagtatcctcacccccctgtagccgtcccaacaagaccgtcccgaagaccacatcctcccgattactgcattgagccagcacttgtgcccaagcgatatggaacagaacggcggcgctaactccctgctgacgggcgcagtctcgtatcctctgcgccagttcatcatccagtgttaatacagcttctgcgatctcattattacttgcctgaacatccagtaaaccaaagggcagggtcggctcatcaacatcactcagcaactgttgaaaataagcctgatgtttttcaacgggaacgcttcgggtctgagcgataaaattgcggtagggcaacgcgggctgtaaatgttcaccttgtcccagcagcaatgtctggatttcattaaatatcagttccagtgacaggtgatcacagaccagatgatggtgcagcaaggacagcagccaggtttcactatgcggatctttggcaatattggctgacattaacggcgcttgggtgacatccatccgtataaagcgagagtcagtatggcggcgtaattgctgttctgcgtcttcctccggtgacagggctaacgctatcacagaaagaggagcctgccggtaaactacctgtaccggctccggctgcccatgccagtggacagcgctacgcaggatatcgtgacggtcgatcacctgttgcagtgccagcagaaacgcatccagccgctgacggctgtcaaaggtcattagctggctgtcgagataggtgtcacccgttgtttccagcatatggtggaacagaatgccttcctgcaagggccctagtgggtaaatatcctgaatgttggccgcaccgccgctgacccgggtaacaagctggtcaatattgtcttgtgtcagcgtgaccagtggcaacatctccggcgtgatggactgacaatcgtccgggatcaggttcgggggaatggcctgcgtatgggtatcagatgcggcgtcatcggttaaatgtgcggccatagcggccaacgtcggtgctgagaaaaccgcgctgacacttacggtaagaccgcgttggcgcagttgttcgatcaggctgacaaccagcagtgagtgcccgcccagttcaaagaaattgtcttgacgtccaatttgctccagctctaacaggttttgccagaccgcggccagttgctgctcggtttccccttgaggtgcctgatattcacggctgatgatggcggtgcgatccggtgccggcaacgccttgcgatccactttgccattcgggttcagcgggaaggcttccagcatgacaaatgcactgggaagcatgtgttccatcaggcgggtgctcagttgttcgcgcaggctggcggcatctaacgtgacatcagacttcggcacgatgtacgccaccagacgtttatcaccagcaccttcttcacgtgccaccaccacggcatcactgacaccggaacagtcggccaattgcgcttcgatttcgcccagctcaatacggaatccgcggatcttaacctgaaagtcattgcggccgaggtagacaattgtgccatccggtcgccagcagcccagatcgcccgtccggtacatacgcgcattgggttgttcactgaaaggatcagatacaaaacgttcggcagtgagttcaggccggttcagataaccccgggcgacacctgcgccgccaatatagatttctccggtgactccaatcggtacgggttgtccctgtgtatcaagaatatagatccgggtattggcaatcgggcggccaatcgacaaggtttccgccgcacagaaagaacgggcggcatggttgttcagtgtcagcgcagtggcaatgacggtagtttccgttggcccgtaggtgtcgagccagcggcaattccgggtttccggcattgattgccagctgacgaaatgccggtgttcggctttttcaccgccgaccgtgactgaacgcagatgggagctgaaactactgcggccggctttcatctcctgtacccactggtgccagaaggcggtgggcagttctgcgatgctgatccgttgttcctgtaagaaatgaccaaaggcggcatcgggtatgcgaatatgcgccggacgcaggattaaggccgcgccgattgacaacgtcgggaacacttcagagacggctgtatcaaaggaaaccgaggcaaactgtagaacgcggtcagtggatttgagttcattgatctggcattgggaatggacaaaattcaccacgttgcggtgctcaatcatcacgcctttgggcagccccgtggagccggaggtatagatgatataggccagatgctgtggctgtaactccggttggtactgttcagggttgtgtgtgggaagctgtaccactgcatttaaatggctggcatcgtccagtcgccagacgggcaggccgtctaccgctaatcgtgcctgcaaatgctgttgagtgagcagtaattttggcgcgctgtctgacagaatataggccagccgctcggcagggtattcggtatccagcggaatataacccgcaccggcttttaatatgcccaacatcccaatgatcatgtcggggctacgctcggcacaaatcgccacgcggtcatcgggctgaacgccaaagtcaatcagggcgtgagccagttggttggcacgctggttcagttcggcgtagctgagttgagcgtcttcccagattaaggcaatggcatccggtgtacgctcgacctgttgctcaaccatctgatggagcaggatatcgttcggataggccacggtagtctcgttgaaatccaccaatagccgggtacgctcttgtggcatcaaaagtggcagcgattccacccgcagtgtgtcatccgctgtcatggcggtgagcagggtggtcaggtagccaaccatgcgctcaatgctggcagggtcaaaaagatcgcgggcatattccagtccgcccaccaatccgttttcggtctcattcagggataacgacaggtcgaagtgtgagctgttttcaggtaattccagctcactgatcgttagtcccggtaattcaacgttttgttgccccggtgtattttcctgagacagcatgacctgaaagatcgggctatggctcaggctgcgcggaggttttaacgcttcaactaactgttcgaatggcagatcctgatgcacataagcactcagggtatgcgctttcacctgtgccaatagctcactgacagtagggttatcatgcaactgtacccgcagcgctaacgtattgacaaagaaaccgagcaaaggctccagttcacgatgctggcgatttgcgacgggtgtgcctatcaccagatccttctgtccactgatgcgggagagtaacacggcccagcccgccaacagggtcataaataaggttgtcccatgacgttgaccgagtgtttttaattgtgctttcagcgtcgcagggaacgtgatttcaacgcttccgccggcataactctgctgcgctggtcggggcctgtctgtgggaagtgttagaagtgcaggggcgtcctgtagtgcactgcaccagtaatccaattgtttttccagtacttcgccctgtagccactgccgttgccagagcgcatagtcggcatactggagcgtcaatggtggtaatggattgggcagaccctgatcaaatgtgtggtacagggtcgagagttcctgcatcaacacattgatcgaccagccatcggagataatgtgatgctgagttaacagcaggatatggctgtcctgcgagagcttgagtaatcgtccccgtatcaacggaccatgttcaaaatcaaagggatggctcgcttcagactgtgtatattcttcgacagtggcctgttgttctgtttcaggcaactgactgatatcctgaacggttagagtaaagccgcagtctgcatcgccaatgatttgctgggcttttccctcgaccatcgcaatggtggttcgcaaaatttcatggcgtgccaccagactatccagcgtggcctgcaatgcgttttggttcagttggccttgcagatgaaggccggccggtatgtgatacgccgtctgtgcggcgggatccaattgagcaaggaaccataggcgctgctgcgcccaggatagcggtaacgcctgttgtgagtcagttctgggctggatctgatatttttcagtactcaggctgttctggatgcgttctttaatttttttctggagcactgcctgccgtaatttatccaaagtttgttcatttatgttcattgttgatctccatttaacatggcaagcaactcttcttcagacaggttctccaactctttttgtaccgactcgatatcttgggcgaaaaaagtttcaatttgtcttgatagaataagttcagcaagtttatacagtgttgagtgatgaaaaatgtctgcaataggaatttcaaggtggaattcttcacgcaggtgagtggataaccgcatgatggataatgaatttccgcctaactcaaagaagttatcatggcgcccaacctgctccagtcccagcagggtctgccagatagcggccagttgaagttcaatttcgccttgaggggcttcatattcatggctggcgctggcggaacgatcgggtgccggcagcgctttacgatccagttttccacttggtgtcagcgggaaggtatccagtatcacaaacgcactcggcagcatatattctgtcagatgattgctcagttgttcacgcaggctgactgcgtccaaagacgcatcaggttgcgggatcacataagccaccagacgcttatcaccggcatcctcttcacgcgccaccaccacggcatccttgacacccggacaggcagccagttgggattcgatttcacccagttcaatgcggaagccacggagcttgacctgaaaatcattgcggccgagatagacaatcgtgccatccggttgccagcagcccagatcgcctgtccggtacatccgtgcatggggttgctcactgaaggggtcggatacaaaacgttcagtggtgagttcaggccggttcaggtaaccccgggcaacccccgcgccgccgatgtagatttctccggtgaccccgatgggtacaggctgcccccgtgcgtcgagaatatagatccgggtattggctatcgggcggccaattgacaaagtttccgtcatacaggaagaaccggcggtaggcttgtctccggtgtggttgtccagtgccagtgctgtggtgataacagtggtttcggttggcccgtaggagtcgatccaacgacagtgccgggtttccggcatcgattgccaggtgaggtaatgacggtgttcggctttttcaccgccgaccgtgaccgaacggaggagggaactgaaaccactgcggccggctttcatctcctgtacccactgatgccagaaggcggtaggcagatcgacgatagtgatcgcctgctcctgcaagaaatggctgaaactggcatcgggtacttgaatatgcgcggggcgcaggatcaaggtcgcaccgacggctaatgtggggaaaatctcagacacggcagtatcaaacgaaaccgaggcaaattgcaggactcggtcagtggatttgagttcactgacctgacactgggcataggtgaaattcaccacgttgcggtgttcaatcatcacgcctttgggcagccccgtagagccggaggtatagatgatataggccagatgctgcgggtacagacccagttggcgtgagtcagggttatcagtcggttgctgtgccacggtacttaaatggtcggcatcgtccagtcgccagacggggagatcctctacggctaatcgcacctgtaaatgctgctgggtgagcagtaatttcggcgcactgtctgacaggatataagccagccgctcggcagggtaggccggatcgagcggaacgtaacccgcaccggcttttaatatgcccagcatactaatcaccatgtcaagattgcgttcgatgcagatagccacccgatcatcgggctgcacgccagacgcaatcaggtgatgtgccagttggttggcgcgctgattcaattcagcatagctgagttgaacatcttcccagattaaggcaatggcatccggtgtgcgttccgcctgctgttcgaatggctggtggagcagaacattttgcggataggaggctgccgtattgttaaagtccaccagtaaccgggtgcgttcatctggcggcaggatggcgagagattgaatgctctgttcagagacgttttgcagtgcggccaccagctctctcagcacggtatccatataagtgttaatgcgtagcggattaacgtgtcggttgcactgggcggtcagggcaaagccatcatcgaagtcgtccacatccagcgacagaggataattactgcgttcttcaccgctgaggatctgaataccttcccaagccggtgatgcggactgtttatcgtcacgttggctatggcggaaattaagcaggctgttaaagagaggttgaggcgcttgaacacggctgcaacgctgggcgatagccagcggggtctgttcgtgttccaacaatgtacttaactgccggtaagtgtcctgaacggtttgtcgaaccgtgcgctcctgcaataaaacgcgcacaggcagggtattgataaacatgccaagaacctgatcggcacctgagcctccctgtaaccgtcccagtaacaccgtaccgaagacgacatcatcccgtccgctgcattgcgccactacctgcgcccaggcgacgtggaacaatactgcggcactgacgccctgctgacgggcacagtcacgtattctgcgagccagttcgttatctaaaatgaaattggcttctgttatttcactgtgttcatcagggttgccctgtatatcgagtaagccaaagggtagggtgggttcatcgacatcccccaagagctggcggaagtagtcctgatgtttttcaagcggcacggtgcgggtctgggcgataaagttgcggtaaggcaacgatggcgacaacgagtcatcctgccccaatagtattgcctgcacttcgttgaatatcatctccagcgacaggtgatcacataccagatggtggtgcagtaaagccagaaaccaggtttcactgtgcggatctttggcgagtttgatagacaataacggggcttgagtcagatccatccgtaccgagcgggaatcggtagcatcgcgcaactgctgttcggcgtcgagttccggggacagcgttaactcggcaatggaaagaggggcttgacgataaaccacttgtaccggctccggcagaccgttccagtgaaccgcactgcgcagaatatcgtgacggttgataacctgttgtagcgccagcaaaaacgtatccagacgcgggcggctgtcaaaggtcatcaactggttgtcgagataggtgtcaccggttgtttccagtaaatggtggaacagaatgccttcctgcaatggccccaacggatagatatcctgaatattggcgacgccatctgggattttggcgatgatctggtcgatgttatcctgtgtcagtgccaccagtggcagcatctccggtgtaatggcctgacaaccgtcggtgatgagattcggcggtacgttttgtacgtgggtgccagcagatccatcagacgttttcactatcagacgcgccgccatcgccgccagtgtcggcgaagagaagacgctactgacatccagcatcaggttgcgttgacgcagttgttcaatcaggctgaccaccagcagcgaatggccgccgagttcaaagaagttgtcatgacgcccgacctgttccagccccagcagagtctgccagaccgtggcgagttgttgttcggtttcaccctgaggcgcctgatattcacggctgacggaggcggcgtgatcgggtgccggcaaggccttgcgatccagtttgccattcgggttcagcgggaaggtgtccagtatcacgaatgcgctcggcagcatatattctgccaggtgagtgctcaattgttcacgtaaatcggctgtatccagcgtgacatcggactgtggcacgaggtatgccaccagacgtttatcgccgctgccttcttcatgcgccactactacggcatcactgacccctgcacaggcggccaactgagcctcaatttcgcccagttcaatgcggaagccacggattttgacctgaaaatcattgcggccgaggtagacaatcgtgccatccggccgccagcagcccagatcgcccgtccggtacatccgtgcgtggggttgttcacggaatgggtcggacacaaaacgttctgcggtgagttcaggccggttcaggtagccccgggcaacccctgcgccaccaatatagatttctccggtgacaccaatgggaacgggttgtccccgcgtatcaagaatataaatgtaggtattgatcagaggatgaccaatcgacagggtgtccatgccataggaagcagggtcatccagtgccagcgcagtggcactgaccgtggtttcagtgggtccgtaggtgtcgatccagcggcagtgccgggtttccggcatcgattgccaggtgacgaaatggcggtgttcggctttttcaccgccgaccgtgaccgaacgcaggtgggaactgaaaccactgcggccggctttcatctcctgtacccactggtgccagaaagcggtgggcagatcggcgacgctgatcgcctgttcctgcaagaactggctgaaagtggcatccggtatgcgaatatgtgccggacgcaggatcagggttgcgccaacggccagcgtcgggaaaatttcagacacggcggtatcaaatgaaaccgaggcaaattgcaggacacggtcagtggatttgagctcactggtctggcactgggcataggtgaaattcaccacgttatggtgctcaatcatcacgcctttgggcaggccggtagagccggaggtatagatgatataggccagatgatggggatgcagccccaactggcgtggatcagggttatcggtcggttgcagtgccacggtatttaaatggctggcctcatccaattgccagacggtcagatcttctaccggcaatcgtgcctgcaaatgctgctgggtgagcagtaatttgggcgcgctgtctgacaggatataggccagacgttcggcagggtattcagggtcaagcggaacataaccggccccggctttaagtatgccgagcattccaatcaccatatcgagattgcgctcaatacaaatcgccacgcggtcatccggctgaacaccaaaggcaatcagggcgtgagccagttggttggcgcgctggttcagttcggcataactgagttgagcgccttcccagatcagggcaatggcattatgggtgtgctccacctgttgctcgaataactgcgccagcagcttgtcctgcggataagtgacggcagtatcgttaaagtcggtcagtaattgagttcgttcgtacgacatcagtagtggcagatctgccacccgcagattgtcatcagcgaccatcgccgccagcaggttttgcagataacccgccatccgttcgatactggaacgctcaaaaagatcgctggcatattccaactcacatgtcagactattttcggtgtcactcagtgccagagtcagatcaaaatgggcgctgtttctggtcagagccagcggactgagactcaattccgccagttcgaaactttgtttactggatgtattatccaaagccagcatcacttggaaaatcggactatgacttaaactgcgtggcggttgcagcacttcgactaattgttcaaatggcagatcctgatgggcgtaggcttccagcgcatgagccttcactcttgccaataatgcgctgatggtcgggttatcttctaacttgatcctcaaggccagtgtattggcgaagaagccgattaaaggctccaactcgctgtactgacggttggcgaccggagtaccaatcaccaaatcgggctggccacttaaccgtgacagcaaaattccccagccggccagtaatgtcatgaacaacgtcgcaccgtggcgttggctcaatgcccttaatcctgcatttaattccggcgataaagtgaaagtgacctgatcgccatgataactctgtactgacgggcggactttatcagtaggcagctctagtaaggtgggagcatcttgtaactcattgcgccagtaactcaactgtttttccagtctttcgccttgcagccattgccgctgccaaaccgcatagtcggcatattgaattactaatgcaggcaatggatcagcttgtccctgaccgaaggcttggtacagcgcagaaagttcgttcatcaggacattaagtgaccagccatcggaaataatgtgatgctgggttaatagcagaacatgttgctgctcgccgagtttgagcagttgagcgcggatcagcggcccttgcgcaaaattgaaaggatggctggcttcaaattgagcgtattcctcaatggttgcctgctgcgctgatgaagataactgactgagatcccggacggttaaagaaaaaccgccatcggcatcaccaatgatttgtcgggctttcccttcggtctgcacgatggtggtgcggagaatttcatgacgggcaacgatgcgatctaatgcggctttaagcgcgttctggttcaggtggccttgcaggtgcaatccgcccgacatgttgtatgccgtctgggcggcgggatctaattgagccaaaaaccagagacgttgctgtgtccaggataggggtaatgtttgttcacggttggcgggcaggatcatcggttgtgttgactgggttgctgtcaccaatgattgcgctaaatccgctaataccgattgagtaaacagatcctgtagcgttatttcaatattcagagactggcgcaagcgagatgcgacctgaacagttaataaagaatgtccccccagttcaaagaaattgtcatagcggccgacccgttccaatcccaataaattttgccaaatttcggccagttgctgctcgatctcaccttggggttcagcatattcgcgactgacgctggctgaacgatccggagcgggcagagccgggcggtctatcttaccgttctgatttaacgggaaagtatccagtgtgacaaaggcacttggcaacatataactggccagattgacactgagttgttcacgcaggctggccgcgttcagggttgcaccaggctgagggattaagtaagcaaccagacgtttatcgccgctgtcatcttctctgacgacaacaacggcatctttgacgccagtgcagtcagctagacgggcttctatctcacctaactcaatgcggaaaccgcgaattttgacctgaaaatcattgcgccccgaataactgatggtgccatccggtagccagcgccctaaatcgccggttttgtacatgcgggcaccgggaatgtcactgaaaggatcttgaataaaacgttctgctgtcagttcaggccggttcagatacccgcgtgcaactccgctgccactgatatgaatttcgccatttacgccaatcgggacgggttgaccccgttgatccagaatatagatccgggtattggcgataggccggccaatcgggatatcttcataggtgcagagatcgtctttatcgataacgattgaggttgcattgacggtggtttctgtcgggccataggtattgatccagcggcatttttgtgtgcccggactggatagccacgtgaccagatggcggtgctcggctttttcgcctccggccgcgacggaacgtaattgctcaggaggccagctataaccggcgctgatttcttgtgcccataggtgccagaaagcggtaggcaaatcgacaaccgtgatgctctgattttgcagaaaggtaataaattctgtatccgggactttaatatgatctggccgtaagacaaccgttgccccgatagccaatgtcgggaaaatttcagcaacagagttatcaaacccgaaagaggcaaactgtagtacccgatcctgcggtgttagttttgacatctggaactgggaatgaattaagtgcactacattctggtgttcgatcatgacgcctttaggcaggccggtcgaaccggaggtgtataacacataagccagattctgtggggtcagccctgtctgcgatgcgtcgatattatcttttggctgatcggcaatataggtttgatgttcttcactatccagtgcccatacggggatgtttgtgacaggcaggcgggctttcagatgttgctgagtaagcattaacactggctgactgtcagacagcatataagccagccgttcagtcgggtgattgggatccagcggaatgtaactggcacccgctttcaaaatccccatgaggccgatgaccatatccagactgcgctcagcacaaattgcgacgcgatcatccggatggactcctgatgccattatgccgtgcgccagttgattggctcgctgattcagctcggagtaactcagttgagtttctccccagaccagggcaattttatcaggagtgttatccacctgttgttcgaacaactgatggatcagagcattttttggatatggaatggcggtatcgttaaagttcgccaataactgagtacgttgtggagaggtcagcaaaggaagatcgtctatccgcaggctgtcatcggccaccatagctgacaggatggtttgcaggtagccgaccatacgctcaatgctggcatgttcaaaaagatcgcgggcatattccagatcaccgactaaaccttgctcagtatcattcagtgttaaggtcagatcaaaataggcactgtctcgggttcgcggcagttcatggagatgtagcccatccaactcgaaatgttgctgtcccagcgtattatccagagccagcatcacttgaaaaataggactatggcccaagctacgcggcggttttaacgcctcaactaattgctcgaatggcagatcctgatgtgcataagcccccagagcatgatttttcacccgtgccaacagctcgctgacactggggttgtcacccagttggatccgtaacgctaacgtattgacaaagaaacctatcagcggctccagctcatgccgttgacgattcgcaacgggtgagcctattaccagatcgtgttgtccgctgatacgggaaagtaataccgcccatccggccaatagggtcataaataaggtgatgccatgacgctgactgaatgcctttaactcggtactcaatgcaggcggcagtgtgatatcgacccggcttccggcataactctgctgtgtcggacgcggtttgtcggtgggtaattccaggatcaccggtgcaccctgcaattcactgcgccagtagtccaactgtttttccaacacgttatcctgtaaccattgtcgctgccagagcgcatagtcagcatactggagtgtcaaggcgggtaatggatcagcccgatcctgacagaaagcctgataaagcgtggaaagttcctgcattaagatattgaccgaccagccatcggagatgatgtgatgctgcgttaacagcagaacatggctctcttctgccagacggagcaggcgccccctaatcaaaggcccctgagtaaaatcgaagggatggagggcttcacgctgggcgcattcttctaccgccgtctgctgttctgtgctgggtaactggctgaaatcttgtacagataacgcaaaaccacgatcagtactgccaatgatttgttggggctgcccttcgacgtccacgatggtggtacgcagaatttcatgacgtgccacaatctgatccaacgcggcttgaagcgcgttctgattcaggtggccttgcaggttcaaccctgccgacatgtggtatgccgtttgtgctgcgggatctaattgagttaaaaaccagagacgctgttgcgcccaggacaatggcacgttcccatcacggggttgtgcatgaatttctgttttttgtgtctgctgacgagttagctttgctgctttagctaactcaagtagtcttttgcgttctgctaatggtaaagatattaattcattatcattcattttttaagtaccattcaaagccagttaaaaaccagaattaacccattgttttgtagagatcttgcaaggattcagcgtcaaattgcagtaactgagcatcaataatgtgctcttcaagttgacaaatagtggggtgtgcaaataattgttgaatagagagttcgacatcaaatatttcacttattcttgactgtagctgtagtattagcagcgaatgcccccccagctcgaagaaattgtcattacgcccgacgcgatcgattttcagtagtttttgccagatatcggccagttgttcttcggtttcaccttgtggtgccgcatattcccgtgtgaggacggccgagtgatcgggagcaggcagcgctttacgatccaatttgccattcagagtgagcgggaaggcatccagcatcacaaatgcactcgggatcatgtaatcaggcaaattactgcccacttgttcccgtagagcaggaatactcagggtgacgccggactgggggatgagataagcgaccagccgtgtatctccggcatcatattcacgggcgataacaatcacatcctgaacaccgtcagactgagccagacgtgcttcaatttcccccagttcaatgcgatttccgcgtatcttgacctgaaagtcattgcgtcccagataatcaatgctgccatcggctagccaacgcccgatatcgccggttttgtacatccgcatatcaggatgctgaccgaagggatcttgaataaagcgttccgtggtcaattccggtttattcagataaccccgggcaacacctgcaccagcgatataaatttccccgactacgccaatgggaacaggctggtaatgtttatcaaggatataaatttgggtattgtcgatagggcgaccaatgggaaccagaccgatatgctgatcgggtacacatcgccacgaggtgacatcaatagcggcttccgtcggaccatacaggttgtgaagttcgctgtgagcaaaatgagtcaggcactgttgttgtaaggaatacgacaacgcttctccactgcacaaaatctgacgcaaagaagggcaacggccggctggtgtcagatgaataaaactttgcagcatggaaggtacaaaatgaagggtagtaatgtcccgcgtttcgatttcgtccagcagatagagcgcttccttatgaccaccgggacgtgccatgactaattgagcaccggcgagcagaggcaggaaaaattcccagactgagacatcaaaactgaacggcgttttttgcaatacccgatcatgctgagttaattgatattcaccctgcgcccacaacaaacggttgacgaccccacggtgctcattcatgacccctttcggtaagccggttgagccggaggtataaagcacataggctaaattgcgcgatgtcagacccaaatcggtggcaaccgggttatccgtcggctgactggcaatattggtttgatattcttcgctctccaatacccatacaggcatagttgtcatcggtaaatgatcttgcaggccgtgatgaatcagcagaagtgcagggtcactgtctgacagaatatagccgagccgatctgtcggatattcagggtcgagcggaacgtaagcagcgccagcttttaatattcccagcaggccgatgaccatatccagactgcgctccatgcagatagagacacgattatccggacgaatgccggctttaattaaggcatgagccaatcgattggcttgttggttaagttcggtatagcttaacgccttatcaccgcaaatcagggcgatggtgtcaggtgtgcgttcgacttgctgttcaaatagttgatgaatcagagcgtgttgaggaaaaggcttatccgtcttgttaaaatcatagagaacctgccggcgttcttgttcagccatcagcggtaagctgtcgatagactgttgttggttatccgccattgccgtgagcaggataatgagattttttatgagttgattaattaactcagcgtcgaacacctgaggatcgtaatggaaatgacaacggatctgttgattgacctccatcatattcaccatcagggggacgggggtatcggcataaagagggtgcgggaaaggtcttaattccgcgttcccccaatgtactgtcgtgctggaatcgttatccatccataacgttggcagctcactaatatatctgggtttttgaaaggtcatcagagtctggaaaatcggatgtgtatcggcagtgcgctgtaacttaaattgttccagaatcttggtgaaagggtatctctggttttcaatcgcctgacggatggtctttgcggtttgaagaatatgttcccttacagtgatattaccgttgatttgaccgcgtaaagcgaccggattgacaaattcccctaccaacttaccccatttggcttgacttcgacccggcatcattgagccaataacgatatcgtcctgcgcggtatagcgatgtagcaggatttgataggcagtcagaaaaatagcgaacagactgttgccgtattcagatgccatagcacacagcttaagcgctaaatcatcagggattctgccgaacgccgtgattttatccgtggctgggggggcgacgttgttatctgctctgttctgtaccgatccgattttcatcggccatgataatgtactcaaatccccagccagattattgccccagaactgttgttgtttttttgcgtttttgctgtttaaccatttctgctgccatgaaacataatcttgataactgtgttctgatatcggttccaattcttgtgaggtcagaatcatgccgagttcttccagcaacaaccagtaagaccaaccatcgacaactaaatgatcgaacgtcaataccatgacactttcttgcgcattacattgataccaactggcataaaagcgcagcggattttccagatcgagaacatgccggcaatcgtcaagtacaagttgctgaagcgtatcttcgctgaggtgcagggcatcatgtgtctgaattttgatttcgctattctctgctatgcgatatcccaattcgccatcgtatagcccgaaactggctcgcagcatcgggtgacgcttgatcaggtgattgagtgcattttctaaatcttgaacgtttaaccccttaactctggcacaaaatgcaccattatttcgcccacgttggcttgggttaatttgatattgaaaccaacggctgctttgtgcttctgataaagcaaatggcttcaacttttcagggtggttcattttatagctcccttttttatgggcatatgaaaataaaaaagtctgagaactgataaaacaaaaaataaaactagaatccaaatctataactaaaaaatccgggataaataaagtcagaatgatctgtttttcagcaagaaaaatcatgctgtaaatgtatgaaataataaaaaatataccatacttataaaaataaaggcatttttaaaaaaactgataagcaaattcttctttgttcagaaaatatacttttattttttcatgacattcgagaggatgaattatatattaaatcaatgtattttacatggttagtcgtgttttacttatatatctaattttattacaggcaatgtgtatctatgttattaataatttatattgcataataattttaataatgtaggttaataaaaaagagcctattaaaataggctctttgaatgaataaaaaatatatcacggtcatttattttgggtggttatttattttatctctgtaatagtttcatggttatgattatttatttctttaatattaccatcttccagcttaataacacgttcagcaatatcgaaataagcatcgtcatggctaatcacaataaccgttttcccacgagatcttaactccggcagaagctctgtatagaacaaccgtttaaataccggatcttggtcagcagcccattcatcaaaaagataaagagggcggtcttccagataagcagcgaccaaagccagccgttttctttgaccggctgaaagctctgtcgtagagaatttaccatcaataatcttcactttgtgacccatgtttaatgcctgaatgtaatgagtcgctttctctgtgacgtctgtgccggtatttaatagctgatcgaatagatgataattggaaaatacagcggaaaagaattggcgatagtggacattgttggatgtatccatctttacaccgttaagccagatagaaccggattcctgttcgaataaaccgaccagcatcatggctaacgtggtcttaccgctaccattacctccgacaataaagacaatttcgccctgagatattttcaggcttaaagggccgagcataaactgacggtcttccttatcagtcgtatagtgatggacgatatccttcaactcaagtaccaggggtttttcactcaaaaatgggtttggcgtgtcaccctgcactgattgattttcctgcccttcgtctaagtcattatcaagctgacgcattttattcaacgagatttcagcttctctcagttctgggatggcaccgacaacttcactgatagggccagccagaaagagcacagttaatgtcaccgtcaccagactggcggggtcttgaggtaaccagatcggcacgacaaagaccatgatgccgataatcatataaaaagcgattgaacttgcattcagcacccaggcataacccgtggttgctttaatacagatttctttaaattttttggcaccgggagaaatgactttatcgataaacgcatcgcctttctgtgtattgagttgcagttctttgctgccatcaatcaggctttggaaattgagatacaacctgtccacctgatcacgcatttcagtcattaaccgtataggacgtttttccagaagataaaaaatatacattatcactagacataaaaggatcagaatgacaaaaagttgccaggaaacccacgctaaataaccaaaacaggcgaaaataagggtgatatttccaaaagcagttggggctaacataaaagattgtataaatacatcgacatctttagttaaaacagctaataggccgtgtctcccaagtttattaagttttttgtaaggtgcacgtaatattttagtactcagactgagacgtaatgaataaattgttgcttgggttaaatgtgagaggataacctcggatagtgttttagtaatgaaaaaaagaatacatataccaaaaaagctccagagaaaggaattaagttgaactgtttctgtaattcctctgctaattgtacttactacagatgcaccggcaaatccactaattaatgcgcttattgttgataaaagcagtaatatccaagattggcggtatagataagctattagagtcataaaaataagccattataggatgttatgggtaatataaaatgtatatatcaatttattagacccgttatggttatttttttttgataaaaattcaaggaagatttatgtaaggtaatatgaataaatttaaaccgtgataacaatcacattacccacctgcatggcaggtgggagcacgaatagtcaataacaatcagataagtgtatttttaaccgctcaatatcctgtgcaatctgtggctgtttcaccacgtcatagcaagcaaacgtcggtaatggtgacatgcctaaaaactgatttgctttgtgaaaagggtaataaacgttgtcgatgccttttccttcaaagaactgttcaggatcttcaaaagattccagcggtgcattccaggtaaccgaaaacatgtaatttttaccctgagataaacctcctgaaccatattttttggtaagatcgctgcgagtccgcccgtcatcttgaaataacgtaccgtcaccggcactaaaaacttcatcgacatattttttcaaaatccacggggcttccatccaccagcccggcatctggtaaataatgctgtctgcccaaataaatttatcgacttctgcctgaatatcataacccttatcaacatgagttatttggatctcgtgccccattcccgtcagatgatccttgatgatctctgttaacgtgttatttagttctccttttgattcaccaaactcttttgctgaattaacaaccaaaatgtgggtcataatcatcctctgttttattttatggataatgcatgaattatattagatccaattttagccggaagggtgcccagttatttccaatcgttgcctgatcctccaaagagatattgttttcgcatttatcgttttatcaaggtcatttgatggcgatgggttaatcatcatcttactcgcagccgtttgatatcccgacagggtggctcaccaaatagacggctgtattcacggttgaactgggaagggctttcataacccacctgaaatgcggtggctgatacgttatggtgttgtgtcaataatattcgtctcgcttcatttaaacgcaaccatttctgatactggagtgggctcattgaagtcaccgccttaaagtggtgatgaaaggatgaaggactcattcgggcaatttgtgcgagttgttcgactttgacggagtcagcaaagtgatctttcagccagttaatggtcttgctgatttgatggctggggctttcctgtgaggccatctgttgcagtcgtccacccaattcactttttagcagacggtagacaatctctttttgaatcaatggagaaagtacgggaatatcctctggagtacttaataaatccagcagccgattgaaacaaaccagcagttcagctgtaacgggagtgacagctaacccgcatgtatctggcgaatcctgccggattgcaacatgattttctatcagtaattctgaggcttcctgaatattaaactgtaacatcatggcaaaaaagggttcttctttcgaagcggtgcaaacttgagtaatggtgggaatatcggtggaagtcaccataaattggctggcatcacaacaataagagcacccgccgatagttatccgttttttcccttgaacaatgatcataatgctgggttcgtacaaccagcctactggtgttgttggctgttctaaatgacacaatgtcatttctgggatcgcagttttgactgcatatgtattgggtcgcgtcaagctggctattttcccgattaattgttgtaactgaatttcaatttctgttgcaccggatgggtgatgtaatgctttcattttctactccctcattcattgccataaacacacaaaatttttactcattattgttacttagcatatcgttagaattggaaagtttatatcagtgaaaataataaattggaggattaggcaaggatagtggaggataaggtggttaagggatttaatcataaaacattaagtggattgattgaacagatcttgggggagctaatactacagatgtaataagtatggtgtcatgatacgcctctatttatgagtgacggtttaacaatagtttaagttaggctgattatagtaattaccgaacaagtaggagaagattatgtcatacttagatccattgatgttattatctttctttattcttccagaaaacgtatggaaggtaaaaaatgatttataaaattgataattatttttatttttttggattatgccttaaataaatatgaatgtgtgaacaatagtgtggacctattatgtatttttataaatctattggcgcatctatttttttagtattgtatctatgttttttaaaagataaaaaggaatatgttcatgatcaaattaaataaaatggaatatagaaaaaatttcaggaggaacaaatcataatagccatcaccccaataatcgtcaaatagttaaagatctcgcttatgctacagcaagtggtgcttctagaagtgacagtgggggctagtatgggcgcgacaaaatatattgttagtagtgttattaaggggggcgcgtgaaaaacggaaaatatactatattaagtacttaaacatcgctcaaaattaaaaagtatctgcatggtaagaaatattagcataattttatattctgatagagttgccgactaaaaattgagtaagtagtgataactattttgaaaaatatcggtatatatatctaataatgttatcaataagcagataatacgcgatctttgtgtctattggtagcgcacaactctgtaggtgtttctgtgagtaaagcaattctagttttactctattcgatgttgcatgtttattttttatacaaggaaaatcatgattagcgacaacacaataaaaaaacctctttcagggaatgtttcacagcgtagatctttaactaatacgatgaagtcaaaacaaagttggaagaaccctgaaagccatttcgagagtgcgatctttgatccatggtataaatcaataactaaaatacattctcttatttcagccaaaacaggaggattttttagctctagagagttgtctccagtactgctacctgttaccactggatctatttcgagtcctatgggacttggatcagattcgatacctgtgaaaattaatctagggggagtggatacttatttggcggattccatgcagtttttgcttgaatacgttctgagattgaatgacaaaggtgtgtattatctcatgcctaccttcagaggcgaagaacaggacaagcgccatttgaatcaattctatcatgcagaaagtgaaatcatcggcagtttggatgatgtcattgaactagccagttcgtacgtgacatacctatgcgattacttcttagaaaacgaaagagcacttttatcgcaatttactgatgaactagaacacctaagaaagctttctatgcttaagggcaacataccacgagtaaggttcacggatgcggtggagttattaaacaatgactcacggtattttagtgagcatgaatctgaatttaaacaaataacaaatgaaggcgaacaaaagttaattgaattattcgatggcgcagtttggttgacccatttccctagcttatcagttcctttttatcaggcagatgcatctgagcaaggctattcacttacagcggatttgttgatggggattggtgaaacgttaggtgcaggagaaaggaatacttatgccgagaatgtagtggagaacttgaatgttcgaaaagtatcccgtgaagagtatgagtggtatatccgaatgagagaattaatgcccctaagaacatcagggtttgggatgggagttgaaagattcattctatggctaattaatcatgatgacattcgagattgtcagttacttccccgcattcacggagaaaatatcctaccataaattatttggttatcctttctcaaagaagcatattttaacttaaatgcgcattgttttgtactgcgtaattatctaactaaggtgaaaaatgaaacacttaactttagagtcaattccaaccattaagtattttcccatgatcggtattgtgagagaaacgaatagaccgccaggaggaatgaatagcattagaagaattgctcagaatgcttttttgaatagcaaaacagaagtgttagaagtgggcacggcgacaggtgtaacagcaatcgaattggctaagcttacctattgtaagattactgcaattgatattgatgagaacaatttgtcagtcgcttgtaatcgggcgatcaaggaaaatgtttctaaactaatttctttcgaaaaaagagatgccactgatacaaagttcgaagataagacttttgatatggttttctgtggcaatgtaacctcttactttgatgacaaagtgaaagctattaaggaatatgaccgggtattaaaagacaatggattgattgccgcgatcccaatgtactatatcaaaaaaccgaaagactcacttgtggatgaggtttcagaagctatcgatgtcaaaattagccctctatacaaaaaagactggattgagttcttcaaccttccagggtacgagcttgtttcttgtgaaaattttgttttcgatgatatttcaaacgccaaagttgaagaatatgtcaatatcattttcaaacaacaacatctagaagaacttgatcctgaaattcggactgcattatacaagagatatagctactttatgcatctgttcagaacgaatttatcacatatgggtttttctttaatgcttcttagaaaggtaacatttcccactgagcctgagttgtttaccgctagcccaatagactaagcgccaacgaagagttagtcgtccacaatgaacttcggtcgactaaattaacacccaaactacaggtgatgaatggctaaaataaccattgttgcgccagccaatactatgtgcaatttagacacaaaaatgatagatgttggccttaaaaatctatcaaatcttgggtacgtagtttcaatcaacgacgaatctttctttgacaccgaaaatattgccggaactactgctcaacgtgcgtctagtataaatcgggcaatactaagtgaaaatacagatattattatggcagtttttggcggctacaattgtaatgatttactcgaacacattgatttcatagagctccatcgtactaataaagtattaattgggtatagtgatatcactgccttacttaacgcctactatgcggttactggtggagttagctttcatggtcctggatttggaaccttttgcaacccaagcttaccagccgaaacggttaatggttttaccaaagcgctaaggctgacaaatatagaagagagacttattcaaccccaaatgacagctagtgacttatggttcttgaaaagtggtttcggccctagggaatggaaatctcaccctgaatggcggactattaatgaaggggaaattaaaggcatactaatcggcgggaatattgagtctttggtaaaccttatcggaactaaatactgtccggacttcgacaataaaatcctattacttgagtcaggttttaataccgatccgagccaattcagaatgtgggtatcccaccttaaagcatgcggcatatttgataaaatttccggcttgttaattggaaactttactgagtgttctagaaaaaggtttagtccctcatatttagataatctgatttcagagtttgttccggaaattgttcctacacttgttaatttctcgtcttcacacacagatccaatattgaccttaccaatcggcggtttcattcatatgaaattaagtaacaaacaaaatgaaatctgtatgtccgtaccggaaataccctaatttttcaatagataataacatcaaacgcgaggatatatgaacaataacttaattgtagatccaaataaatttatttcgtatttacgcgctagtgggtacttacaagtcgaatcagttccaaaaactgttattatggtttttttggaaagtctaatggaacactgcaaagagatttatgacttaaataaaatagaagggtttaatgctggagaactttatgttctatcagacaatgaatctgtaggaattttttattgtagaggaataggagctcctgtcgcagttataaatctggaagagttaatcgcatttggagtacaaaattttatagttgtgggaacggctggagctctcaaccctaacctttccattgcagatattgttctatgtgatagtgccctaagagacgaagggacatcaaaacactatgtttctgacgggcaaatatctttaccaacggaaaagtggcataaagaccttaaactttgcttcagtaagcatataccatctattactgaaggtagaacttggactactgatgcaccttatcgagagaccaaatcaaaagttacgagcttacagcagcaaggggtattgtgcgtagaaatggaagcatcagccctgtttgttgtggccggattccataaagtcaatatcgcatccgcatttgttattagcgactcattggcagacctaaagtggactcctggttttttttccaacaaagtgactgattcactgatttgccttattaagcattcaataaatttcttacataataaaaaggactaattatgttagatatagttgaatttggtcatataaatattgttgtagatgatatcgacgatgcaacaagattttatcaatctttatttagatttgagctggtacagtcatttccacattttcagaactcaggttttgctaaaggtgctggttttttggaaggctcggaacaagtagttgttgctataaattttcttaaaatacctaatactacagtttatttagaaatcattagctacattaatcccaagccaattaatccacctcaaacatttttgccaaatgaattgggagggcctagacatatagcgttacgtgtgagggacattgccagtgcatacgagaaaatcaagtcttttcccggtgtttctctcatcaatcctaactcggattataaaccctttcaattggatccggtatgtcccgacgattttaccttcgcaaatgcagagctcgaatcagatttagatctgaaactaaagtcgtcaacaatttccagctcaattagttttgtctacttcaccgataaatttggtgttatgtgggaactggaagaggaaccaacaggtgctgatgatccagcattatctgtctagcatttttagataggagaacacatgcgaattgcacacacaatgttaagagtttctaacctagttcaatccattaaattttataccaaaatactaaatatggatttacttgtatgtaaggattttccggatggtaaattcaccattgcttatgttggatatggcggagaatttgatagcgccttgattgaattgactcataactgggagactaataaatatgaactcggaaatggattcggtcacattgcaatctataccgatgatgtgttcgctatatgtgatcggataattgcaagtggcggaaatgttgtgcgaatgcctggacccaaaaaatatgggtcaacaataattgcatttgcaaccgatcctgatggttacaagattgaattcgtagagtgcgaaaaagaaataaagaaaagtcctaatgaaaaataagttataggtggtatttaagtatatgtccatgaaaataaataaaacatatagtgcgagagatgttgaaaaagaagcacaatcatactggtcatcagcaaaaacctttcttgcagatgaacataacccaggggaaaaattctattctctttgtatgtttccctatcctagtggcaatattcatatggggcatgtaaggaattactccataggtgatgctattattcgttatcaaaaaatgtgtggaaaaaacgtatttcagcctatgggatgggatgctttcggattgcctgccgagaatgctgctattaaaaataatactcaccctgcatcttggacgtacaagaatataaacaacatgcgaaagcaattaaagcaaatggggtacgggtacgattggtctagagaaatagccacgtgttctcctgattattaccgatgggagcagtggctattccttagattatatgagaaaggactagcgtataagaagaaatctgtagtgaactgggaccctgtggatgagaccgtccttgccaatgaacaagttataaatgggcgagggtggcgttcagatgctttagtagaaaaaagagaaatctcacaatggtttttaaaaatcacggattacgcagaagaattgctagatggcttgaaccacttggaagaatggcctgttcaagttaaaacgatgcaaaaaaactggattggtaaatctacaggagttcaagttagtttcaagattaaaggcacaggaaatacagtagaagtatttacgtccaggcctgacaccatttttggttgcagctttatagcgctagcaccagatcactcctttgcacgagaattatctgaacgagagcccgatataaagctttttgcagataagtgtatgcagatgtctactgctgaatctgatttagcgacactgacaaagaaaggcattcaaacagactgcatagctattaatccgttgaatggcgaagaagtgccaatatggatagccaattacattttgtcgagctacggtacaggagccataatgggtgttccagcccatgatgaacgcgatcacgagtttgccggcctctatgatttacccgttaagcacgtcataaaacctgttgataaagaaagtgccaatattgagggcttatttacaggtaaaggaattttaataaactctggggagttcaatgggctggtgagtgatgacgctatcgagggagttactcaaaaactaagggaaataaaggcaggaacattcgaaaccaaatacaggcttcgcgattggggagtatctcgccaacgttattggggggctccaattccaattatatactgcgatgattgtgggactgtacctgtacctgaaaatgatcttcccgtagtgctaccaaaagaatttgaattcacagataaatccaatgtgcttaaaaacatacctgaattttacaatgttaagtgccccagttgtggaaaatgtgcagttagagaaacagacacttttgacacctttgtcgagtcttcttggtattccgctcgatttacatgtgctgaccaaccgaacatgatgttagacgagagagctgattattgggcgccagtagatttatacataggaggcatagaacacgcaattttacacttactgtatgctagatttattcacaaagtaatgcgtgatgaaggcttgttaacatcggatgagccgtttgtccgtctatttactcagggaatggtgcttaaagatggtagcaaaatgtcaaaatcgaaaggaaatgtagtgaaccctcaagattatattgacaactatggtgcagatactttgcgtctatttatgatgttcagcgcacctcctgagcagcagcttgaatggtcagactccggggtcgatggtgcacatagatttattaagaaactctggaatacggttcatggtcatgccgaacactgcatgcccaagataattcattcaagtggaattgttactattgagcaaaaaaatttaagaaggaagctccatgaaactctaaagaaagtaactgatgttatggagacaagattaagcttcaacactgcaattgcagctgttatggaacttatcaatacatacaataagtttacggttaatagtgaaacagacaaagctgtagtaaaagaagtattagacaatgtcgttattatgttatctcctattatccctcacgttacgcatgttttatggcatgttctaggacatgataatgctctcattacagaagagtggcctaaagtagatgagttggctattgttcaagatactgtcactatcgcagtccaagtaaacggtaagttacgagctcaacatcttattagtgtggatgcatcagaggaaatgataaaggataaactgttcactctaaaagaagtccagaaacatattgaagggaaaactgtgaagcgcaccgttattgttcccaatagactcgtgaatatagttacatcttaattatcacacgtaacccgtaagatgtactagccaaaattattcttttcagtaggaataactcttattaaattggagttattccttttgtaggtgaatttttactgatatagagatctgacaagataataaataatattggaggtccacgtgaggctaactaaacaactatttcttgaaaaatatcgattacctaaaattctaaaccagaattcaactatgtctttattgagttctgggcctttttatcaaatggtagaaaagggaatacccttattcttacctattggtaataagatattaactgctattgagcgttgctgtattaaagaggccgaaaaatttgaattcaaccatatagatatgacccaaataatcccgactgatatcttatcattgggtgagcaattccatgacggttttctagatcaatttgtcttcctgaaaggtaaaatggaacgctatcatttgctatcaactccagaaccgttattattaaatttccttaaggaggggcttcaaagttacagacaactaccaataaaaatgatgttttccgccaaattttatcggcagctcagccaggttcaaggtattctcaaaacaagagagttcagaatgcttgctggtgcttgtttacatgagagggtatctgaaaaggaattggctattgagttctttcataaatacacactacatttagccaatgtattttctatacctatagagttcacttataatgaagaaagtaaattttacgagtatttctatattcatactgatggtgaggaactctttaatgatgtttctgctgtgagtttggcaatggcgtatgaatatggtcaagaaaaaaaagtgattgcccgctattgcagcaattcaaataggaatatgaacgcccaattcgtaacttatgggctggggcttcaaaggttattttttgtgatcctcgattgctatcgagataataaagggttcaacttaccaaagccagtacgcccatttgatattgctataattcccctacgagatgaagacatatcgaggtgcttggagtttgcaaattgtttacaaatcccaccagatcgaatgttgatagatgatcgatgcaagactcaggtattcgaaaaagaacgttttgctgattaccttggtattcctcaaaaactctttattagcaatcaggaagtatttgtcaagaacagggatactggcacgtttttaaaagaagtattccagctatccgatattaaaaaagaaagctgtagtttctttaatatccaaccatatgcacaaaactgattcgatataaattatttttctcgctataaaaattaataaaacagtgcgagacgcgcataatataatcatacatcaatcatgtaattaaattaacttattttgcaagtttaagaaatgacatttaattggtttcgatattttttaatgacacatacttaactgataataaaggaatgacaatgataaataaaatgattggagcaatctcaatttatcgagggttatcatcaaatatctatttcatcgctatagcgagatttattcttggtttaggaaattttattctaccttttatgatgttgttactgactgagaaactcgattactctgtaataattgctggatcgttaacaatgggagtgactggttcatattttatcggtagtattctaggaggtaaattttcagatagtatgggtcataagagagttttggtatttggcgagctagtcggttctcttatattgatagtatgtggattttttgtatataaccctatagtcatacctttgttcttattcggaacatatttcttttttggtctagcactcccggcaagtaacgcattggttgctgacttgtcaaaccacaggaaccgcgatgctgtaatgtccttaagttatcttgcttttaatttaggttcagcagtaggtccacttcttgctggatatctattttggagttatacaagttggatattctgggggaacggtttagctgctctgataggaatattaacagttctttttggagttaattctagtgttaaagaaaggggaacgtgccaaactcagttattgaatatcgagttggaaaaaccagtcattggtaccgtttggacagtactgtccgagagaccaagaattattttttttacatttttttgctctctaatgtgggtagttatgaatcaaatgactatggctagtccgctgtatttgaactatatatttgatactcatggccctattctatttggacagctctgcactttttcctgcttagtcgttgttgcaataacacctatattaatgaaattgactgcctccaagtcggacattataagccttgcgtattcaagtgttattttcgcagttggttacttagttgtaatgtcaagcccaactataccaatgcaatttatcgcatggttcttcttatctgctggtgaaattcttctttatactaaggaaggtatatatttagccaatcaatcaccaaaaagccatagaggtagaattcaaagtttttcaacgtgcatgcgcaatattttgcttatgccaagttttgtattaattggtttcacaatcgataaatttggatatcaatacacatggttacttatagtgtctattgccatgttggctgcatttgggtttatggctatggataaaaaatatgaatctttaagaacttagagaggtggatcaataagataatttttgattagcgggtatttctgaaaagcagaagagagctcatataggactccacttgaaaaacggaaaatatactactgtaagggcttccccggcccgtcaacgatgactaaaggggtaagattgctttactatacaaatactttatcgctgagttccaacctcaacatacgcttagtctcattgaagtcaccgccttaaatggtgatgagatgatcataatgctgggttcgtacaaccagcctactggtgtcgttggctgttctaaatgacacaatgtcatttcagggatcgcggttttggctgcatatgtattgggtcgcgtcaagctggctattttcccgattaattgttgtaactgaatttcaatttctgttgcaccggataggtgatgtaatgatttcattttctactccctcattcattgccataaacacacaaaatttttactcattattgttacttagcatatcgttagaattggaaagtttatatcagtgaaaataataaattggaggattaggcaaggatagtggaggataaggtggttaagggatttaatcataaaacattaagtggattgattgaacagatcttgggggagctaattacacaggtatagcttctgaatatatattccgatggatttcaatatgcgtcgcggcggcaagggaacgaatttcccggaacatagataattgtgtggctggggtgagtgagtacagcgaacaaagaggcaacttactaatgtattaagtattgattcccccagtgggggaatcaatacttaaaaataaaaattgagataatcgattcgtttagggtcctggaatagctggaatagctggaatagctggaataactggaatagctgcaatatttggaacaaaggaattaaatatatcagatgcggacgactgcagtcgaatttccgtcatatattctccaatgatattggacttctctagcatttcaaaatgtagccatcgattaaaatcatatctaaatctatgatgactccatagaaaatccatatctcttattaaatcatcactaatatgtcttcccgtagctctgagcaaattttgtaaatggcgcgattgattaattagactggtactaccatagcgagtgtcactttttataaattgcccatataaatttagatagttatcttctgtgatgttcagcaaaactggtggtttcgatggcacaagatagacattactaatcattcttgttgccccgttagtgctcagtatttcaaatcccgatctatccaaccgaagaatcgtgttggtatctaacccgttaatatccacgcttaaagtataagcaccgctatttactgggttttcgatttggaaaaccctatcttcatttaacatagactggaaagtcagggtgtattcgttgtgtttgattagctgagtttcaggaaccctcctaccgctcataccatggctaaaactggttatcatccggtgtcccgctcgccgcatgcctgtgaccaagccgctgatggcaccagcccccatgctgaccacaccgaatcccatggaaacccaaccgaggattgcagaggcatggggatcactgtcttcggtgaccacactggctattcctgtagcatcagcggcaaatcccagtccggccaaaacagcccccccgatggacagtgacgctccccctgtgggaatagctaagacgataccaacggctaacccgacagtaccaaaaacaatacccaaaatgccccccagactcatatgcccgctgggatcagtccggtttatcggatcattcaggcaataagcataactgttgataccaccggcaccgaatggactcagattgtccggggcagtaaaccgcatcaatacgggattataggtgcgatagccattacctaagtggtaagttccccacacgggatcaagacgctcgccattgtaggcgggcaggccggtggcacgttcattttccgcctgctgtccatacggggaataacggtagcgtgtttcagcgccatctcccttgtggctcagcagtacgctgctgtgtttatctgtccccagcaaatggacctctggacctgtcaccgtcgcgaccgtttccccgtgggcatgtaacagacgggtcgcaaccccgctttcccgcaagatctcggctacacgggtcgcgccctgataataaagctcataggttttcttggtaccaatatgttgcaacaccagacagttggctgcgtcataagcgtaatgacttatggccgcatttaaacgcactgaggtcaaccgccccagcgcatcataggttaaatggcgcccaacctcatcccggatcaatcgccccgccttgtcataagccaatgtgatggtggcaggataaccggggtgggtatgggttatcccgtgcaactgacagggatctgcctcactgtaagtaaaagttgctgtatcgctgctgccatcttcaagtatggtcacacaggtttggatattacccagaacgtcataggcaaagtgctgacgggcaatgccaaaaccataggcatcacggggagactccgaaccagtgcagtgatattccttcaaccagctgcgtgcgggatcataggtgtaggtttcctgccgtaacaagccggatgcctgtgaacgggtgctacggcaggtcacctgtcccttgacgttatagctctgttccaaagtcagcgtatcggttttagtccggatctgacgattgacctcacgaccaaaatcatcaaaactcagggtaatggttaatttctggttgtgttgtttgtcatgaactgtccaactgtttacacgactggctgtatcatagattaaggcaatctcaatatctaaatctcgtcttgcgatcggacgaccaaacgaatcaaagcgcatatgacattttttttccgtcacatccttgtaatccgtcatcaggccaatgggagaataggtatagtcgaccgagcgggcgacaccggcttgtccatcttcaaaatggtaacgggtctgactcaactgccccgaagcagtatagctcatctcatgcgtagcaatctgcgatgcagaagcctgagtcatcgttcccgttttgggatcataactaaagcgttgttctattccttctgcctccactttcgtcagggcattccctaataaaggctcatattgatgtgtcactgtatgacccaacggatcagtggactggctgggataaagattgctcccctgataagcataatggtaggtacgcccgccacaggaggtggagatattgcgctgcagactgtcaaaatcgcgtgtccccaatacatgaccgccagcctcaatttgtgtcaataaattgccagcgctgaaaggggcatagttttttcggatcaccgtgccatcactgtgtttaatggctgaaacccgactaaacagatcgtaaatatattctgtcttttgtccaagttcatcgatggtggcccgtaatcgtcccaaaccatcataatgatggatctgttggctataaagctgcccctgactgtcataacgtgtaatggtgacgggttggtgacgtacattatataccacggttgttttgccaaaacgcagcccttcggccagcagggtaatctgtgcagtccgggtagcaggatcataatcatgccggagacgttccccagtatcctgtatcacaagatatcgctgtccccagtcatcatattcaaaacgctgactggaagagacttgcgtgatagaaccagccccctcaccgacgggcagccagtcatgactggatatatttctctatacgccccccgttgtcatagaccgcttcagacgccaaacgccagccctgtttctcctgccctttctccagtttctcctgctgataagcacgccccagtccatcaaagcgggtaccgcatctgattaccccaaacatcagtttgtgttgttgttaccgtaccggcatcttcaatggcatagacatacgttatctcccgggcgtaatcggttccctcattattgatgcgtttcaggatacgcccaaaagtatcatagtgataacgtgttgtacggccctgcgcatccatgccatgccataatttgccactgctccgcgattgtgtgcgttgagtagctatgctgagttggtcatgccctgtccactgaataccctgcaccagcgcctctccctgaaggacgtagctgaaaacttgctggctcgtccatgactgaccaccatcttgtatactatgcaccgtttcatcaacccgctgaagacggccatgatgaggcgaagcgacttcattcacatagtgagtctgtctttcaagcagtagcctacctgcgctgaatattccctgataagtacgcacgacagcataggataagggtgaaccgggacgggctggcaactgagcatagcgatagattgttttgtaaacaggtgcctcctcattgatcccctcgggggaacactgacccggcgtaacggttttggacttgacgaaacgcacaaagccatgcggatctggcggacaggcacctgtctccccgctggcgggataataagtccagtcggtacgtgtaccatccggcgcaatctgcacggtgggattacctgagtcatcaaactgtgtctggtggttttccccgttggcggcctcattaaagctgacaatcgccgattccggcatctgaaattgcgggagctgatccacaaaatcaacgccaatctgtgcataatactttgtcttatgatgacgctgacaatcattttgctggatcacttctgaggtcaacagatgataattgttatagctccgggtgatatggcgctgtgttttcccctccagccagctttcggtcgagccatattggtagtcggttaagatgttataaagataatcctcattacgatcccaatttcctactgccccataacccagaaagttaaaattggtgtattcataagtgcgcacaatatcagagccattaccgggagattgtgtgtgccgagtgacatagggcaatgccggtaggctcgcattgtctggaagctgatggccgttagaattatagtccacaatttccttcagccccgtcggggacaagacctgtgttaaaaatcggttatctgtgtcatagtccatcttccatttcaacatttgacccgccgtgcctttttggatactgaccatatactcattattaaataataattgaatatcataggattcagaggtgtttggccagaccgttattcgtgtataggagcccaattcataatggatatttaacaacactttctcttcatcggctatcgaagacaggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccaattacacagctgatggtcgttttgcttgtaccgttcacaccaaaaatataattgatgcggcgaagatcactgagccttgctggactcatataagtcgctatgggcggatttatttggatttcgccgatcataccttctccttagatttcgccagaaaaggctttttggctcaatgatgaaaaagaagcatcacaaccatcaagagatgcatttaaactgtcaatgtacttttgtactctccaataaattgatctaaatttcttttgcagtggcaaatcggggaaaattgcatccgtagtctcgaactttccctttgaaatattcaacatagagccactagttccagtcgcctgagaggtcagctttcctttgaatctaggctcccaaatcaagtagtttagatattcgggcaatagtatattttcacttgtttttacattccaaagcttatctggtaaaaaaacattattgttatctttagggactatgcacgttgctgcgacaagatctctagtgtttgctcgactaaaaagaagatcaccttttttaggaaatactaacttcttatctgcaggaatatctttttcataaacaaatttattttcctgaggattaaatttgccactagttaccgctgaaatttttagcaccccatactctccctcattacaaggatagctttcgccttttgcactccatccggagatgatcgatttaatgccgtccaccaatggcctaacctcccaccccttcggattcgtcaccggatcaccaaacatatccagaaacacggcgcggaggaattcattggcaagctggatggcttgctggcgtttgcggcggatggcaccggctttatcgagaatagcggcaatacgtttttgttctgttaggggtgggagagggatttccagatccttgaacctacctacatccaagttcgaaatatttgtggtttgacggccacaatgcctgattctatgctgcgtagacggactactaatccagtggtaaagatatctgctatcaataaccctctgcttcgcacggactatagagataaatcccccagctgtggcctgataattcagctttggtacgtaactggcctttcccacaagctcccagctattagctgatgaaatcaaaatatctccttcacacagagcctgttcctttctctttactagctccgagggaatagcaatcagatcactttgctcgagtccttcaacctgaacatttttagtacgcataaccacagtagagttggaagataaaggctctaccaggtcatcaggcttgaaggtcactccacgaatgaacgatataacatcgtccaatttagcttgaggccaactcacagcatcccctccagtgcatccagatccgccataatctcgctttccagcgttttcagtttgttcagaatcgtcttcgggtcctcaaaagcttcttcctcatacaccacttccttataacgattgatggagaggtcgaatttgttgtcgacaatatctttggcgtccaccacgaatgctttttgagttttatcgccaaaggctttgttaatatctttggctaaagcgttcctctcaaccaaggcaatatattgcttccacttggcaatagcttcgggcaggtcgttgctgccttcgccttttaacggcgttcttttatcatctaatgaatagctatcagtttgcaggtcatagaaccagacacgttcagtgctgccacctttagtaaacatcaaaatggccgtgctgacacctgtatagggtttaaacacgccgctgggcaaactcacaataccttcgagctggttattttcaatcaactcctgacgcagttgctggtgtgccttggaggagccaaacagcacgccatcgggtacgatgacggctgcgcggccaccgagtttgagggcgcgcaggatatgcgccacaaacagtagctcggtctttttggttttcaccaagcccaacacatcgggattggtattggtttcgtccaggctacctttaaatggcgggttggcgaggatgacatcaaagaagttttcttcctgctgcgggaagttttctttaatggatttactcaggctatcctgatagaggatattagctccatttaccccgtgcaaagccatattcatgctgctgacgcgcaacatagtcgtgtcgaaatcgaaaccccagaacatctttttgttgatatggtcacggtaaggctctaacaagtcgccggtgtagtgtttgttaccgtcgtcgtcttcaagaatgccgaactcactggaatgcacgcggttgagatattccatgatgcgagtgagaaatccggctgtaccacaggccgggtcgcagacagtatcagtgggctgaggattaatcagttcgatcatagcgtcgataatatggcgaggcgtgcggaactggccattgataccggctgtggtaagtttactgagcaggtattcgtaaatatcgccttttacatcgctttgggttagaggcagttcatccaccatctctactgcactgacgagcaccgattcatttttaatttcaagatcggcatcctgcatgtattcaccgatatgccccaaagcttcgatggcactaccgtcgttgcccagaccatcttgttcatcggactttttgccaagttttgcaaagtaagggaaaacattttgcttaaggtgtttatgcagttctttgccactgagatttttaaagtttttccagcgcaacaattgcccttccggtgtattgggaaacaggcgatcaaaatctttacctgtacggttcgctttgcgttcggccatgtcttcctgcatgtcgagcatacgggcgaacatcaggtagctgatttgctcgatcacggttaaggggttggtgataccgccggtccagaattttccccagagattgtcgatatcgttacgtatttggcctgttagcattgaatagctcgcttaatgattttctgctgtttctgattcgattggcgctgcgcttagcacattgccctgtgccgtgttttccaactggcttggctctatctcttaagccaactcatccataggttcgtctgccggatctttcacctgttctttcgtctgctcatcaataggttcaacgatcaaggtcaggcgctcggtttcgaagtctatatgtgcagcctccaagtggggcaggcttttactgactttggcagagagttgactgaaccgatccaccttgccatacaagccttgctgtcctaccagcgctttgacggtgctgttgtagtggttgctgacggtactcagggtgccacctaatttacttaaacgctcggctacagtacacactgagttgtatatatcacctgctttttcgctgatttcgcgggcttcggcattgctgcgttcaatcatccacagattggacactgtgcgcagaatgggaatgagcgtggtatgggagaccaatacaataccttttttgtagccgtattcgaacaggtttttgttatctttgagcgcctcgatataggcaggctcaatgggcatgaacatgagcacaaagctggggctacgcataccaacaaggttggtgtaatccttgaatgccagatcatcaatgtgcctgcgtaccgctttaacatgttcgctcatggccagttggtattcttccggtgattctgcacccacagcccggtcgtatgcgttcagtgctaccttactgtcgatgatgatgtgcttaccatcgggcagctttatcagatagtctgtctgcttttgcttgccttctgcatctctgaatgagccttgaacttcatagtgcgcctcttccatcaagccactcatttccagggtgcgacgaagctgtgcctcgccccaggctccgcgcttctgagaatcccctttcagcgcagaagtgaggttattggcttctttgctcatttgcaggccaatttccagtacctttttaatctcggcattgaggctggtattgccttgcaacgaagcatcgtgtacttcgtttatacgcttttggaagccttcgatctgttcgcggaaaggcttgagcatagtgtcgatactggcctgactggtatgggtaaaggttttgcctttttcctcgaaaattttattggccagattctcaaactctttggtgagcgattgcttggtttcactgagctgctgcatttgctctttaaagtgttcttctttgcgctccagcgtggttttaagctcagtatactcgttactgagcgactgatagtgctcctgaatctgatcataacgctgttgttgatctacaagggtctgtttgacgtctttcagctgctcgcgcgcttcggtattggatgcctccaactctttggcctttttgccttcttgtgccagctcatctttgagttggctcaccaaggtgcgttcttgctgaacgttctgctcacatttttccagacggtctcgtaaatcctgcgcttgttctttcaacgctcggttatcggcttgagcggtttctagttgcttttctgtactatggtgctgccctcgtaactcttccagcgttttctgtaaggatgccagctcgcctttacgctcggctaatgcgtcattcaggcgttgttctgtgacctttgcattggtctgttgcgtctgtagcttgctttccgacagttctttctcgtgcagagtgataccaagctgcttgagctcatcctggtatttctggttttgagtgttggccagcttaagggcttgatcagcctgttgcaattgggtgttgagctcagtgttcttacgtcctagcaggaccatagccagcagatagccaaaagcagcgagaaccaggcccgccacagaggcaataatcatgagtttagtcgtccattctagtgattgcatggtcactcctgtgtgctctcaggctgtgagcctaacaatttaggttcagccttgataaaaggttttagtacggtgattaactcacccacgtcatcggcggtaaatacgccgtcaataccctcgtgcgaaactgaggtaaaaggcgcatcgtacagtttttcgatcctgatcgagccgtgctgggcgatgtagtttttcagtaggttcataaagcgcacttgctgtgctgtaagtgttgggtgggcgtgcaaaaagctcttgaagtggtcttcgatggcttgcgagtccagcccgataatttcacgcacggtcaggtgtagttgatcggcagtgcggccatagaattcattcagcacctccaaactcacactggggtggctggtgagtatggtcgaggtgagggtttttaattctggttcggcaatagattcgcctttacggattttctgtaacgtggggttggcagctatcatctgatctagaatatctttgagtctacggcggtagatcatggcctcgttggcacctgcgattgttacctcacgttcttttagttgcaaaccggtgtcacccgtttttgttgctggtatagcgtacaatccaccgctaacggtttggcgatatttcatgatgccccgcaactctttgcgagctttttccagcttatcgatagtcgggttttgccagaactcggcactgcgcacttctgctataaccacatctttctggcgcactgcctgaatgttaacggccagcttattaagttctgccaacagcagctctcgaccatcatcaaaacagctggcttgctctactaggcagcgttctatggtggccatgagcttatccagataagtcgcatgtttgtcgcgcaatacacgggccgacattaatggagcgatgtgattggccaactgatgctgagtttttgcatcaaagcgcttcagtagatcggtttgctgtaactggtgtacgacccgcaattcacgttttactgcaatactagtatctggcaggtcgttaatatcggcacgcaataactcaatggcagcatcgaaggcggctgcatggtttcgctgtaaggcggcctgagccagctcaatccgggattcgaaggtagtttgcagcaaagattttccgccagtgtcttctggctcctgatattcctcttcaaagaaagcgaagttagcgtaatggtcaaaaatcaggaattcggttttgtgtttgccaggcccgaaaagattgtgccgtagacgcgtacctcggccaatcatctgccagaatttcacccaacttttcacaggtttggcgaaaacgagattaaccacctcaggcacgtcgatgcctgtatcaagcatgtcgaccgaaatagcgatgcgaaactcgttgtcagcctttttgaactctttgatcaggctttccacatggggaatggaattatggatgaccttgcataccttagtaccgtactgcggatacagcttgcagaacagttcttccagatgctcagcgtgatcctggcgttgggcaaagatgatagttttaccgaccagggagccagtttcatctttgatgccattgtttatcaggttttccagaataatgcggtcagtatcttcactgaagatcttacggccaatgtctttacctgcaatagtggtattacgggcctcttcctcgcccaagtcttcttcgagttggcgcttctgctcttcggtgaggttattgtagtgaataccatcacgcaggaaatcagtggtaagatctttaacccgaaacggtaccaaatacggtggttcgttgttaatcgctgcatccagcccgaactcaaatgttgggtcagtggtttcgcagtcgaacatatcgaacgtattgcgactgataaatttcaccggggtcgcggttaagcccacttgaagggcatcgaagtaatcgaacagatcgcggtatttgttgtagatactgcgatgggattcatcggcaatgatcagatcgaagaagcctacatccaattgagagaagcggttcatcatgccggggtaagtggcaatatagatacgcgcacttttatcaatcttgttggtttcaccaatcacacaacgcggctcagagggtagattttgcttaaaagcatcgtcggcctgtacccgcagttctttgcgatcacacaaaaacagagcgcgcttggcccagccagtacgaagcagtaattcagccagtgcaatggcaacacgggtttttcctgtaccggtcgcctgaataatcagcgccttgcggcgctgactttgaaagtgtgccgcgactgttttgatggcttcgatctgataaggacggtcagcaatgctgagctctgggttgaatttttccagctcagcggcacggtaatggcgctggtagatcagataatccaggctgtccttactgtagaagccatacaccggacgataggtgttgtactgatgatcatcccaaatgaaggtttcgtaaccgttggaatagaaaatcaccgggcgctggtagcccatgtgttcaaaggcatcggcatagaggcgagcctgctcacgacctgcttgaaggttggtattgccggattttttcgcttcgataacagcaagcggatgaccgttatcaccccatagcacataatccacataacccttgcctgagggattattgggaaagatcacttcaaattcatggctaacctgatcggggttctggatatcccagccagcttgcaacagcatggcgtcgatcaatagtgcacgggttttggcttcgttccattgcaggctgtcggccactaactggctctgctgccggcgtttttgtcggtcagacttggcgggtggctcaagcttgtcgatatttcgggtgcgctcacgttccagctgctcgatcaccctttcgagttcttcctgctgcttttgcaattctttttcgtagcttgaaacggatttttgcagttggttcaaagttgccgtagggtcttttatatcgacaaaagaggggatctggtccttctttttgttgtagtacttaatacccatatacatggccaactggtgcgccgtgcccaatgccatttgagcattacgcaattcgccttctgcaccatgggcggtatcgttaccttgaatacgcaaaaagttgatctggtgaatcagtgacttgctgacgcagtcttcaaaaaccgggtttttgatcagctcatagaagttggattgcggcatgtgcggcagcagttcttccttataaatggccttggtcagtacttcagcaaagctgcgcaggcgggtcagggcactacccggatcaatatgcagtaccgcctcggcgaaactaccgaggttggcaagaaaatcattttcaggtcgcaagaattcgaagttcgctgatttcatcaaaattattttgtccatatattctgtccatacctgcatcgtctctacgtacagagagttttagcaaaggacgtgccaattttatttaatcactgggaaataccgtatttttccatccaattgttcagtgtctggtagtttttcagccccagcagctgtgctgatcgggtcttgttttggccactatgatccaacgccttacgtatataagtcgcagcaacgctgccaattatacattgtatatcaataccttgagatatatccatattcatcaaccctgtttccggctctggcatatggaacaacgcctgacggatatcagcggcggtaatatcgtcaccttggcaccatagagctgctcgcagcaatgtggactgcaattcacgcacatttcctcgccaagggcattgaaggataagattttttgcatcaggagaaattttcttatgcctaagcatcgagtcatggatactcatcgctttgaccaagctatctgccagtaatgacagatctccatcacgctccctcaggggcggtagatgtagtactccaacagccacccgatagaacaaatcctccctaaagctaccattggaaaccgcttctatcaggttgcggtgggtcgccgtaatcaagcggacatcgaccttttgctctttggtgccgcccacagggatgaacgtcccctcctgtaatacgcgtaataaacgcacttgtatactgggttccagttcgccaaattcatccagaaatagagttccaccattagcttgctcgaataaacctgccttgtcggctagagcaccggtgaaggcgcctttcttatgaccaaagaggactgaatcgaccagctcggtcggaatagcaccgcagttaaccggcacaaacggcttgttggctctatgactggcattatgaatagcacgggcaaagagctctttacctgtaccgctctccccatagatcaacactggcacttcacgttctgccagtatttgcgcctgcgctttcagagactgcatgcgggggttacgggtgacaatgttgtcgaaggctgcattgataggggcactggcctctgccagctggctaatctttgcgctgtcaatgcttttagcagcgggcaggtattccgctgaaacctcaaaggggatatccacttgttggacaccctgctctagtgatgattgataaaactgacagggataatgggttttacccaataagatccacacagcctgcatggccggtgttcctgggcttaacaagagggataactcgcagccctctacggtaagcttagatagctgctgattggcctgaacatagatttcaccgaagttaacaggtgaagatagcgaaatggcgtgagcacagataggcgtggtaactagctcctgcaaccaagccagataggacctcacctgatcttccgggtagttgtaaagcagttctacggcatcaaacgcttgtgctgtaagagtcgcagcaatcggcccaagcgcctgaccatcagctccggtgctgccggtggctttgaggtcgttccccccaatccagctgaccagtgtatggggcttagccttgcacatccgtgaactccagcatatcagccacctcacattcaaataggcggcaaagtttatccaaagcctcaatgtcgatcttttgcgcagattctttgtacatcagcgttacagtattcctgctaagaccggtttcacgcaagacgtcggaaattttcatttttcgctctcccatcaggcgagcgagatggcaacgtatcatggcctgactctacgatgtacacaattaggtctaataatatcccaaaattctgaaaaaattaaagattaactgaaatatttacgcgtaacgataaaaagtcgggctatatcgattaatttttgatcgttagttgtatgcaacaagctaactcaactcagtagcagctataagatggctgcggatcttagatatgcctctggtgctgatgtcagaccgctatgaatgctgtcattgatatcagcagcttacttgttgaacaacactctacagtgatcaaggggtatttatcctaggctttatgtgatgagatgaaaactgaggggatcacactgatcacccatgttcgtcgtaatatgaaagccaaatttttatcactttgggacagggttatgttaagaacgcggtttttgatagagacagtgaatgaccaattgaaaaatatttctcagatagaacattcaagacaccggagcgtagtcggctttttactggaggttgtatcgggacttattgcttatacattccaacccaaaaagccgagtttaggtttacgtgattctgaaattgggatgcttaaacaaaactgaggtttttcagatagagcattcaaggcatcgcagtcagcttggttttttattggaagttgctgccggccttattgcttatatatttcaacctaaaaaaccgagcttgaatctacgggataatgagatcgctatttttaaacgaagctgaggtcaatttagcttactcgtgctctagaacgttcctgttcacgaattcgggcctcaatttcggcgtaaagattggcctcagcgttttctctatccgttgcagtaacaactaaagcatatgattcgtgttgactattgagtggagccccccactcacgatcatttctagttacaactacaaaccacttttcatcaggagagcgacgcttaaaggtccaactagatgattgcactgtacagtggtcacgttgttgtgcagtaacagaacgattacttgccgcatcatcattcctggattttgtgccatcctgtacatcatgattaaaatactgctggacatcctgtaacgatgttccttttatgagtctataggatatttgcgtagccgcataatccagcctggtcgttctgacggctggtgaataagctaaagtaatgtgcagttctcgtactgcccgttgagttcttaaaaaggaagcgggtaatggaagctcaaaaaattgatgtgtattattcacaatttgttcatcacacatcataacaactacttcttctgatgaacggtataaactatcttcctcgacgactccatatccaacaacatcccgaataatgctgcggtttcgagttgctgactctgctttataacactcaacaacttcttcagaaaatgtattttccatctgaggagtcaatactgcatggttgaccagcatcgctcgcaacatattggctgacatatctggatattcatttagtaaacgtccagcaagatgcgttatatatggtgcagaaaaactagttccactttgttcagagaaaaatgtgcttccttggaattgatggtggcagcttagaacgccaagtcctttggcatgttctcgccattggcctccgtcattacgcatggggacggcgaaattaccaccatgagctactatttccggtttaaaagctcctttcactgacggcccgtggcgtgtgaatggtgagggttgaaattcccccgcagggcttaaatgactaatttcatccgccctacgttgagcatcaaatgttgcattgtgcctggcataacttcctgtcgtgaggacattgagtgcaggggctggatcgataataacggaactgttatggattaagtaacttgggtactcagcacgccaactttcctgtggaacatcagggtcactacttccgctaaagttacctgcagaaacaacgaacagaatgttgtgacgacgagccagcacatcaagaacataagcaattcccctgatatgcttaccatcatatggtgcatttgcattaccaagtgataagttaaatatacgacatcctaaatctacgaaatactctacagcctcagtcaacgttgtttcgatcgtagaagtatcaaattccccttgagaattaaggagttttccattatataaccacactgatggttgccagaaattactggcatcgcaggcttcaacatcaccatatagcgcaatacctgcaacagctgtaccatgcccgcaatggtcaaattcgtcttcattaaccacaaagctggcgctttcagctatagcactacgcaataatggatgtgcggtattaattccactatcaagaatacaaactttcgcagcgtcaggagatggggaggggatgtgtgcaggaataacgttgatatctctgttcaatttttcgtacgaaatcccgcttgaaggaagcaaatctaccatacggacatcacgatgggctagtagtttttcagcttgctcgcaatttactcgaacccgatacatcaacaagctatcaagattaattcgatccaaacggtgaatcatattttcctgaagccagttttcaaattcttcgcagatccgctctcgtgaaggatgtcgtgtggtttctatcggccaaagctcaacatccagaccgaatgattctaattcaggaaaaccataatgcctgactgaccagcttttgcgatcctcactagaccaaacatcaacactgtccaatgctgttaggatctgctggtaggtaatatgtccatgtcccaattgtgacaggtgctcctcaaagagggcaattcctcgttcatcagcaaaagcaatacagatcgttttgtcttcttggctaacgaactcgataccatgcctgtccagatgagcaatatctaacatcccagtatattgtaatttaagcatgtaccggccatcattatcttttcctggaatttgcggggtagctaattgcgtaatacctcgtaattgctcagacaacatgcttccatgcaggcgcaagtcggcacgtggtgttctcggaatgttaaactgacgtgtgcgtctagggttctgaagagattctttcgcaatactaagatgtttatattgttccgtcatttattatccctgacgagttttatttacattttcccgcaagagtgcattcttaaggtctttcagagttaaaaactcttggctacgtaaaatcattcttttgattgcacgtcttacaatccgttctaaatcggcaccactttttccaataaatagtgagagcacggcatcatcttcaagctcaaactggcgacgtataccacgaagttttagcttcatcaattctaataattgatgtttgtcgggcagtgggaattcgattgcatcgtcaaaccgcctccaaatagcgctatccagaatatgctcatggttcgttgccgcaagaatcaagcttttcccctgatatgcatccatcatctgtagaactgcattcacgacccgtcttaattcgccatgatccccactatcccctcgttctttaccaatagcatcaaactcatcgaaaagtacaaccattggatactgagagataaaatcaaatatttggcgtaggttagcagcagtctcaccaagataagaagaaacaagagtatcaagcctgacgattgccaagggcatatccaactcacaagcaactacttctgctgccagagttttaccgcatcccggaggaccaaaaaagattactttactaacagctttcattccatagctgcgtagcacatcagctctgcgattttcttcaagaatctcttcgattgcatctgaacttgattcgggtagtacgatttcattcagagaacggcttggctgtttaatatccagtaatggtaggcctctctctttatcaacaggcatctggggagctgcaggcacgcgggaggtctgtatggtgtgatctccatacaggatatgttcaagatcattcgcaagaagatgatgctgtttttgtcgttcttcctcaatgatcacttccgaaacacgacggaaggtcgcgacatcacctgtcgccccagcttttataagctgtctgagaaccttaccgtttgccatttctttcccccaacaaaccaatgtgcacaaaatcttgctttcagtttagcatcgccgcatccctataagaagttagctttacctagattttttgaattgttacaacttttttcggctttttagaaggaacgatcgaaacgtcctatatttgagacgttctccccgtagattaatgtgagtaatgtccgcttggcacaatgccgactgtttttatatggacgtcccgtaatattcaacttttttcagtgactcagttcgtggctaatttcgcttcacagtcatatatccggcgtctggcaatcattccaatttactgcgccatggtgaagtccgaaccttgcctcctcatcagattaacggattaaaaatcctcaacagtttcaggttcttgcaaggccggataaccgtttagctcatcaactgaagtcaactttattgaaagtgaaacaaatttattcaggcaaaggccttgctcacctgaaacacgtcattattaaccatgattgaccagcatattctggcgcatttgcatttattggcgtaagcgacacacgctttattaaatccccgccggttaaccaaagactgcatccagtcacccagtgcatcgtgccgtaacgttctgcgttgcatggccgctctggcgccatgaattaaaatacaacgcaagtatcgattactatttttagtgattttacctaattgagttttcccaccactacttgcttgtcggggaaccaaccctagccaagccgcctgttgcctgccgttattgaattgctttcaatcaccgacataagcgataaatgcagaggtgattagggaaccaatgccgggaatagattgtaattgctgccactgtgccgtttgtgatgatagcaatttgagggtttcttctatttcctctgttcgttggagcaatatcagccagtcttcataaagttgtttcaaaatcctacgtgcaatcaccgttaatccattactagcatcctcaagtgcttcatacagcgattgtctcagggcagcagagcgttgcggaaaaacgatgccatattctgccgccagtcctctgatttgattagaggtggcaacgcgtttttgaactaatgactgtcgcacatgatggagagcacaaaggtcctgttgagaaaggtttttcactggcacaaaattcatatcaggccgattcgcagcctcacaaattgccagagcgtcattagcatcatttttatggtttttgacgaaggctttaacgtgctgaggggggataaggcaaacctcaaagccaagatgcccaaccatccgtccccaatagtgggcagtgctacaagcctccatcgcaaccaaagtcccggattccatttgtctgacagcatccagtagccgattgcgagtcacttttttattaaagacaacgtgattaccgtcgagcaaacagagctgaaagatcgattttgctagggcgtgttgacgttttgtgaaggtaatctgaacagcatgatgattgggtataatcaatttcgccaaaaactcattaagcctcatcatcatgctacgaactatgttaacagatcccgtctgggataagctatctgcactaatgcaacacactgggctcgtttatcataaagccgaacatcgtcttatccttgaggggatcctttatcggatgagaacaggtatcccatggcgtgacctgccgttggaatttggtcgatggaatacggtctttgtgcgttttaatgcggggtcaaaaaagggcgttttaaatttgatattcaaagggttatctggacttgctgatagggaatggctatttattgatggcagtattgttcgagcgcatcaacacagtgccggggcagcaacaaatgaagaggaagcgataggcaaaagccgtggcggacgttcaacgaaacttcatttggccgtagacagtcagggtttacccgtccactttgaactgtcaggggggcaaacgcacgacattaagcaggcggaaagtctggtgaataactccccggcatcagattttgtgattgcagataaaggctatgatagtgacgccttcagaaatatcgtcgaacaaacaggggcaacacccgtcattccttatcgaaaaaacagccgaaaatcagaaaagcccatagacaaagggttaaatcgttaccgacatttagtggagaatgcctttgccagaataaaacattttcgggctatagcaacgagatacgataaattagaacgaaattatgccagtatgttagcactggcatttactctcgtttggttaccaatgtgggctgattgatttatgaacataaaacatcaacagtccctaaatcaataccaagaattttattacgcatgatggacgctcccgtaaaatgagtatgctatttcattttggtacaattgacgccatgtgggacgtccatctcatcagattaggttgcgctcagatcatcgatagtgtcatatcgagtcttatttggtacaactaactcgcttttgtccagaagcgagttatcgataacatattaataataacctaaaattcaagattgctttgctcatattccaatgaccagagaagcagaccttgtgtgctccaatacaacttattcaccctcaatattctggtaatacacctgccgaatataacgtcctcgcccgtcaccatgtcctaaatccatcgagaccagtgccagcgcttcccgctcactgaatccttgcgctatataatgctctccggattgctgagcaaaatgataacgcatactgtgtggcgctttattgccgctcagtcctgcacgtctgacaatatagcggtaacggtctatggcctgagtgatcgtcggcttatcaatcagtttgccgctatgtcctgcctgctcttgctccgcataggcaatggcatgttgcagcgctgcccgatccaatatggtcgtctgtcgagaccgtccacctttagtaccgaacaccacccgcacagacgtatgcccgttttccagtgctttcttccaggtcgctaacgatttgtaggcttccaccgcttctttggtacgcagtcccagcacatactccagttgcatcacagccgcgacactccggtctttttgctccacctgttgaaaaatgtcccggaacgcagccggtgccagcgccattttagttcccttgcggctggtatccgcgatacccaatgcccggttactcaggcgagcattatcgggatcaaccagcttatgctttcccgcctgcgctaaaatggctcgcagcaccgacatttcattttgcagtgtccggtgactgagattgttggctttgcgctcagccatatagcgctcaatatatttcaccttcaggctatccatttgccggagtttgatgccattgtttttcaaataatcaaggaactgccgggccatacgctcacgatccgccaccgtaacaaaacttccgcccgcctgtcgggcatgcgtgataaaggcttttctgaactgctcaacctttgaacgtgtcgatccctgcgccattcccgcctctcttgctactttttcatttttagtcgtttttaaaacaattccctgcgtgtcggttcaggttcaccgttccgtggtgcgtcagacaatgtgtagcagggcgggattgtgttgagttattgcaggagctcgcgacgtgctcagcacagcgatgacatgctccccgttcagggtctgatcagctcaggatgaacgcctcattatcttgacgtgatgaatttctccttaatttttactgcatcagcctgctatcaggcagtgggttgaaaatcagatatgacgatcgtttatcaatcaaacaacagggtggttaatggtctatttttagtggtttcactgagtaatgcagggttcaaatcggtcgtaaagccagaccggacgtgctctggacgttggccgctttgcggcgtcacttggtaatctctgcgctgttacgcaagtgaccccgcataacagtggacgctgaaatcattgacgccctctgatcttttcgcgcaatcgctgtacagagatcaggacgtttattgtcagtgttcaaaacgcaggttaatgtttttcggaacgaggcaaagaatgctctgcccgtattgcgtgataagccggttgtgaataacaccgggtaactttcatcgccggacggagggttgttgtctgacgatatctgcttccaaaagtgcgcagatgtaccgcaatcttgctctcccttgcaggctacgagagttttgttttcgccactcagaagaggtgatccttgcaggcgatcagatcacaggtagtcacattcaggatggtagcctttgtatcaggccgggtcaaatgtcccttttatcatctctgacaaactgatcttacggagagagaataaggtgtatgctgggcattcaacgtcgaagcgcaatctggcttccttattctttaatttctaaagtttttttatatttaataccggttaactctgacaaaccaacctcttttccctcagtgagaaagaggtttctgcacctcaggttgtacaggtgaagacaatgctcacacatgtcagtcacattagccggatttctgattgccttgagcgtcctgacggcgtatttaccacaccggcaccgcacgacatagatggcactgtttttatggttaccccgttgtgataaagggcggacacctaacaccgtcaaaaagccatattcataaccctggatctgcatcagtatgttgattaaattgggctctcttttatttaaacgcaaatcatatgtggttttataaggaataaaatgactggattgtttttgactttttttgctcttatcctttttatcagtattggtcatcactttccctgatccatttcagaatatattaaagatgttccaatttaactgctttcattattaattcaatagcgaaaaaaccaaactgaataggtaagccgggtccggccctgtttattttcattatcataaacggcgaagcctcaatgggttcgaccattgggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataaacgggggaattcgtgacaccgctcggatcctgaaagtcgccaccgccaccgtcatgaaaacattaaaaacctcagactccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttacgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgacccagaaagtgacactggactccatccgggcgttgcaggcggcgatggaggggaagttggataaatcccagagcggggcagacattccgaacaaaccggagtttgtgaaaaaccttggtttggggaatgcgctgaaggtgggcgattatggtgttggctctaataatttgtctaacaaaattgctggctatctttgggatgttggcggaaaccagcccagcggattttatggctactcaccgagctcacacaaagatgaggtgtgggggtcattcataaaattgcgttggaatgatggaaaccaacagtatctggtattccctaactttggcggtaacgccatgagaattgttagattttctggcggtaatagctggtcagattacactgtttggacaacgggcaacgccgactttgacggcaacggttttctcaagaagacctcccccatcatccaaatccaccccgatggcacctttaccactaacgacgaatccgaaggggcaactgtgaccagactcggccttggtcactacaaattatccggtatccttggctataactcagacggtgcatggggtgttcatggcggtatcagtgttccccgtgacgtcaacggcaatgagttagtgtatgtcgatgataaggtgctgccggatggggctattgaaatcagggtgacacaccgacagaatgcacacatgcctgcccggttacagaacaggcgcatcaagtcacaggatgagcagacgcactacaccgatgatgaggcctgtgatttgcccgcagggactcggttagacgttcgtgtccagatgccggaggattctatctggaaccagaagcaggtattggcgcctgatcctcagcaggagtacagcgtcacgtcagtcgtcaataaatagccaataggggagactagggggtagtggggtgggtgctaaaaagccctcaagggagggctgattgggattaatttggtaggtaacagtaagattgaggtgcagtgattcgctttcctaattgttcactaagctcatctaatgaaattggataatcgtacttctgtacgtagcctatctgtattgcgaatgctttatttcttcttttaaaatattcatcaaaaaaaattttacttatacctgagttctgttttgttatgcgccataaagatgatggcgtatcttcaagaatatgttcgatattaaattcaccaacaactttacctacaggcttggttgcataaattacaactgatttgacagatgaatttttgaatattcctttcctaaattcatatttcttagtgccttctagtattttttcaacaaattcaggctttatcgataataatattttcatctgtttcacttaaagttattattctatggaattgttcatcggttaatcttagtataccccaccgatcgttagggtcaagtcctacattttcaatgagtgaggctctatttaatcttttaggtaatgctaagttataagtaaacgttattataaatggatatttcttatgtatgtagaatgcttgcaactgttcttttgtaaatacagaatattttatacagtaatcaatgaaagcatcttcagatgagaaattagtaatattttgtacattttcaacaacgcagattgatgaaactactgaattgtaataagctgccgaccttccatccgatgtcctataaatcactaaaatatcataaggttttaaggatagtacgcctttcattccgcatatgtatactttcctaatactatttgtatgtgatatatcttttaatatatctggtgattccgttattaagcgggaatcagggaaaaggttagtatggaactctggatatatagctaacaaaaatttattttgtttatctgtgtttagaataaatgggtaatctgaaagtacatccccagttgaacatgtgtctttcatacatttcaataaaacaatttcttttccattttccgtttcttttattgcgcattcattgaaaccatataatttaaataatcttattaagtagttgtgctcctcaaaaaccgtaacataaatatcatcaactccatatgagagtgcgttatcaaatatttttttcaagaaacgctgaccgcgtagcgttccctttggattaaacttgaatgttccaatttttaaatgttttcctaaagatattggcggggtaacatcatctataattccatgttctatttttaaatacataaagccatcaattttttcattttcattgaacaaaacgtaagcttgctcagaggaactatttgatttcttgtaaaaccatgcaacaaatccatgtttataatcagattttaaagatgaaaaaaatcatcattaatattaatttcactgaaaggtaaatattttaaattatccataattcctctctaccatttaaaagaaaataccattaaagcaccactataatgccatgatactaaatcacctccgctaatatgttgatcagaaaatgcctaatttgtgagattatggacataattaattctcttagagatcaactatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtatatttctccttgttgtgactctttattcgttagtcttaacattatttctccagccaaatcattattttcccttagaattacggcaagccttacctcatctccattattattaaatgcaggggacataactctattgaattgggca

SEQ ID NO: 14977 - DNA, 114885 bp, Xenorhabdus bovienii
  unsure (1)..(114885): unsure at all n locations
  Genomic contig Name=Xb4151_4152.C436
tccatgcaagatgtggccgtaactacatgtagaaggcacgctaggagccaggtgacgggacttgctccccgagccgaggtcagtcgcagataccagctggctgcaactgtgtaataaaaacacagcactgtgcaaacacgaaagtggacgtatacggtgtgacgcctgcccggtgctggaaggttaattgatggggttagcggcaacgcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaaccttgaaccttgatgtgtaggataggtgggaggctgtgaagtgtggacgccagtctgcacggagccatccttgaaataccacccttgaatgtttgatgttctaacgcaggcccgttatccgggtcgcggacagtgtctggtgggtagtttgactggggcggtctcctcccaaagcgtaacggaggagcacgaaggttagctaatcacggtcggacatcgtgaggttagtgcaatggcataagctagcttgactgcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacctgacaacaccgaaggtgttttggtgagagagagagacgcagtttcaaatgaaaaacagcagcttgttcgggattgaacacagaatttgtctggcggccatagcgcggtggtcccacctgatcccatgccgaactcagcagtgaaacgccgtagcgccgatggtagtgtggggtctccccatgtgagagtagggcactgccagacatctatttagccagagaagccacccaccgggtggcttttttgcgtttgagacattttattcgttatttttacgagtataagccgccaatactgttctttctgataactctagataatctttcatctttttagctgctaattctgtctgaccagaatctaaaagctccagtatatgtgcatttttatcaatataaggggcatacagtagctcaggatcattcaaaagcccaaaagccaaacgaagttctgctgagatattgcggtagaaagtaatcaatcttttactgtcagttaattctacaattgcggtatggaaatgcatatttgcggtgccgacgccaacccaattttggttattccgatatagttgcgcactggtcacggcctctttcattttggcaacgctggggtgcatggaatatgcctgagtgagagcctgacattcaatcagtcgtcgaacctgatagatatcaataatggatgcaatatcgggaatcgctacaaatacaccgcgattgggttggtgtttcagcaatccttcttgcgttagaacgcggaatacttcacgtaacgtattgcgtgaaatctcaagctgttcactgagaatggcttctgataagcgttgccccggtaacaactccccaataaccaatttattccgtattgtttcagcaattttcttactcaaaatttggggagaattctcttttttcatagtcatccattgggtttatagctgagaaaaagcgctttcgatgatcaaaagttaatcttcacatattccctgataaccagcaagttaccgacattggattattatagggaatgtattgcactgaaatgatgcatcttggtactttccttgataattgatgttgaaaaagtgatctgtattgaacttttatcacctataaaacgattctatttgctcattttctcaacatgatctatttattgttcaacaactatatgtgaaatatttaacaataatgttatttagttccacaatgtatgaatattgcttaggaaataataaatacgataacaatgacagggggacatagcctatggcaatacaggaaacagtaaaacaagaaacggttaattttgtggtaaatcggcggtcgtctttaatggccgcggtttttttgatggcaacatcggcgattgggcctggtttcattacgcaaacagcaacatttactgcaacgatgggtgccgcttttgcttttggtattttggcctcgatcctgattgactttgtggtacagcaaaatatttggcgaattgttaccttaaccaagatgcaatcggccgatatcgccaatgcagcgatccccggaagcggttatttattggctgcactagtgatgtttggaggattagttttcaacgttggaaatattgctggcgcagggttggggcttaatgctctgattggtttagaacctaaatggggcggattattaagtgccttgatggcgatttatatttttgcctcgcgtagggctggggttgccattgatcggattattgtcgtattgggcgtagttatgatagggctgactctgtttgttgcgatagtttccaatcctcctgtgggggaggcgttgcggcaaacggttctgcctgatgacatcaattttgcgactattacgacaattgtggggggaacagtcggtggttacatatgctatgccggagcccatcgtttgctggataaaggtatgacaggcgtagagaacattgatgctgtatccagtgcggcaaccaaaggaattttagcagtaggactgatgcgttattttttatttttggcaatattgggagtggttgccagtggtgtcacactcgatattgccagtgaaacggcaaatcctgcttcacaagcttttcaggtcgtagcgggtgaatttgggttgcgtatttttggcttgattctgtggtctgcggcaatcaccagtgttattggtgcggcttatacctctatctcttttgcccgcgtatttaaaaaacagttgactgatcgtcatctcaatataattactctctgttttattaccctctcattagcagtttatttattgataggaacacctccagctgctttgctggtgtttgcaggcggctttaatgggctgattttaccccttggtttgactatctttgtttatgttggctggaaacgggctgatctcatgggaggataccattatccccgctggttactatggtcaggggtcgtcacctgtgtactgacatggtatatgggagcgatgtctattagttcaattttcgcttttctgaaagcagcttaagagaataataatgataaaagcaattgatttaaatagtgatcttggtgaaagttttggtcagtggaaaatgggtaatgatgcaaaaatgttgggtattgtcagtagtgcaaacgtcgcttgtggttttcatgctggagatccggtaggtattttgcagacacttaaatctgcaaaggaaaaccaagttgctatcggagcccatatatcttatcccgatttagtcggttttggtcggcgtaatatggatattgccagccacgaattgacagcagatgtgatttatcagattggtgctctgcaaggtttggctctagcagcagggacaagtgttcgttatgtgaaaccgcatggtgcgctgtataacacgatcgctaataatgagcgtcaggcacttgctgttattgaaggcattttggtgattgatcctaaccttgctttagttggattggcaggatcaaacattctccgattggcacaggaaaaaggtttgaaaactatcgccgaagcttttgcggatcgtgcttataccgcagaaggggagctagtttcccgtcgtgaagccggtgcggtgttacacgatgtaaatctcgtcgcacaacgcatgttgcaattggtgactgaaggtggagtagattccatcgatggcaaattcacacctatcaaggcggattccatatgtgtgcatggggatagtccgggggctttggatatggcaaaacaggtaaaaaaagttctgcaacaggcagggattaccattcagtcatttatccacgcataatcatacgggtttatgatctcaggagatcactttgcgttttttacttgttaatttcaatacaatacttgttgaactcagtggattgccagaaacattggcgttgtttgattcactgagtattgttccggtattggggattgaagagattatacctgcggcgagaaccctaatgattcgttttcgtccaacgaaaatctcaattcaccaactcgtagcagaaattggccaccgtgacttgcatgagtgcagtcatcctcaaggaaaacagattgaaattccggtgcactataatggtgacgatttagcggaagttgctgaaatactggggtgcacggctcaagacgttatccgccagcataccgaaaacgaatatacagtggcttttagcggatttgcgcctggttttgcttatatggtatcggatatggcacagtggaatattccccgtcggcaaacaccaagaacccgtattcctgcgggtgccgttgcactggcgggagaattcagtggtatttaccctcaggcgagtcccggtggttggcagattatcggcatcacaaccgaacgtatgtgggatctttcccgtcctgatcctgctctattacagccgggttatcgtgtcaattttcgggatgctggacgtgccactgtaacggtaagtttgtcagagacctcacgcaccaatccggtttttcaatctgaaacttctcgctatttagaaatccggagtgtgggattgcaaaccctgtttcaagatttaggacgttttggcaaatcgggattggggatctcagaatccggtgctatggataaaagtgctttgcgaagtgcaaaccgtattgtaggtaattcttccgagcaggcgtgtctggagatagtacagggtggttttaaagcggttgcctgtgggcagatgatggttgctgttacaggtgcgctatgtcctattgagataaaaactccgcagggtgaactcattcatgtaagtgcttacaaacccattgacttaagtgatggtgatgaaattatcttgggaagacctgatgcgggaacgcgttcttatttggccgtgcggggtggttttacgatcccttctgtattatccagtcgctcatttgatacgctatctcatatcgggcctgagccactaaaagccgaagataaattggtcgtgggaacaacgtctcattgcgctgcggtgtctttttctgagacgcttgcttttgtgatgccaaataaaaatgagattgtggtattggatgtgctccttggccctcgcactgactggtttactcaagagtcgattgatttattacgaaaccagatttggcaggtgacgccacaatccaaccggattggcttaagattaaatggtgagtgttcactatcacgcattaagtgccaagaactgcctagcgaaggaacctgtgccggagccattcaaattcctgccagtggtcagcctgtgctgtttctgtctgatcatccattgacaggaggatatcccgtcattgcttctgtggcacattatcatcttgatcttgcaggtcagatcccggtcaacgccaaaattcgatttaatcccatcatacaatttcacgaattatcagggagtgaagacttgcgatgaacactattgtgaacaatgtaaataagaatccaaacaaagtgctgattgccaaccgtggtgagattgccgttcgtattattcgagcctgtcgtgattatggtgtgcagactattgctgtttatgcggatgctgatattaatgctcaacatgtgcaattggcagatgaagcttacggtttatcggggaatagccccgcagcaacctacctcaatattccacgtttattggcgatagcgaagcagtcgggagcaacgatggtgcatcccggatatggattcttgtctgagcgagcggaatttgcccgtgccgttatggacgcaggattgatttggattggccctaatccagaaaccattgatgaacttggcgataaggttaatgctcgtaagattgcccataaagttggtgcgcctttggtagtcggtacgtcagagccagtcaaagatgcacaggaagttgtcgcttttgcagaggaacatggcttgccgatagccattaaagcggcatttggcggagggggacgtgggctgaaagtcgcttggcgactggatgaagtggcagaactttatcactcggcagtacgtgaggcgacagctgcatttggccgtggcgaatgttttatcgaacagtttcttgataagccgcgtcatatagaagcacagattattgcggataaacagggtcatgttgtggtggttggcactcgtgattgctccttacagcgccgcaaccagaaattagtggaagaagccccggcaccatttttgactcaacaacaacgggagcgtattcatcaggcggcaaaagcgatttgtgcggaagccaattatgtgggagcgggtacagttgaattcttactaagcgccgatggaacgctctcttttttagaagtgaatactcgcttacaagtagagcatcctgtcacggaggaaacggcaggtatcgatctcgtgattgagcagttgagaatcgcggaaggtcatccattgagtattcaggagacaccagttccaagaggccactcatttgagtttcgcatcaacgctgaagatgcaggcaaaggtttcctaccgatgtcaggggttatcagcgaatttaccccgccttcggggcccggtattcgtctggattctggcgtgatcagtggctccactattcctgcgaccttggattctctgatggcgaagttgattgtcacaggcacaacccgtgaacaggccatctcgcgcgcacgtcgggcactacgggaattcagaatccgtggtgtggcttctgtgttgccttttcatcaagccgtgatggaacatcctgattttgtttctgatgagatcttcaatgttcatacccgttggattgaaacggattttgcgaatgagattgaagcgttaccacgccagattgtgacagaagataacagcatcacgcgtacatatattgaaattgatggccgcaggcatgagctcgggttgtctgccgatttatttgcgggattttctcatttggcacctgttagggaacagcaatcttcccagtctgcaataaaggaaaaaatgccggcagactctcgtcaggtgaaggcaccgatttccggtattttgcattcttggattgtgaaagaaggtgagcaggttaatgagggcgaactcattgccgtgatggaagccatgaaaatggaggtgcaaattaatgcacaccgtgcagggaaaatcacattctgtgtacaggcgggggattatcaggatgcagaaagcactctggcccatattgaatattgaatcggtaggaaataacaatattgagttgtcagattctgcggtgattaataatcatactgtttggttaagacaatatctcagaaagtagctcgtgaaagcttaggatttccagaattctttgaaggaggggtttatgtcaccaaaaatggtgtttctgaattatttgttcaaacggcgaatgaacgagatgccgaattgcaggaaagagtgcttgagcgtcaggttcatgcactattaaaactcatcaacactgaagcactttatcgtcatcaaatccttcattctctccaataaataagcccaccttttgtgggcttcaaccaacctcaattacagcgtaaacaccccaatcaaggcaaccacactcaaaatagcggctgtaccataaaacacccctttactagctggaatatggatttgcagatcgtgcataccgtggtgcagacggtgcattccgcaccagagcggcaggctgatcatcagcaacaaaaagatgcggccaatgaaactctgacagaatgtcagaacacgatcataagagagggcttccggtgccagtcccaacgggatcagaaagcccagcagcagaaccatcgccggcccgacaatggcgctccacataccgccggcaccaaatagaccccagaaaatcggttcatcggaacgcttaggtcgttgattcatcagatcctccccgggattagtaaaatagtgcaacgccgagaatcacggcggtggcaatgatagtgattgcccataatagtttgataatcggctccggcgacattttttcatttttgacaatgatattgagggctttcggagccagttcaaaccacgttttcgtatgcagcaaggtcgccagtaaggtgatgatattaatcaccagtaccgccggatgttgcagaaaagagacaaaacccgcccaactttctggtccatctttcagggcaaacagaccatagagcaccagcaggctgaaccaaatggcaggaatggcagtgccttcgcgtatcatataaaaacgatagaagctcaatttatgccaccaatgggattccataccgcgcacataaggtttacgtttagtcgtcattactctctcctccctcattgtggtttcagcatggagataaggaaatctttggcactttccgctttgctctgctgaattgcacccgccggatcgacgtgttttgggcaaacttcagagcagtaaccgacaaaagtacaagaccacacgccattgtcactgttgatctgaggcatccgttctttcttgccgtggtcacggttatcaaggttataacggtgtgccagcgtgactgcggcagggccaatgaattcaggattcagaccgaattgtgggcaggcggcatagcacaggccgcagttgatgcagcctgaaaactggtgatatttcgccatttgtgccggtgtttgcacattcgggccatcagcaggcttgcgatcattaccaatgatataaggcttgatagcttccagactctcaataaagtgagtcatatcgacaactaagtctcgttcaatggggaagttgccgagcgcttcaattttcatcccttgcggataatcgcgcagaaagattttgcatgccagttttggcactcggtttaccatcatgccgcaggaaccgcagatcgccatgcggcaagaccagcggtaagacagatcgggagccagattgtccttaatgtagcctaacgcatccagcaaggaggtttgctcatcataaggcacctcgtaggtgacgaaatgaggttcgctgtcgatttccgggttatagcgcatgacttccattttcaggtttttcatctcagccattcgcctgctccttctgttgtttatcttgtgctgcggcttcaccaccatagacccgcttcgcgggtttagatatggtgattttcacatcactgtactccaaacgtggtgcaccttctgggttatagaacgccagcgtatgtttcaagaaattctcatcatcacgctctgtacaacctgcatcaaggcgctggtgggctccacgggactctttgcggttcatggcagaatgcgccatacattcagcgacatccagaccaaagcccagttcaattgtgtagagcagatcagtattgaacacactggaacggtcagtgatttcgatatgcctgaagcgttccttcaattccgtaattttatccatggttttctgcatcagctctggagtacggtaaatcccacagccttcttccattgaaatacccagttcatcacggattttcgcccagctttcaatacctttctgattcagcagcttattgagtttattttcgatatcacgggcttgtgcatccagcgcgttttcattggcaggtgtggtttgctgaatatgtctgacggcttcttcacctgccaaacggccaaataccaccagttctgccaatgaattggaaccgaggcggtttgccccatgcaggccgacggaagcgcattcgccaatagcaaacagtcctttgatacgggtttcacactgcgggttagtttcgattccacccatggtgtaatgtgccgttgggcgaacaggaattggttctttaaccggatcaacaccgacataggcttttgccaactcacagatgaatggcaagcgttcgagcagttttttctcacctaaatggcgcagatccagatgaaccacatcaccacgcggcgtcgcgatagtacggcctgcctgccattcatgccagaaagcctgagaaactttgtctcttggccccagttccatatatttgttttcgggttgaccaaggggcgtctctggccccatcccataatcctgtagatagcggtagccatctttgttcaccagaatgccaccttcaccacggcagccttctgtcatcaaaataccagaacccggcaggccggttgggtgatattgtacaaactccatatcacgcagtggtatgccgtggcggaatgccattcccatgccatctcccgtgacaatgccgccattggtattataacggtacacgcgtcctgccccgcccgttgccataatgaccgcattggcgcggatctgaactttcgttccttccatcatattcagtgcaaccaaaccgcgcacctgcccttcatctaccagaatatcgagcacaaagtgctcatcgaagcgttgtatttgcgggtatttcagggaagtctggaacagcgtatggagcatatgaaagccggttttatctgcggcaaaccatgtccgttcgattttcatgccgccgaaacgacgcacgttcacggaaccgtcttccttacggctccagggacaaccccattgctccagttggatcatttctgtcgggcagtgtttgacgaaatactcaaccacatcttgttcacataaccagtcgccacccgacacggtgtcattgaagtgaaagtcataggagtcatgagattgagtgacggcggctgatccgccttctgcggccacggtgtggctgcgcatgggataaacttttgagatcagggcaatcttgagttggggattggcttcagcggcagcgatggctgcccgtaagcctgcgccaccggctccgataatggctagatcggcattgaaggtttgcactgcgcttctccattgttcaagtgggtggttcaaatgaaatgagttaaaatcggctaaaggagctcatgcgttatcactcgtcactttctttatctatgttatttcacagtgatatttttcttgtttaagcgagtgttattgataatttgctatgccttaacgatttagggtcactatctgttactttttgtatggattaagtatagccaattgtaaagagagtaaatttgatataaatgcgggttttgtgggattttgccaaaataatgtgatatagatcacttttctgtggttttttaaattatttatataggaaattattcttattataaatataagtaaaatcattatgaaatatttgttaacactatctggaataatgctacgatagcgatcttcttatttctagaaaatagttttgtttttttatttttgacaataagaaattagattaatttcttggttttttttctggcagctatttttttgcacagaaaacatattattaataataattttggattgttttttaattaaatatttttatcaaaatcattaattagtgcttcgtcatagaaagtaaattaatccgaactttatgatttttttgatattgttctcaccgaagtcttgcgattcatagtgtataaattttggtttaatgtttactaaaaaattattttttatgtcccgctgttttccacatgaaggacaggggtattctgttcacttttatagtggagaatggcaagtaaaaatgatattcactaatctgatgttgaaaatttgtctagtggacttgatatgagtaaactgcgcgttttgttttattttggagtcattggaacatgaatgaagtcacggattggcagccaagtgcccctatcgccaatttattgaaaagggcgaagattcttgcggagatacggcgctttttcgcagatcgtggggtgttggaggttgaaacccctaccatgggtcaggcgaccatcactgacatccatcttgtgcctttccagacacggtttgtcgggccgggagcggcggatggtctgactctgtatctgatgactagccccgaataccacatgaagcgtcttttgacagcaggaagtggttccatttatcagatgggtcgcagtttccgtaatgaggaagcgggtcgccaccataatcctgagttcactatgttggaatggtatcgtccacattacgacatgtatcgcttgatgaatgaagtggatgatctgttgcagcagatcttagagtgcgaaagtgcagaatccctttcttaccagcaggtgttcattcgctatctggagattgacccgcttaccgcgagtaaagaaaaactgcgtgaagtggcagcgaagctcgatctcagcaatatcgctgatcaggaagaagatcgggataccttgttgcaactgcttttcactatgggtgttgaaacgcatatcgggcttgaaaaaccgacatttatttatcacttcccggcttcacaagcgtctttggctgaaatcagcaaggaagatcaccgtgttgcagagcgttttgaagtctatttcaaaggcatggaactggcgaatggctttcgtgaactgactgacagccatgaacagcgcctgcgtttcgtgcaggataatcgtaagcgtgaagcgatgggattgcctgttatgccgattgatgaacgtctgcttaaagcccttgaacacgggatgcctgaatgtgccggagtcgctttgggagtggatcgcctgatcatgcttgcgctgggtgctgaacggatcagtgaagtgattgcctttcctgctgggatttcctgacgcgactattagcgtcagaggttttttatccaacgattttattgctgaaggtgcagcttccggctgcacctttattgcccttcacctttcaaattgcagtgcggtggctgcaatttgaaatctattgggtatcgtattgattatttatgttcgtggcgtttttccagaaatttcacggctaagtcagggaaatcggtgaaagcaccatcaacattggctttgtcgaaaacgatatcgaataactgattgccgctggtggcatattttggcagttgatcgacacggatagtgtatggatgaacggcaagatggctggcgtgtgcttcttgcaccaaacccgttagcttaatgttgtttggtgtggagtcattggcgatgagcatgtgataatcagggccaatgccatcggcatattttgccacttctttcatggcacccggtttaaacatccagtcataactataatttacccatgagccatcttgtttctgctcataagtttctttccagtcggtgtaagcgatgagctgtatcaatttcagatccatgcccattttcggttccaactcatttttgatgcgtttgagttcattggcatcaaagcattgcagataaactttatcgctctttttggtgtagccgtattgtttcaggacttccagtaccttggcggtgatatctttaccttcctggtggtggaaccatggggctttgatttcagggtagatacctatgtttttgccagtagatttattcataccctgaataaactcaatttcttcctgaaaagtatgaatgctgaaatctgattttcccattgggaaacgtccgggatagctctgtacttttttacccccctcgatatcaaaaccttcggtaaatctcagggacttaatttccggcaaggtaaaatcaatagcatagtaacggccatcagcacgggcacggtttggaaagcgctctgccacatctgttacgcggtcaagataatgatcatgcagcacgatgagttcattatcttgggtcataacgagatcttgttccagataatcagcaccttgtgcataggccatagctttggctggcagtgtgtgctcaggcagatagccgctggctccacgatgggcgatcacaatcttatcagctgcatgtgcaataccggacatcgacgacgctaacagcagacctgccatgatggctttgataggggtttgcattggagttctccacatttatagtaatgtatagtaataaaaatcttaaataaaaatgatgttatttttttagcttgtttttttaaaacagcaagaagaatatgatgattattcaatgcagctttttatataaaataacgacataacacaatgctgaatactgattttatctgtggtatgtcacagttttatgacagtcgtgttcattctttaaacgtgctgttgaagttgtatttttgattcaatacgatatatagataggtaaactaataatgtcataaatttggtttagttttataaatatttaatctaaataactccttggaaataaaatgattatgaccatgaagagcaatatataaagtaaaaatcagtaatatatttaaccaaatatgacatgaataagtaaacctgtaattagggagcaatggattagttcagtcagttgggtttggcaattaatttttcaagtaaccgcagtatcagaagtagtactgcggtcaattttacgtgttattaccgtttatgtggcggcaatttactggctagctatacgagcgatttcctgcttatgtttattctcgcttaacatgacaaacaacagtagaacgacggacagggcactgccgccgatcatgaccataaatccgccgtcccaaccgaagaagtcaacggtataaccgacaatgatactggccgcaaccgaaccaccgaggtagccaaacaaaccggtaaagcctgccgctgttcccgccgcttttttcggtgccagttcaagagcgtgcaggccaatcagcatcactggtccgtaaatcaggaagccgataaccagcatacagatcatatcaatatttgggttacccgccgggttcaaccagaatacgatggtggcgatagtcaccagtgtcataaagaatacgccggtggcaccacggttgcctctgaacactttgtcagacatccatccacatagcagcgtaccgggaatacccgcatattcgtagaggaagtaagcccaggacgatttatccatagcaaagtgctttacttctttcaggtaggttggtgaccagtcgaggataccgtagcgcagcagataaacgaatacgttggcaattgcgatcatccacagcaatttgttaggcagaatgtattgcaaaaaaatctcttttgcagtcaattccttttcatttttgtccgtatagtcaggcggataatcgtttttatactcttctatcggcggtaaaccacaggattgtggagtatcgcgcatcaaggaaaatacgataattgcgacaaggatggcggcaaatgcaggcatataaaatgcggctttccagtcctggaaccacgccatacccagcatgaacagtaacggaggcaagccgccaccaacgttatgtgcacagttccagatagaaacgatcccaccacgctctttctgtgaccaccaatgaaccatagtacggccgcagggaggccaacccatgccctgaaaccagccacacagaaatagcagaacaaacatgacggcaatgctggaagttgcccacggcacgaaacccataaacagcatcactgctgcggcgagtatcaagccggcaggtaagaaaatacgtggattggaacgatcagaaacggaacccatgataaattttgagataccgtatgcaatcgaaatccctgacaaagcgaagccaagatcacctttggaaaaaccttgttccgctaggtgaggcattgccaatccaaagtttttccttactaaatagtaagccgcatacccaaagaagatccccatgaaaatttgccagcgaaagcgacggtagagtggatctatttcttgcgcgggcagccgggctttgtggggtgccggtctaaaaatacttaacatgtttgtctccacatgacttttggtgttagcgaattaccatctctgagcgatgatgatgttaaacgaagaattttcattaactattttctatatagaaggaaataatagccaaaataatatgctatatctgtgatgtatcgctgacctgtagatataatttcgcaaagaccgcaattttgagtgatttgttagagttttgaaatataatttaccgataatatagtgacctacgtcacaataaaacgctttgcttgttacttatgagcgtttaaagttcgtttatgttcctttcttaaagttaatccatattattggcaggggttaatactcagtaaatataaagttgtaaaaatatgaaataatattttcataaaatcatacagacataaattcataaataaagggtgacatttatcgtcgggattttaacgggctatcactatttaaataatgcctctgtttagtcgtgtagcttatttttatttacatgtttggcgttttttataacgcagttacaaataaaatgtttggatttaaaactcaaaataatagatattactacaagtaggtattcatattcatgatgtcagttatcatgaaattttgaacatctattttttaaaataagataataatatcaaggtaataccagattgtataaggcgtaatacaatctgtcagccaataaatagcctttttatttgtaggttaattaattaaagattacataataatattagttaataaaattattaaattagcatgaaattttatgcaatttatttttacgattcagttgaatgtcgacataaggtatttgcaatatctgaatataggcgaaaactgaatattaatgactaacagcattgatgtctccattcatcataaaaagtgatgaaataaaatggaagacagaaagagaacatcattatgaatacacacacacacaaggcaatattacacacagcattcactgagcaaacattttcacccgatgacaatattaacagtagtaatatcagtcataggatagcagcacttgaaccatggtttgataacgtgccatctcgcttggcaaaactggcgaaaacgataccgaatgacattgcggtttctgatccctatgaaaccctggtatttggtgaattacagcagcgtgttgaaaatgcagcaaatattttgcatcagtacggtgttaaaatggggagcaacgttgctattgctgccgaacggggaattccatggtttgttactatgctggcggtttggcgaattggggcggtttatattccccttaatacgatgatgccagaaaaacgtctgaatgatattctcgccagcctgtcggaaagtgttctcgtatcggatgatacggtatctgcggggctgaaggcatcaacattaatccctttgcacgcccttctgaataatacccgtgaaataattaatgatgaaataacagaaaacatcgatatgcctgcattgggtgatcacccggcttatgtgatgttcacttctggctctactgggttgccaaaagcggtacaggtgcagcatgacaatctggctgcctgtctgtgtgcattcggcaagttactgtcagtcaatcagcatgattgtatgctcaccctgacgaccttttcttttgatatctcattaatggaattactactgactgtcgttcatggcggcagtatctacattacatcaatcgatactcagcgtgatgcgatggcgttgtcgcaaatactgtctgatccccaattcacctttgcacaagcgacacctgttacttggttaatggccttgaatgctggctggaaacctcgttcagagttgagcatgctttgtgggggagaggcgttgtcacaggatttggccgatcaattaacggcatccggtggcactttatggaatctctatggcccaaccgaaaccactatctggtcaacagcatttcgcatgagaaaaggagataaggttcaattgggtgggccgatccccggcacaaccatcacaattgtagacaaatacttgcgaccggtgccgaaaggaacggtgggtgaaatccttattggtgggcttggggtgacggctggatatcgcaataacccgaccgaaacggctaaacgatatgtacccgatatgacacaaagaggtaaaagagcgtatttgaccggagatatggcacgtatgcttgaagatggctctctcatttatatgggaaggcaggatgatcaggtaaaagtgcgtggatatcgaatcgagttgggtgagattgaaaccgcattaagaaaacaaaatggcgtacaggatgcgattattcgtgttatcggcagtggcgatcttgccaaaattcaggcgtttgtactgttcgatcccaatagggttgtatccgaagattgggtacatgaaacccagatttcactcagggaagttctgcacgaagcctggatacctgccgaatattatcgtatcccttacatcccactgacgagcagtggcaaacgtgatagaaaacggttagacgaagtcgcagaacggttgaatgccagctatgacgttgtactgcctcaaacagaaactgaaaaacaggtttatgcaatttggcgtgacctgctggcgacagacgtattaggtgtcaccgataatttctttcaggttggggggcattctattttggttgcccgcatggtggaacggattgaaaaagccttttcactccggataccgatttcaggtatctatgttgaacctacggttgccagaatctcgtctattctggatgaaatgatagaagcgtatcaggcaaatccggctaatgccgggggagtctaccacagtgaggcgttaattcagcaacatgcagaaacgctcagaaaagatgtctacctgaaagaaagcgtgtgccctgatggcctgcctcatgcgaactggtatcagccggatacggtattgctcaccggcgctacgggatatcttggtctgcatttgctggaacaattgctgaaacagactgcggccagaattatctgtttgtgccgtgactctgatgaagaacacgcccgagacagaatcaaggccgggtttgacaagtaccagattgatgttgttaacggacttgagcgcgtagatgtcattatcggagatttggggcagccacgctttggcttgttaccggaaacatgggcacagctcgctgaaaacgttgatgtgatttatcacaacggggcgttggttaactttatctatccttatagcgcactgaaaagcattaatgtcgatggaacccgaaccgcgctggaatttgcctgcacagcacgactgaaacatttccattatgtctcttccgtgaatgccctgtttgccacagaatcaccccgtccatttatggaagatgatcgtactatgagcgaatcggtacgggatccttctggttactcaggcagtaagtgggtatctgaagggatcattaatattgcccgtaagcgaggtgtacctgtcagtatttatcgtccgggtctgatccttgggcatactctcacaggagccgcacaaggcaatgattatctcgttgcttccctgaaaggttatctggcaatgggcttttaccctgaacatggattgctgcttgatattgtaccggttgattatgtcgctgcatcgttggttcatatctccagtcaaccggaatccgatggtaaattctttaatttgtttaatccggttcaagtctcgatccggcaatttttcgattgggtacaggagtttggctatgtgctcaacccaatccccttcaatgagggtaaagagaagatccttgcactggatgatactcacccattgtacccattgatcccgttgattagggacatgacagagaaaccttatcgcgcgttagatccggcttatgttcatgaaattcacccagaactggagttgaagcaaacgctggcattattggccaacactgacattaaatgccccgtcattacggccggatatgtccatcaagtattgcaatatttgatagatacaggtttcttacccgcagcactgccagaaaacttcaagccggaggcctatcttggaacagctaacaggaaacgaagccatgaattggatagtcgtcgtgaacagcagaaaaaagtattcggtctggcctgaggcctatgtgcttccagtcggatgggtggccgtcgggatgacaggttctaaagaagaatgcctcaatcatattgccggtatttggccgaagccaacaaactagatgacggatattaagtcatattaataaatattcattattaatagcaggcatgctccagaagaagcatgccttttatttttcttccactctatgtgtgctttgaattcgtttttgttccttatcaaacaacaactgtagattttaaatatattttgccattgaaacagactccgcttataccccgtccttcagttagctaagacactcaataataatgtcttagctaactgaaggacggggtttttatggcgcattagataaattaatacagccaatccatgcccatgcgatctgcggccattattgctgcatagacctgttctggggtgactttaaacggcatattgtgaatagtttcaccttcggcacaactggccttggcaacttccatgattttctggtgcaatttctcactgtcccgcaagccgagttgctccagagtgacaggaagaccgacttgaacacagaaatcgagcacggtttccaactcttcattcgggctgttttccagcatcaattgtgccagtgtgccgaacgccactttttctccgtgatagagatgatgacattcctccagcacggtgaagccattgtgaatggcgtgggcagcggcaagtcctgcactttcaaaaccgataccactgagataagtattcgcctcaatgatattttccactgccggagtactgacacccgcttccaccgcgagttttgccttataaccttctgccagtaaggtgtcgtaacacagtttggccagagccagcccagtattggatgttgcaccccccgccattgttggtttatgagcagcgctatttgcccgggcttcaaaataggtggcaagcgcatctcccattcctgccacaagcagacgaaccggtgctttggcaataatacgggtgtccatcagtacgatattagggttttgtggatacagcaggtagccatcaaattcacccagctcggtatacagaacggaaagggcactggttggggcatctgtggaagcgatggtaggggaaattattacaggtagcctgcatgcatgcgctatagctttggcggtatcaagagtcttgccgcccccgatcccaattacggcctgacattggtgactcgctgaaatgtctgacaggcgtttgatttcgccacggctacattcaccgttgaagatctcaaaatggctggtgactgcgtgtgcttccagacttttgctaacggcatctccaatgaggctcattacgaaattatcggcaatcacaaaaacgtgatcagcaagtattttggtgtattggccgatgtgagataacgcacctggcccttggatatatttggatggagactggatcactttcagcataagaaatattccttcttcactggaaactcaacatgagctgtcataacactggcgtgtggcagatcattagcagtttcgaataaaagtatttgtttgcctgtccgccaacactatacgataagatatacagggaagttatgagccaaagcaggaaatgagcgatctgtgagataaaatcgaaagatttatttacgccctgattgattcggggcgtaatgttgcttcaatgatttttgaccagagttttatctgttgaatgagagaaagaaaatttcaggattaaattcaaaaggacaccataagctggcaggaagaaaagcatacagatgaacagcttgaaagcgtaatccaccagagcaatctctacccagtgcgtcgccatgaatgcatcgctgctgcgataaaatgcgataaagaaaaatgccagtgtatcgagcaaattaccaaaaaacatggcggcagtcggtgctatccaccagcggcgtttctgacgcaggcgattgaaaactcccacatccaatatctgaccaaggacataacccataaagctcgcggctgcaatacgggcaacaaacagattaaaggttcctaatgtcccgaatccctgccacgttccttgaaaaaatagagcagaaatgaaataggaaatcagcagcgctggcagcataaccgtgaggatgatcttacgtgccaatggtgcaccataaatgcgtacagtcagatcggttgccaaaaagataaaaggaaatgtgaatgctccccaagtggtatgaaaaccaaaaatggagacaggcaattgcaccagatagttactggaagtaatgatcaaaatgtggaaaagcgaaagccagatcaacgccgtggctttctgctgcgtggtcaaatgaaacatattgtacctttttgatgaatggggtaagggaacccaaaaaaacaaactttctttgcctgaatgatcaggtgaaacgcatcatacgcgcgttgcgcaacaaaagcaaagtgcggcagttgatgatattttgtaatataatccatcgccatagtgtgtttgaacctacagagattgttatgtccaatgtttttgctaaccctgacaaaacgcttgatacgcaggggttacgctgtcctgagccagtgatgatgatacgtaagatcgttcgccatatggatgctggccagacactattgatcattgctgatgatccggcgacgacccgtgatattccgggtttttgccgttttatggagcacgccttgattgctcaggagacagggcaaactccttatcggtatttgatcaaaaaaaacgaaaatgtagcttaggtgactggcagaaaaagtgggctgtgctaggcttttaatatggcacttggatagcatcaatcacctcactgggtgccatattttctttttccttaatagcatttttgagttactgtaattttgaaaaggtgcattctttgcaccttttcaatttatctttttgatcttttgattaagacgtctgggttcttaaccaatccgcggattaatcaatcatcgtttttgtgacttaacccgtagcagccggatggcgttcgctgtaaccagcgccgtggcacctgaatcagccagcacggccatccacagacccgtgatccccaatagactggtaataaggaatatcgccttcaagcctaacgcaatggtgatattctggcggatgttatagtgcgttgtccgggacagagcgatcatttcaggcaaaccggtcagtcgattgtgtgttaaggcggcgtccgctgtttccagcgcaacatcagtaccactccccatggcgacaccgatactggccgctttcatggcaggggcatcgttgatgccatcaccgaccatcatggtatggtgtttttcatttagctcagtgacggcttttaccttgtcttccggcaacagacccgcgcgataatcgatccccaattgagctgcaatagcggccgcagcacgagggttatcgccagtcagcatcacagcattgacgccttgttttttcagggcgcggattgcgtctatggcatcctgacgcaaggtgtcctgcatggcaatcaaacccacaaattgctcaccctgtaccacggcaaccgccgttttaccgttgctttccagctctgtgaccctttgtttccatgcggtggataacgtgttttccggcagtcgccccggagccgcgaccagaattttctgccctgacaatcgcccttcaaccccgatcccagccaacgctttacggtgttcagcttcgacaaccgtcacacctttattttctgccgcgttgaggatagcttttgccaatgggtggtgcgagccactttcgaccgctcctgccagcgccagcagtgtttctacgctgatgttttccacgggttctatttccgtgacccggggttttccttcggtcagtgtgccggttttatccaacgcaatggtggtaactgaaccgagctgctccaatgccgctccgcctttgattaaagcaccacgacgggtcgctgccgccagtgcagaagtgatcgcggcgggtgttgagataaccagcgcacaggggcagccgattaatagcagggtcaatccacgatagatccaagtttcccaaggctcggcaaggaggaggggagggattactacgaccagtacagagaacaagataatcagcggtgtataaatacggctgaatcgatcgatgaagcgctcaatgggagcacggcgctcttccgcttcttctatcagttgaagaatgcggtcgatggcattgtgtcccggttcagagaacactctcatttgcactgcgctatcgacagagaggcagcccgcagcaactttttctccctgctggcgttcaactggaatagattcacctgtcagagcactttcatcaaaactggcgaacggactgagtagttcggcatcggtaggtaaacgggcacccggcgcaatttcaataatatcccccggacgcaggtcagcagccggaacggttttcttttctcctcctgtcacccgcagcgcctgttcaggaaccagagccatcaaggcactgacaccacggcgggcacgccctgcggcataagattccagtacttctcccactttgaacagcagaataaccattgctgcctctgcggtggcatcaatgaatagggcaccgatagcggcgacactcatcaaggtttcaatggcaaagggagttcctgaacggatcagtttgatggctttggtggcgaccgggtataacccaatcaacgtggtaacaatgaatgcaatctgtccagcgggtggatttatttttgtaatgccccaactgatgaccattaatgctataagaatgagaattggggaaaaggttttccagtgatttgctgctggaggcaatctaatcgtcgaatccgtttgcttgatttcaaaacccgcctgttttaccgcttgttcgacggctgcgcgaatatcagaatcagcatcgaccaccagtttttccgtagtaaacagcaccctgacctgtttagcttcaggcaattttttaaccgcattttcgattttgcctgcacagcttgggcaatccatgccgtggattatccagttaaaacgctggttggcggttaattcaagaggggttgtatcctgtatggtaggggcatggtcgtgtgaacagtgtcctcgatcatgttcatgggcgttgtgtgaacttttatcttctttgccatgaacgccgtgggaatgtttatggtctttatttttgtgagacaaagagccgtgctgtgattgcttatgttttttgaatatggagaacataggcggcctctcaatagagttaattcaaatgggttacagttcactctacactctggagtaagctccagagtcaaacttaaaacaatgaatttttttgatgatttgtgctttttgaaatgaaatcatttatcccctctttttttgttatttgatcagataaccagtgagtgaataatcaaaataaatgataccgacagaataccgtcggcatcactgacaccaaatagaaagggaatgggacgttattttttatcttgacgctgttttttttgccaagtaagtaactcaaacacaccaaaaaagaagatcttggtctgaagaaaaacagaaaacttttgatctttgggttgggagttttttaatagtaaaagttggaaggcatgcattatcactgtgaaaaccatggcgatatccataaaatatctcaatggtttaggaaagggatggatcaaattgaaaatcataattccccaaacgagaaccatgataacttttcctaattgaataaacatcattaactccaaaatcgtatttaagcagatctgtcgccagactgctggcggcggatatacagtcggtaagcaacttggccggcaattttttcccgatgtaattgccagtttgcgggggcttctgttgcagtagattctgattccgcttcaacataaatccaactctcttcagccagccaaccgttggcttccagtaagttgattgtttcaacaagcatccccttgcgaaatgggggatcgagaaaaaccacatcaaaaggtgtacctgtctggttgagatattgcagggtgtttccctgtaccacattagcattttcggccttaagtaaggctaaattggctgataattgttttgctacatgacgatcatattcaagcaaggtcgcgtgacttgcgttgcgcgataaggcttcaatcccaagtgctccgctgccggagaagcaatccaggcagcgagcttcctgaatgatgggcatcagccagttaaagagtgtctcacggacacgatcagtcgtcggacgtagcccctcactatcaggaacgggtaattttctcccgcgccattttccgccaataatgcggatttgtcccaaagacgcactctgtgattttttagtcataatttatatagtttaagcatttgtcatccgatgctatttgcataatagacggcggatacaaaaaatgagaatgaagaaacatattgattaatttaccacgaaatccacacatagatatgtgttgtgatgtgatgaaaatgttagactggattttatcaccgttagaacctatcgcagcaggcgtagtggttgaaaaacaaagcgtctgcggcgataggtttttagcttatcctaataagtattaattgcacccgcaaacgggtaaagaaaatagcttaatgggataggttgttaaacgccataattaaccgcgaggagtgtagtgcccaatggcagaagagcaaaaaaaaggtttcttctcttggtttggacgtggtcgtcaggaaaagaaacagcaagaagaacaacttgaacaagacaaatcagcggcggaagaagcggagcagcaacgtttagccgaagaagccgcccgtcgcgcagcggaagaagcggagcagcagcgtttagccgaagaagccgcccgtcgcgcagcggaagaagcggagcagcagcgtttagccgaagaagccgcccgtcgcgcagcggaagaagcagagcagcagcgtttagccgaagaagccgcccgtcgcgcagcggaagaagcagagcagcagcgtttagccgaagaagccgcccaccacgcagcggaagaagcggagcagcagcgtttagccgaagaagccgcccgtcgcgcagcggaagaagcggagcagcagcgcctaatagaagaatcatccatattacccaaagagcaggatcgtccgagcaaagaaggcttttttgcgcgtttgaaacgtagtttggtgaaaacccgccagaatctgggttccggatttttagggttattcagcggcaagaaaattgatgatgatctgtttgaagaattggaagaacagttactggttgcggatgttggtgtcgaaactacccgtaagatcattaacaatttaaccgctcatgccagccgcaaagaattaaaagatgcggaagcgttatacacgaaactgaaagaagaaatgtcagatattctggcaaaagttgataagccactggatatagaaggtaaatcaccttatgtcatcctgatggtgggtgtgaatggtgttggtaagacgacaaccatcggtaaattggcgcgtcagtaccagtctcagggcaaatccgtcatgttagcggcgggagataccttccgtgcggcagcagtggaacaattgcaggtctggggagaacgcaacaaaatcccggtaattgcacagcataccggcgcagatccggcctcagtcatttttgatgcgatccaatctgccaaagcgaaaggcgttgatattctgatcgctgataccgcagggcgcttgcagaataaatcccatctgatggaagaactgaaaaaaattgtccgtgtgatgagaaagctggatgaagagaccccgcatgaaattatgctgactctggatgcctgcacaggccaaaatgcggtcagtcaggctaaactctttcatgaagcggttggattgacggggatctcactgaccaaactggatggtactgccaaagggggagttatcttcgctattgccgaccaatttgatatccctattcgttacatcggtgttggggaaggcattgaagatctccgtccatttaaggctgacgattttatagaggctctttttgcccgagaggattaactatcaatgattcgctttgaacaggtcagtaaagcctatctgggagggcggcaagcgctgcaaggggtggattttcatctgcttccaggggaaatggcattcttaaccggtcattcaggagcgggtaaaagcacgctgttgaaacttatctgcggtatagaacgcccaagtgcaggccatatttggtttggggggcatgacatcagccgattaaaaacccgtgaaaccccttttcttcgtcgtcagatcggcatgatttttcaggatcatcatctcctgctggatcgcacggtttacgagaacgttgctatgccgctgatcatctcaggggcaagcgccgaggatattcgccgacgggtatctgcggcgttggataaggtaggcttgctggacaaagcgaaaaattttcccattcagctttctgggggggagcagcagcgtgttggtattgcccgcgctgttgtaaacaaacccaccgtcctgctggcggatgaacccacaggaaatctggatggggaactgtctgaggggatcatgcgcctgtttgaagagtttaaccgcgttggtgtgacggttctgatggcgacgcatgacgtagctctcatagaacgaagaaattaccgtatcctgacgttgaatcaggggcgtatgcaaggaggacatcatggttaaaaatgtccgtcattcagcgaaaaaaatgacaccgcctaaacccaagtccaagtcactgaaagggggctggcgcgtacagcagcgttacgcgtggaaaagcaccttgtcagatatgctgcgccagccgctggcgacgttgctgactatcatggtaattgccatctcattgaccttaccgagcgtgttttacattgtctggaaaaatgtcaaccaagcggtggagcagtggtatcccgttccgcaacttacggtctatctggataaatccttgaacgacggcggcgccagacaggtgattgagcagttgaaagtcattgatggtgtgaaatcggtgaattacctgtcccgtgaagaagccgagaatgaatttcgtgcatggtctggctttgccggtgctttaaatcttctggaagaaaacccgctacccgcggtcgcgattatttcccctcaaatggattttcaagattcgacggtattaacaacattgcgtgatcgggtttcccagatcaaaggtattgaagaagtcagaatggatgagagctggtttacccgcctcactgccttagcaaaccttattggccagattgctgctgtaataggtattttgatggtggttgcgctgcttttggttattggtaacagcgttcgtctcagtatctttagtcgccgcgaaactatcaatgtcatgaaactgattggcgcaacagatggctttattctgcgtcccttcctcaatggtggcgtattgctggggggattaggcgcgattttttctctgatcctttcatcgttactggtttggaaactttccaatgtcgttacggacgttgcaggtgtttttggtactacctttaaattgtacggtttgggatgggatgaatccctgttgctggtactgatttcgggcatgataggctggcttgcggcatggtttgcgactattcagcatttacgccgtttcaggccggaatgagtccatttgttggtcttcaggtgaacttttgggctgcattacggtcgaagaaattgtggtcgaaagtacagttagcaatttgtatccatattcataccatttagatgatttgaatatgagctctatgatggtaaaatagacatatctttggcttgaataaaccttatcggtgggctcaggcaaaatttacaaggccatcaatttggatctgatttgagagaatttgaatgacaaaagaaatgcaaactttggcactagttccacaaggtagtttggaaggatacgtccgtgcctccaatgcttatcctatgctctccgcagaagaagagaaagaactggcagaaaggctgcattaccagggagatctggatgcagcgaaaaagctgattctgtctcacttgcgcttcgttgttcatgtcgctcgcagttattctggctatggtctgccacaggcggatttaattcaggaaggcaacattggcctgatgaaagcggttcgtcgatttaatccagaagtaggcgttcgtctagtttcgtttgctgttcactggatcaaggcagaaatccatgaatatgtactgcgtaattggcgcattgtgaaagtcgcaacgacaaaagctcagcgtaaactgttttttaatttgcgtaaggctaaacaacgtctggggtggtttaatcaggatgaagttgatttggttgccaaagaattaggggtgaccagcaaggacgtccgagagatggaatcccgcatgtcggcgcaggatatggcgtttgatatgtcctctaatgatgacagtcatgacagccagccagtggctccggtgctctacttgcaggacaaggcttctgactttgccgatggtattgaagaagacaattgggaaaaccacgctgcggataaactttctatggcgatagaagggctggatgagcgtagccaggacattatccgcgcccgttggctggatgatgacaacaaatccaccttgcaggaactggcggataagtatggtgtatcggccgagcgtgttcgacagctagaaaagaacgcaatgaagaaattgcggctggcgattgaagcgtaaactcatccctgacgaattaaaaagcgataatttatttatcgctttttttgtgtctgctgccctataagacgttaatgggtttcctcatatcttcagtctccacttcaatctttggtgtaggtgttgctggccagaagcatcagagcatagaggacattgctatgaaaatcgtaattgctcctgattcatttaaggaaagcctgagcgccttgcaagtagcggaggcgatagagcaggggtttcgggaaatctttccacaggcagcttatatcaaattgccaatggcggatggcggcgaaggtacggtggaatctctggtggctgcaacgggcgggcagataatttcatgttcagtaaccgaccccttggggcagccggttgatgctttctttggtttgctgggggatgggaaaaccgccgtcattgaaatggccgccgcttctggcttacatcttgtgccgatggaacagcgcaatcctttgataacgacaagttacggtaccggagaactcattctggcagcgctggaacacggtgcgcagaaactgattttgggtattggcggtagtgcgaccaacgacggtggtgcaggaatgatgcaggcactgggtgcgcagctctgggatggtgattgccgtattctgccattggggggggcggcactaacccgattggaaagcatcgacctttctggtcttgatccacgtcttagtcagcttgagatcactgtagcctgtgacgtgaagaactcattatgtggtgaatcaggggcatcagcgatatttggcccacaaaaaggggcgacaccggaaatggtcaaagcgttggattcggcattgcaccattatgggatgaaaattgaatcactgacggacaaaaaagtgattgatgttgcgggaacaggcgctgcgggaggtatgggcgcttccctgttaggttgtttgggcgcgaaattgcagtcgggtattgagattgtcattaataccctgaaactggaagaggccattcagggggcggatttggtgattacgggtgaaggtcgtatggatagccagaccatacagggcaaaacaccgattggagttgcccgtgtcgccaaaaagtttggtattcccaccatcgctttggttgggggaatgagctgtgattaccatgttgtgcatcagcacgggctggatgcagtcttttccattgtaccgggtgcttgctctctttccgatgcccttgccaatagtactgataacttacgggtaacggcacgtaatgttgcttcggtctggcgtatggcttattcgtaataataggcattattttgtgcatcatagcggaaatcgcaggcatccataaaatcccgcaacgctggagcgtggatatcaggaaaatgattcaggctccattcccaacggttgatctccgggaatgcggccttgacctgctccagcagataagccccaacgccacgccgacgggtcacttcccgtacacaaaaatcttccagtattcctgttgatgaattgagcgtcactttaaccgcggcaagcaatcggccgttaaattgtgctacaaacagtttttgatcacctgctaacagcacttcccactcctgcgtatcttgttccggccaaatttttttcaaatcaatcttatcctgctgggataaaacacttattggtttaattgttaacttcatatattcaccgacctcaatgaaataaattccaacattaatcgtaatttatcttactttttccaatttttttggcaaaaaattttaacagcatgaattttctaagttaaaaattaatcccactgcatatcagtagcacatcataccattctttgaacaaaatctgctttggcacgggttccttccgtggggagcagtaccgctctaaagcttttaatggtgaacgcattaactcatcaaactaatttattaatttcaaataatgatattgagaatctctaatattttgcgatgaataaaggggaataaagacacaatatataggctttttttgggtttgacataccctcggcaacgtatatattaagcatttatttttaattgataagaatttataaagatttttcacttacctgaaattaataaactcaacatataccttatgtatttcaggatgccaacaacactgcaacttgaaggacgggtataaaggcaaagtggtcattctcacaacatgccgctttaaggaaaaggagtcagttgtgaaatcgtttgaatattattatcagcaggaatttgattatttaagacaactagcaaaaattgtgagtgaagaaaaaccgcaccttcgtgatgtactgggtggtggggatcctgatgtcgaaagactttttgagggtgcttctgtattaacggcgcgcctgaagcacaacatcgaggatggctttcctgaactgacgcggccattgttgcaaaaattacgtgcccagccgctgaaaggccttcctgcaaccagcattatccagttcgacagtcatggacagggagattccgatttttccatcccggcaggaaccgaggtttataccgaggccggtcagccatttgtgatgtgtcgtccgtgcccgattgcccccctgacattggtttcccgtgaaatcatacatcagatacaggcgaccaaaatcatcctgaaatttcgttacaccggtaaagacgcggagtggcagaccagaccgataagcctgttcctgagcagtgacgagccagtcgccgatatactgatgctggggcttatgcagtattacaccgataccgagctgcaccacaacggccaggtttataaagcgcagggagagcggtttgaagcccgttccggtgcatcccgtctgacactatcatcggccaaagatgacaattgggcaccccagttgctcatagaatcgctctatctgccccatatcaaccagtttgtggatttacccctgccagtaatggcgaaacaactcaaactggcggaacatcgcgaattcagtgtggaattgacattaaatacgctactgccgttatcggcggaacaaatcgaatcggcatttcagctacattgtgtccctgttgtcaacatgaagcgcaactgtcaggtcacactgccttttgccgccgaaaccgcccgttatcctctgccgctggcactcaatcagggaattttgcatatcgctggcattgagttgaaaaatgagccgggcagtgaagaagagcaccgtgggggtgagtatctgttctatccggcaagcctgttgaccggcatggagcgttaccactcggaatatgataacgccggcttctacgggcttgaaaccgcccatgatgaatggaatggagtccgctatcaggtagtgttctatgacagtgaaggaaaattaatgcataaaccgcctgagcgcgaatttatctgtcatttttatggttttgaacagaacctaccccccctgatatccggggtgatttctctgggcggtgagaatgttcccgagattttgcaattaaaaaacatcacgcccacttcacgcacctatccccccattaccgacagcctccgctattggcatttcctgtcacactatgccacgggcagctatgccttagagagcgtacgatcggtcagacaactgttgcaggattttgacctgtaccccgagggggatcgcccggtcagccgcagcatccggcgcatgattgacgggatcagcaatatcaccgcgaaatggggcgacaggcttatccggggcagacccgtccgctgcctgcttatcactctggaaatggatgaatcagcctataccagtgccggtgaaatgtaccggtttgccaacgcgttataccaattcttcccgttctgtcttgcccagggatcgtggctgagaatgcgtgtcatcagccagccttcagggacgcaatggtatctgtcaccttcaatgctggaaggttatcgctcaatcatgtaaggaatttctacaatggatggattagtttttacctgccggataggccgactgccgcaaaccacctttcaggtcgtagatttcagtttacaggaagggttatcgcaactctttcacctgaccatgaccgtcgtcagttcactgaataatgtggcgctcagcgagcagcttggtaccagcgcttctctgaccgtcatacgtgatggcgtcactgaacgcaccgtcaacggcattgtggcgggggcagagcagggcaatactgacgggctgcgtacctattacacctttattgtccgccctgaaatgtggctgatgacgctcaatcaggatagccggatttttcattaccaatccgtaccggatattctcgcccggctgctgaaagagcatcgcatcaaggcggagagtaaattctataaagatcaccagcaacatgcgatacgggaatacaccacccaaaaacgtgaatctgcctatgatttctggtgccgtctggcggccgaagagggcatcatgttctggtttgaagaggacaaactgttctacagcaactctcaccttggcatgttggcggcactgaccctgacctacaacgttcaggccaataccgacaacagtgattcaaccgcatggcagtggaattacggcgaatacctgtgccccgatgaaacccgccataaagacaacaacttcctgcgcccctcctatccattgcaacataccgctgcactggaaaaaggcatggggcattcggtttttgaaagttatggccgttttcagaaggatgccgaaggccgcccctttacccaattgcggctggaacagttgcagaaccagagcaaagtggggaaagcggtcaccaactgcatcaaattgcgtccgggtcggatctttatgctgcaatcacacccgattggcgccatgaatgatagctggcagatagtcactgtttcccatcaggggcatcagccacaagcctccggtgaggccggggagggaaccaccctgaccaaccagatttcctttattccgggcaggcaggattggcgcccgcctttccgctataagccgctggcggatggcgatgaagtggccactgtcgtggggccggagggggaagagatctacgtcgacaaacatggcgctatcaaagtgcatttccactggaaccgttacgatgaagcggacgaccgggcatcctgttgggtgcgggtggcgcagggctggaatggtgatggctatggttttatggcgatcccgcgcatcggtcaggaggtgattgtttcctacctaaacggagatattgatcgtccgatcgtcaccggctgtacctacaacgggcgcaaccgcccgccgctggatctgccggcggaaaaaacgcgcaccaccttcaagacccgcacccacaaaggtgagggatttaacgaattgcgctttgaagatgcgaaagggagtgaagagatctatatccacgcccagaaagatcagcttatcgagataaactacgataaaacccagcgtgtgggtcacgatgaaagccaccatgtcctgaacaatcgcaaacacgaaatcggcaatgacgaattcatccggatcatgcatgaacagcacatccagattgacctgaaccagtttgaaaccatcaccaaagatcgcaaaacccgcatcaacaacaactggcaggaaaatatctttgcggatcaccggcaagaagtggggcgggacaaaaccgccaaaattaacaacaactataccctgaatgtggtcaacaacatccagagcctgacgaaagtccataccctacaggccagcgaatccgtgctgatcaaaggcaaggcagggtcgattaagctggatggttcaggggtaacgatcaccggcaaaatcaccttgcaaggggaggtgtcggtaacggggggcagcccgggcacggtgccgtcactcagcggatcagccaatgaagggttggtcatggcagaggattgccgggaaaaagcccgtaaacagcaggagtcatcggaataatgtcctggatacccgattatgccgaacattgggtggtggattatgcctataccacgccacaaggcgaacctgactctgcccgggcgattgtccatgcagcgagccagccgcaggcgctgtcggcgctggcggaatatgtcctgcaggcgggagattcaccggggcaataccaaagtattcagccgttgcctgaataccttgccgccagcgctgaggtcgaattgccgctattgcggcagttccggcagggggtggagcggaatgcccgggtgatcccgctgaacgaacacaataacaatcccctcctgccggccgcgcgtggcgtattgcagttcgccgtgacggaaaccctgcccgccagtgcgcgtgggcaataccgctatatggtgattgatgccacggtttaccgtcgggtcatgggcagttttatcgtgccagacctgatggtttccaacctgcgatgggaaagcctgtttcagggggaaacccaaatcacgctcgaagacagcgccccttatttggtggagttaacggatgacccaacggtgcactcggcttttcagcacaagatcacccgaccgatcactccggaaccgggcatttttatcgacagtgaccagccatttcctgtgatccgtaatcacctgcgtaaattcacctatctgagaaatgaacaacaccaatcctgggtgttttaccgtttttatgtgccgcaaggcttgctcccgctactgagaagcctgccggatgaacaactgatgcactttatgcgcccgataatgcagatcggttatttcgacagccagacggggcagtactacgccctttctgtggcagaaaacagtctgaatcaggaaaaaacggctcccgtggccatcaaccgctctctggttgacatactggcggggcagacccaagcgcgggcggtgacgcagatagtgaaattcattgcagagacccagcctgaactgtcggccgaacagcaagaacagctgcccgcctttgtggtgcaacaggccaatcttgcgtgtctggcgggattcgcccatcagcgttccattctgtatctggtggcgggcagaagtctggcacggggtaacgaagcactctggcagcgggcatggcagcatgcctgtgccgaagcacaggcgcaggaggtgcgggcgctggcttgttatgaatattgttttaaaaaccgggcattaagttaacacaaggagataagataaatggaaaaatcgatattaacgagcgcgggtgacgctcttgagaccgccgcgaaaaaagtggcagaaacgtttgaaaaaatggtcgatgaggcgaaggcacgcatacctcatgagctggacatggataccgttgtcaggccctgtgatgccaatatccggccggtttatcctgtcagatatgcttatatgaatttttttggtgacacatggatagacgctcaattaccgccgccaataagtacgtttattgatcctgatgatgattcattaagtgccagcgttctggggggttatagcattcgcatgcccagaccgggctggatctatgtcaaagaagaaggggcgattaaaacccggggctcccaacagaatggcaatttactgattttcaaattcagccctgaaattgttaccttagagggcaaaagggggatggtcacaaaatacaccaaatatgagcaaaaagccggcagctcatcgtgggaagaaatccaccctgccagcggtacagcaggattaggctatccttttctggcgattgataaagatgtgacccaaattagcctcatttacagtgaagtcgagctggctaaatctgtcctgaataagatggataacgataaaaacttccgcaagaatgcgatgcaatttgtggatttagacagtgaggtatcagattatgccattgatgccagacaagaacatttcgacggattagtggaagatttcaaagatcctgaaaaacaatttcaggcatacaaaaatcaattatccgatccgcttttacacgctgctgatttgggggatatcacgacggaaggcagttttttcatggatgccgatatggaaatgcgttatatcgacagtcttatctgcccttattacaaagataaagcgaagattgtggtattgcatgatccggtgggatatcagcgtgatattttaatggcctatatgttacttaatctttgggagctaagctatagtgcaactaatatgtatcctcttacgatagggaattttgttgagatattagcggcatcaaaaaataaagaagttaaaaaatgtgttgaggagtgtattcaccaagaaaattggaaaacttggtggcctaaattaactacgccgattaagagtgtaaaagatagaaagaaagagattcttgaattttataaatgtttttctgaaagtgaaatgattgcaggtaaattaggtgggcttacacattattttaagaattttttctccgtatctgataaaaaggacatttataccgaaggtgatgcaaaagaatttgaacgattctgtattttacacgctgaattaatggagccgctaaagcattcagaagagggattgttggcgatggaaagtattattgcgggtccattggctatagacggaaatagtgcgtgggaagttgccctcaatggaatagtgaattcattgggccatgatggcgttgataaaggttccattgcaaggttcctcaatcggggaatagatataatactcagtgtcgttggcaatttactggctagactgtatgtatttacaacagagctatcatataaaggggtattacatttacatgtgttgagtgttaaacaggtaacgcataaacttgtgcctaaaatcttagattattttgggcttgaaataaagcaaggacactatctcgaattaaccgagaaagaatattatacgtttctaaaaaaaattgaagaatatgaaaatcaaggagtatcaggtgaaattaagaaaggcatggctcatgctgagtctggcttgaaaaggtttgtaggaaaaaaagtgtttgactggtctaaccggttggataattacaataataatataaagataaaaataccgctgattaaatttaaaaggcctgagttaaatcctcagtttaaatttttttataatgcaaataagtctgcgggctacttattgagctctggattaagtggtttggatttattgatgaagagctatatgttatataaattgacatcaatgtctcgtttcgacaagaatgcgccatttaatgcaaacagacttccttattattatgtttcaagctatgctaatactatattaggtgggttaattgctgcgaaaggtgtttccgctattggtggagatgctattaaagttgcagctagcctggcgggtaaattgaatagccccgcagcaaaagcgttattggattctgcatcacgcaggcttctgttagaaagtgctttaataacaaaatgggtaaatagtggattaattgctacagggtttgtgagtggagtactttcttattacgatgcctacaactcttttagttttggtaatgataaagaagcttattctcatatttcaataggtacaggatcaataataatggctgtaggatggtctatggcggtagccgcatcggaagtgacttttggcgtcagtcttctgattgcgctaggcgcttcactaatgcttggtggaacattcgcagctatatacttcaattggatagatttggaaacgttgttaagtaactgcttttgggggaatgggagtaaatatgctttttggagtacgagtgaaaaacgtttaagtttagaaaatcaatttaaaagaataaaaattatagataaggaaattaaagatatatatctggtcgaatttcaggagtttttaaatatttttattaaaccaactttaaatattgaaaataataaacaaggaaaggtgatttacaaatttatactacctaacttcaaatgggggaaatcagatatataccatgaagttattccatcagctttgtcagatggctatagtgatcctgatgcttcaataattgaacgtggttatagcaggcatcattattctgtggtgaaagataattttgataaagcaatagatatcgctcgtaaaaatcgtgaaaatctaatttatgacgaggagagtggtttaactacactgaccgtagaagtagacgaaaaatattctgtttatatgaaagtcttttggtattataagccaacagaagatactgtttctcctcttcactataaattgggaaaagagccaatattggaaaatgcggtttatggatatgaagatgaggtattacgttaaatgagtaaattaataaaaaaactttttagagtgaagacgcttccaacagagccattatctacttttggtactcctgttctggagcaaaaactaattctgctggataataaaactgtaaaacgtgcaggatttttggattcaataaatagcaaggagtgtcatttccgtcataatcttatcagagcaagaaaagaaattataatacccgtgtttgttgggtttatgttaggtttttctttttttattaatgacaacattaaggcatggaatgcttcggaaaaaactatccttctgcttttaaagagtgcaaaggaaaattatggggaacaattttatttaaattctgaagcatctgcatctactaaattattgaagatagtatcaaataataaaaaggtatcattaatggaatacttatatattagttattctaaggatagtatttatggagaggaaagagctagaaggtctcttattttagattcaagtttcggattatttttccttagtgccaatattcttattatcagcatttttttgagattacgtaagcctgcaaatttcatcattgatcatgaaagacaacttttttatacctggaaaaaagggaaagtgtatgtatctcgctataaagaattaggcgtagcgtttgctaataatattttgcatttcaaatgttatgggctgaacgaaaagaatgaactgacatatcagttttttatcccttatcttagtcttttcaactcagacgaggataaaatttatattttggcatttatgtcaaaatatttattacaaggaaaagaggctgtcagttcagttgattttaaacgccaagaacaattaccgtggtttcgtaagcaaataaaaccagcagattgggaaactcagattacggcaatattagctgaattagataggttttggccaccgaaaggggcgactgaacctaaataatagttggggaaaatattaatacagtaagttatattttttccagaaaaaatagcaccgaaaatattataattatctcggtgctaattttaaagttttaaagattgtattgtaaatagttgctttgttatttatattaaattgttatgtgggattttttatggctaaggataatgaaattaaattatcaagaatatcaactgtttgcgatcctcttttgaaggaaaatattggaatattagataaggagcagttagaaaatgagggggtttttgaattaattaatgataaaaattgtgtaataattaatgagataaataatcatcggatacatattattgttcctgctcttattggttttttattggggttttgtttctttgttagtgattatattaatgaatggaaatgtaatgaaaaggggtatttgagaacgcttaaatatgccaaaaagtattatggtgaaaatttttatttaaattctaaaataccagaatatatgaaagcgtatgaatatatttctgatgcggagagtgtatctttattgcaatattttcatattcgttatacggatagtgggttctataaaaaatccacagtgcggtatgatttattactggaaggaggttttttcctgtttttccttactgcgaattcttttcttttgtatttgctgtttttctctcataaagtagctccacttgttattgacagagaaaagaaaattttttatacgtggggaaaagagaaattgtttcttctcttcactataaattgggaaaagagccaacattggaaaatgcggtttatggatatgaagatgaggtattacgttaaatgagtatattaattaaaaaaatattcaagaaaatttttagagtgaaggcacctccaacagagccattatttacatttggtgatcctgttctggagcaaaaactaattctgctggataataaaaccgtaaaacgtgcaggatttttggatgcgataaatagcaaggagtgtcattttcgtcataatcttatcagagcaagaaaagaagttatagtacctttgatgattgggtttatgttaggtttgggattttttattaatgactttgttaagggatggaaagctaatgaagaggatcttctttggtctgttcagaatgcaaaaaaacgttatggagagcaattttatttaaatccaaatgcacctgcatatactaagtcattacgagtaatatcagatgataaaaaaatatctctaacggaatatttatatatttcttattcaaaagatagctattatggtgaagaaatggctaggcgatatttgattatagatgccagtttcggattatttttcctgagtgccaatattcttattatcagcatttttttaagattacgtaagcctgcaaatttcatcattgatcatgaaagacaacttttttatacctggaaaaaagggaaagtgtatgtatctcgctataaagaattaggcgtagcgtttgctaataatattttgcatttcaaatgttatgggctgaacgaaaagaatgaactgacatatcagttttttattccttatcttagtattttcaactcagacgaggataaagtttatattttggcatttatgtcaaaatatttattacaaggaaaagaggctgtcagttcagttgattttaaacgtcaagagcgattaccgtggtttcgtaagcaaataaaaccagcggattgggaaactcagattacggcaatcttagctgaattagataggcttgagccaccgaaaggggcgactgaacctaaataatcgttggaaaaatattaatacagtaagttatattttttccagaaaaaatagcaccgaaaaatattataattatctcggtgctattttgaaagattctaatgtattcgataaaaacccaattaataaaattggtatgtttaatctgatattataaattgaaaaagaatatgttaagtatttaaatatttcttagtgctatatgctaattgagtcaaccataaagactgactaatgcggtaatcaatattgtagagccgagtacgaaggaaactgcaacataataatgctgttactgaaaaaggcaatcttcttattaatgaagaaaattcacttatcagctaattcttacctcattgcgacagaatttttaataagtttcctgtgatcttattggtacagcaataaatcccatcttgaccgttgcatagggttgctacatatctcagaagagaatacggataaaatcgtttcagtgttgaatttgtctttctgtgacaagattatgaatctgattttatgaccaactacgccagcatgttggtactggcgtttatcaatgaatcaagctttagcgcgaagatttcaattcacggagcgattttaaatagtagggttgccccggattatataacggccccatatcgatagtttcatgattagatttggcgatatatcccataccttctctggcagcattggccaacagaccgcaatcctgatcaccagaccaggaaaagatccctcccagttgatgcccggtgacatattctcctttttgtttcaccgtgcggggagtatccagtgagatgaaatgcccctgtttttcactgaacaggaaatctgcatcagcattggtatctgtcattagtacaaacccattttttcccgtactcagtgtatgttcactatccatgtagttattgacaatatcgaagaattccggcgcccctttttccattgtgcccagagcatcacccggcttatcgtacaaacgcgtttccagcttggcacctttacccgaacgtccatagttggcataacccaagttaattatactcagaggaataccgagatcttgatgcaggtaattaatcgccgcttctgccgagagatcatattctccattaggatcgggctcgttaggggaatagaggttggtatgatgcccgatataattggcccatccggtgccaaaaaagtcgtaactcatcaggaagatattatccagcccatttttaactaattcagcgatatttgacttagcaagtttggcttttaccccactacaggcaatagaaatttctttactgcctgtaccgaaccgattatccagtgccgttctcagctctttaaccagcaaggcataatttttgccgtcgttttcactgataatattgtgtacatctccctcagcaccggggtattcccagtcgatgtcaacacaactgaacatcgggaagcgttcaaaaaaatcaaccacactgttgatgaaaacagtgcgctgtccttcattttcggccatcttggagaaataactcgataaactccagcccccgatactgaatgccagctcaagtttgtgtcctgctgcccgcgcgcgcttttgtaattcccgtaatcctcccagcaaacccgccgctttactctgctgataatagggcagaaaagtccccgcattaattgaagtatttttactcgattccggcagaccgacgttacgggcagtgcctaaatcgccgtaagggtccagtggcacgatatggccttcggtgattttctggtcagtctgggaattccagccgtcccagacttccttaactttttctttcttaacgccaatatccccacagatacccaagaagctgaaaatcaatttgtcgtaagttgtcggatctatcgtcgatagattaaaccctctgccgcgatcctcggggttttcattcttgtcatcaagacgggcatcatattgacaccagtctgtaatgtaagcggaaagtttgggtttagccgggtcacgctcatattggttatacatcggtttacagacacgggtcgcggtataagagagatttgtgcctgagccatcgggcttgtacttcaccttctcgtaagtttcttccgtgtatcggtcagattgcagaacgggggatggaatctcttctgtcgggtttatcgtaccatccgttggattgccatgtgtgttgatctcttctgctgttgccgcacggacgtactgccaggcattgtgcggcgaacttttctggccagattgacccggtacatgccagcgttcaacccagtaagtattggtataaacgttgctgttaaaaatcacgttataaacccgcccgccttcctgttggttccaggccgttaagggatcaccaataacatcactgatatcggacattgcttttgatgatgtgtaagtatatttgttagccatgaataaactccgataatttttcctgttcagccccctgttcaggaggctggttaatcatgaaaatcgccagtcacaagctgaacctgtgctgttattaatccgtgatcttttgttctaccaacaatttctgaacggctttaccgaatgcagaggaaccgatttttgcggtataccggacatgcaggatcacatcggtcagactgtcgagattttgcgagttattggtaaaaccgaatgtccaacttgattcaacacccgcaccttcaaatggcaggaaacgctcatcatcaaaattcagtgtgaacatgccgctgtcgtttatgccggtggataaggaaatctgctggttggggtggatgctgcgtgccagataaggcgaatcagcattaatcccttctttcaccagcttttccattgtctgaatgtcggctttcaccatgcgggtattgacgcccagagagagttgggcgcaaatgtcctcataaggcccgattaacataggcagagaaactgagacagatttgatccggcgattggcaaggttagggtaatctttagcaaagtctgattcttgcaggttaaaagtaatgggagagtgctgtctcagggttgcaagatcgttttcccatgctgttttccgcaatgccttgagagagatagttttagtaatctcttgcaagcgtgagttttgttcaacataagcgcgttccattctttgcagcgccagtttcagtgtttcaccagacattaatccctgatagagatcattccagctactgccttcaataaaggtctgctctgaatccaattcgtactgtaatgaggcttctgcggagaggcaaagtgatgaaacggcatcataggcttgcaggtacaggtttgacagttggctaatcatccatgtgtacaggctttcattggtaaagcggctggagaaataatctaacagcgccagcgatttttgctgttccgcctcaacctgtgccaaccgtttcatggaagcagtcaattgcaggttttggacattgatttgctgatcaatggaattgacttcccattccgcctgtttgtattgcatttcccattcttggcggcgccggcggtatgattcagacacattcagactatcggctttgatactgtcagattgatgtttgatcatgaccatttcggccgccgcactcagtgcagctccccagcgcgatccgcccacggccagcccatagatattaggtagcatatccagtgcagccgcgccggtacgcaaagtttgtgctgccagtaacgccgaagcggattgggattgcagttcaatcacctgttgctctgttgacgaaatattttcgtcatacaatcccttaaagtgttcatgtcgctcttgagccgattttttgctgacctgtaaaacctcaaggctggcttgattgatgttgatttcctgctgttgaagatcgattgagaagcggtagagatcactattctggagcatctggaatttttcaaagctcaaactgtctttgcgttccagcaggctcagtaaggtgccgccaaactgtatcagcgtttcaacgccggctctggcacgtgccagcatcggttcaaaacggtaattaggtgttttgaaattcatccggctggcattgcgggcagtgactacgcgctggtaacgcaggttcatcaggtcgcgtggcgagatcttcccatcatagagtgccatgttgatttctttgccatccagcgtcaggttgtgccgtaaattgtaaatccggttttccatacgatcccaaatcgccgtcagttcattgttgatcggcttcatgaacagatcattatcaagggcgcggatcgtgttgtcatgaacgacgggaatatggggcaatggctggctttgcatctccagttggcgcagctcactgttgtcatatcggtagagagcatcttcaagggacagcggttgccagaagcttgccaattgcacatcagggcggcggccaagcagcgaactggcggttgcataactcaaacgggcaatggttcttgccgtgggttggagcttccggtattccatgtcaccgtcatcaatcaggtttctgaccagaaaatagaaaatcgccttgcgataatgtatcggttcaccggaagcaatcgcatcgggatcactcggctgcatcaggctgtagtttttcttcggctcatcaattaatgggcggctgttccagtaacgcggctttccttgtttcagagccggttgatcctcattttcataaggatcaaaaatatacttgagccagcggttagcttcttcataacgctgctcaacattgaaacgccatgccaccatgaaaggcatatggaagaacagttcccagaaatagatgccattggcacccttgaggtcaatcggttctgtgccactgccagaaatcgactcttcaggcaggttctgggtatcccaactgagcaccagatccagtttctggctggctttactgaccagctccttggcaaacagggtatttaagcggatctgtttatcggtataccaaacgggagtcggtggattttcggggaattgcaggtattgggtttgtttggtttgtttgatctggaatttttcacgaaccaatttacccacgctcaagatgactctgattctgccgccaatatcgtcggcatttgctttcggcaaactgaaaccggtgacaatcgtgatgtcgctgaggtcatcgctgtgacaccgtttgactctggtactaagcttgatttcccctcgctcaaaatcttcttttgtcagtacctggtagttcagccagcatctgtttttatttttgtcttccagccagatgcagtacaggatgtttttgctcaggctgaaatcgtatttgtaggtggagatggcggtcagatacatatccagtgaatcttccacatagtcagctttgaggtcgaaatcctgttcgtcacccagtttgccctcaaattttctttccttctcaatcggccattgcctattaatatggacgggataaaggatcagctgcttgaattcatccataccaccattctggggatcacggaagaagaaccaaaccagtttgtcaccataatcatcttggtcagagagtttggtgctggagggaggcagatccgtggaagccatcagcatgttatcgcagatgtaactgaatactacgtcatagtcataagggactttgttttctataccatgacggcgggtaaatgccaccagtaccagacggtcttctttacccgtccggtcaagcaccgcaatcattttatccatcgcatcatcaagcacctcttcgcgtacggtggtgccgctgctccatgtaccatcaaaccccagatgtgccagattgagtttggtgcggtatcggatgatggttttgctttcgtcgtttttgtttttctcttcttcttttgagacttcaaaccagcttatgtagagacggttattcatgatgaccggacggacaaccccattacgggcattttctaacggcacactgatcggcttccattcgctccaggcggttggatacagctcattcgagtccgtattacgctgtttcatgtccagtgttcgccagaaatagcgataaggctgggtacgggttttagcaatgaaataggttttgtcattggcaagatcaatgccatcttcataaccagaaataatttccagattactgacttcttcaaaattgttcaggtaaccaagaactgccttctgagcgacgttatctgtcagttttccctgattcagcacactttccaattggaagaaaaactcggttttggtcagccgcaaggtaggatcaacataaatttcggggtataacctgagttgctgattggcagaccagtaaccgtaacggttggcaaactcctgccagtcgtaggtttcttcctgagtcatggaaagacccggttccaaattgagcacaatacggttgatatactgctgtatcgattgggttacgtgagacacgcgcgatgtgatgactttcgaagagacttgtgtatccagtagcagaaaatcatagagatcatcgacgttcttgattttgtcgcgataaaactggaaatcttttcccttgggaacaatttgcccaaggtagtaatcaacgagcgcatcacgcagatcttcttgtaattttgcttcgatggaattagacattctcgttatctccttgcgcttttaatgccgccatgactgcttcaccgacgctctggtaaaggctgaaatcagtattgagtgttaatgtaccggcatcccataacgttttgactgacaggctggtggtgactgcaagctgttgtaatcggcgtaaccaatcgatatggagtaagtttttggcctgcggaggtgtcaatccgcgcaatgtgcaggccagatgaatctcatcggcatgccagcccagaatatctgccaaaatctctgcacatttttcactttcatcctcgttgtttttgactgcttttccattggcctgtggtttgttggcgtaagaaaaatagtcatggattttgtcttcgttctgattggcgttgttcacgaggtcttggtagcgggtcaacagatatatttcatccagtgacaatgcatttgatgttttactgtttgataaaccgagccattctggttttgtcaggcgcaacaaaagtaggtttttattgattttcagggtactgatgatttgagtataaattaacaaactgtaggtcaagtcggtgaattgatgactgatctcagcggcggtttccgggacacctgtcaaaatcatctccagaacgagataaacattgctgcctaaccagcgaagctgtaagggaaccagacttttttctacgccatattccgccgcaatcgcgctggataacagattttcctgcgcatttttggcctgaatcagcagttgggtcacgatattgatgacattatcctgtggtgttttcccttctttgaacagtgccttgaccttttccctgatctggatttcatctgttttatcccactcaggcggaatatccagaaccagcccttgtgcattgagaagtccgccctctgctgttaatagttcccaccagttgatcgttaccagctctgggcgggtaaaatcagatgatgacaggagcacactatcggacaagccaaccgcgatacctttaaaaaaggtcaccatgctgtctgttggcacgacaggcagcactgtctgccccaacatcagggaaagttttgccgctgtgattttagttttcgccagccagcggctcacggcttccattttcatgatgacgatgagaatatcgtcctgacgcgtcgagtctgcggtgaaaatgggttgttgtgccaaatagcggtgattgccggtcagaatatcgatcaggaacacgccgtcttccgtggaaagaccgaaaatgcgtggaatgctgaccaaacggtaaagtctggaaacaacatcaagattgcgccttaattgccccgtcagcgtatcctgagttggtgtgagcgcactttcaaccatgggggcaatcaattgaaaagttaccgtggaaattcccagcccggcgcagagttgcttgacggttttggcatcatcgccctgagttgccgtatagttgaatacctcatcatccagtgttaacggctgatcaaacagtttcgtctgattaaagatctggtcaaagaacggtacgctgtcactggttgagaatggcgtaatctggtgtagccagcccgcaaacatttcgggagtgacttggtattgcgtattgagatgcctgaacagccccaattccttcaatacattgtcagtaattctcatgtccagattatcggcttctgccttgataccggaagccagcagaagatcaagctggtggtaaggcaggccaagccagcgctgcaagcggataaagcggttcagccgatcatagcggaagttggatacagctttgatttcacgcccgttatccgcccgaatgatttccagagtatctcgttgtccggcattaatgtacaccccgccataatgataagcggccgggaaggtagcggtgctctgtctgttgaaaaaaatcgggttggaaaagtgtacattaggggaaacgataggctggtagttaccgctgctgaatagattttcaatgtgagtagcttgcgttccggtttgatcgccaaaaatggcgattttcttaagctgggcgctttcttcttctgaaagaccataattattgataaagaagtcattcgcctgcggtgataattcggaagatgatgtacctgatttggcaatcgcaagacgataactcattgcctgaaatataacgccgtctattggcccggtgggttgattttcacctgatggtatttctttgggcgtcgctgcataaatggtcatattaccaaagtatgggccatcatccagattgccaatgtctgagttatcgctttccacataggtcagctttaactggcggctaaagggcggagagttgtcaaacggctccatccttgccttgacgcggtagtaagtgagaacgttttctgcccgtagcttgaccgagatggttttgtctgcctgatttttgcaggtgatggaaattctatcgtaggcactgggcgaattttcgaccagtttagtcgggccttcaacactgtcatcttgagcaacaatataagcatgccgcgaaatatctttgtcaggcacaagttctgtcgtactgctgctgtaataggctttgatgagctgatcccgtgacagcaggttttcagagaaaggggcagcttcggtcagtaggctgatttgttcattgctcaactgtgaataagccagcaagatctgatcatattttgaaatttcagtatgccacgggaaatgcgtatcgacttgccggatcacggtacccaattcatttttgctttctgccagcccccggttgatctgctgagtcggcaagttatagggcaacgtaaagggaaaacgtgtttctcccaatacctgattaaccggtttattggcttcccctgtctggtcaatatatattctggcactttcagacagtacatcattcacgatggtcagagcacgaagctctttataaagagcgtcactatcaagcatcagatatgagatatccgaccgcctgcttgccagcaaagttgcctgattggtgccatccacttcaatctgctgaataaatttatacagatccagcagatagttggcagggctatcaagggattcgatagcatccggctgacagaagtcatcccagggttctggaaacaggccactataatcaggcaattttcctgtttgctcgctggcattctgattatctgtcgctgttgacaggaaagccgcagtctgtccatcgtattgtctgagcgggttctgccgatagtgttgaaccagttggttagccatactcactgctttgtcaaagatgatttcagcatgacccgcaagagattcattgtggcgtttaatgaaacgctgttttgacagcctgactatatcgaagatggagtgatagcccagatttctgagtgaatcgactaacgaaacagatgatggggtattgtgctgttttactgtggtgagtgaatatttttcgggtaatgctatttcaggtaatggtatttcagctactgccgccaataatggtgatacttttttcatattctgctgttcatcagaataatcgtgattcttgtccatttttattatcccatttcaattattcggccatattcatcaaaccgtcattaatcaaataaccatttagatactgtatttcagaggttatgttgattaaacacagtctttgcattggggttctttgggtttatcgtaagaagggagatcatcgttatcgaaataaaacggtgacatatcgataacgcttttcttaacgggacgtcccagaccttcgtgggcagcgttggttaataagccattatcctgatcaccggaccaaataaataagccgcccaatcctttttctttgacgtagcgggctttttctctgactgaacgtggcgtatccaatgacataaaaactttgagatcttggttataaagataatctgccttagcaacattatcttgaatgatttcatagccattacgacctatgccattttcgaaatcaacatagttatagataatgtcagtccattcaataaccgcggattcgaaagtgccgacgatattgccttgtccgttataagttccttgaagcgggcttttgctggtaatgtttgcgccttttgcattgcgtgtataaccggcataaccaatgaaaatctttttcttgtcaacaccctgagtgattaaatgctgaacggcatcgtcaatagaatatttggaatgttggtcatttttgttgcgataaaggttggtatggtgagaaagtttgccatcacccagagtaaagaagtcataggtcatcaggttgatgccggtgacacctgcttccatcagttctggaatatgggcatcatcaattttttgaggatcggctgaagctgcaatactaataccttgtaaattggggatcttggctgccgttaattcctcaattagttttttataatagacataatcatctttatcaaatgggtttcccattcccgccgagccggggtattcccagtcaatatcgatatgattgaacattgagaaacgacagaatagatttttgactccatcaataaactgtttacgataggcatcactgcgacaaatttcataaaaagcaccactcattgaccagccgccgatactgacggaaacctccagattgggatcagcttttttcagtgaattgaaaccacccagtaatcctgtggctttctcttggttatagacatctttagccgctccagatgccccactatcgaaaccgcagttaaagtaagtgctgacatcaccccacgggtcgattggaataggccatccggtgtaatttttgagggtttcagcctcatcggctccgaatccccaatctttggcagctttcagaattatgtttcctttcggcccttcatcaccaacgatgccggcaaaactgaatatcaatttcttaaaggggctgccattggttgaatcgcctttaatgcgggtcaaatcggcactgcgtcccccctgatttctgaatacttcatccgatggtgatgcctccactgcccttccatcatattgtgcccagtccgtgaagtaacacgcgatactgaattcatcatcatcgtgataagtgttaaacaccgtcttagccatgcgggtggcggtataggtcagaatatcggtgcttgttgccgggtcataaccgtttaattgataggttttttgtgttgcttccttgccataaccctgaacagggcttggatgttgatatcccggatcagttttataaactaacttgctttcggtatctttttctgtgttatccattttatactccattattgttacatatctttgaaaaaatcagatacgttctctgcgatgatcaatgttaaaaatgatggagttggtcagatggcgatgatttattttatttaagtctgtaatacaattcattaataacattttaataacatagaacgtaattaatctataaatagcaatttaaaactaagctaaagataatacgttttcttatcaaatgacttaaacaattttttttatgtgtaggcagtaaaaaatagaagtgttattttttatctggagtattttagaatgtacaggaatagataacattgatgagattatggatagcattattattttaaatgattgaatcataaaaatactaaaaaataaaaattgcgattttttctattttacgatttgagaaataggataaaaatttcttttagaaatgaattaaacaatatttgtcatcatgccataacgtacctttgttaaggttatcaaaaatgtggcgactattagcatagtcggcattttaatctgttttcagtctgcatgtttcagtgtggtttgtggcttgtttggatatgggcacaaaccccgtgtaatcggtgctagtctggctgatgctgtttgataggatctgacggaaatgatccttcattcttttattttatgtggggagtacaggtttggtctctggcagccaaaacagattccctatgattaacaggccaccaatgattgtcgccgcaacaactggaatggcacctgactcaatggcctgaataaccagaaagcagaaaaaagggggttgaaagtattgaaaaactctccggaaaaggaattggctattatcaggcagtttattacggagatggttggtgtgatgggtaatctttggaagtgtagataaaataatcaggaaagccagaagcctccgatttgccagattgaatcaggctgtacagcaggcttctgacgagtttctctggcctcatttaacgaccattttttcctataactgtttcagcaatgggaatatattgatcagtgagtttattgactgtgctgtcctctttttcatctttgaaacattcttcaaagaaccagctaattggagtacccaactgcttagagataacaacaagatgatttatattaatccggtttgttcctctttcataacgagaaagctgctgctggctaatgccaatttgttttgccaatgccgttgcggtaatacccagctctttccttttggtacaaatacgttttccgactaatgtattagcgtctaccatatcttatcctttcaatttaaatcagtaagttatggcgttatcaaggatcattttcctggcgcttcaaaatggtttggctttttcctcaccagttgcgcctattgttacacctgatccgccgttttgtttttctgacattcacttggtttttttaatgacatgaccttttttattaacgtgttgtaaaaacagtgcccttaccaagataaggggggcttctatgacacgggttgtattctttgttttgatgtcaccctgcattttgcaacttcctcatctaccaccgggttaaaccgcatttttactctccttactcgagggataactaacctgcttcctaacttttttcttatgagatttatgtaattttaaatttattaacgtattgaatgtaaagtaaataaagtttttaaatactgaaaattagtaaaataaaattaatacatatttaaatgcgtattattgtatatatattggttctattaagacctttcttcaggctagaaactggacaaaatatatcaaactgtccagtttagatttataatctatatgatgaatgtttggtggagtttaatttcggatatgtcaatttaaaagaatattaattctgattaacttggttttacttggatgccaataagtaacgatttttagctatcaatactattgcaaagagattaaataggtgaataacaaaaaaaattcatggattataattgcttaagcggaatgagttgtaatatgtaacgaaatttgacttaggataagttatataggattatgtttacagtttgatataaaatgttttgttttttaacaaaattctatttatttaagttagttaaagatatttttgcattttaatagattattatcggaaatttttctaattcttattataaatatcatttattatcattttttccactaaataatctttcagaatcttaaaaataatggcttactcgcattttagggtattatcaagatgtggatgttttttcgacagtcatggatggtggttttctattttttataataaaaacaatatgataattatttttttatgacagggtcattttttatcaagtgacattcattcttcttcatattccatccttgaataattacaccttcgagtgtgtttttgtattgaacacttcatttatataagaacactccagtttttacatagtggtctgaggtgttctcttactcatggttgcgtttttatatggggaaatgacggaacgtaatatggagcctatacaccatgtcagatcacaacgaaatcttatctgacaaatggctggatggagggatatctggaggcagacaggaacagatctcggaagtagaatgattcccttcatctttcaaattacggcttcattggcacccagtcacattgttatctatgtaactggggattcattcacttactactgcgctgcatattgcttaacgcggcatgctggtcggcgatatcgacgtccagttctctcagccgtgttgtcacctgtgtctgatgatgatgataaaagtctacctttcggcacaggcaaacaaactttgctgatgtagattgtgggcaaactggcaacttagagtcagttcttttctgctatgcccccgaaccagaagcatttcccaacgatgatggtgaccaggcacaaaccctgtgcaggcaaatccggcttgttgcaaaatttgtaccgcgtggagagtctcttctccgaccggtagtttcacatatatcagcttatgcgccggcagttctgtcacttcttttacccgctccgttgtctgtgtttctatccagacttctagtcgccctccatgactggcgattctagtacccgtatctattggaaccgcgggttttagcggttcttgaccaaatatttgagtgaccgatgtcagccacgtttgccaattcactggccagtgtaattctggaaacggccagcgttgcaaaggcaggcaaccgagtacaatactttccggacgtgcttgatcaaagggagatatcacataatccggtaataagcctgtggtgtgaaaacccaaattttgagccagacgctggctgtgattatgcgacgatacctgtttaatcgtgagcatacctaatcccatttctttggcttgatcacacaaatatcgacccagcgcggttgcgataccctgtccgcgcgcttgtggatgtaccgcgataagcgagagctctgcacttgatgggcaacgcccattccgccacaatgtcgcgtgtcctaacacttgtccattctgtattgcaacggcagaataccagtgtctggccgcattataacgactcagcatggttggcaggtagacttccggatagacgtaatcttcgccgtaaacgacccgaaacaacgcgctgactccggtggaatcttcttcccggaataagcgaatcaacggcatgactggatttattttcatgctgtcttctcttctgcattataacaacgatgatccacgacccgtatcagcttgccggaacgggggtgagtcaccatattttccagagcacaagaggctacctccacctgtaatcccccttggctacagagttctgccatagcgggttgggccgtgactaacgcctgatggattgatgttgttgatggcatctgtggtgagtcgctggctaatagcagtgttatcttatctatgccgtcctgacggcttaataatagctgccaagccagtattcctttctgttgttgcagtaaacgggcaatctgatcgggaaacagggataacgtagaaacccggatacggtgagcacttccagcccgaccctgcaaagcaaatttgcggttcagtcttcccgaaccttcacaccagcaggccagatcgcctgtggggtagcggatcaccggcattagacgacgttgcaggttagtcacaactaacatgccattgcgcccagactcagtaatgggctgaccattggattcgtcaataatttcgacaatcgaatcttcatcaaaaacccgatgttcaccgtggtgacagtcaggagaggcggcaccaatcagacctgcatcaacactggcacatccgattgaactaatgcgtgcgttgggaaacactatattcaaaagagccagttgttccggaaacaggctctcgccgccgtacaacaggcgatcaatattgggcataaactggcctgaacgctgcaaggtactggcaaaacgtaacaattgtaccggtactccagccagtacattaatccctaagctaacaatggcgtcagccaacgcctgatcctcgactgaacaggtaaacggatattccaccaccggaaccggtgaatgagataacgctccgtgaataaacaacaggctggtatacagatctccggcaaaaaagagattggcaacacggtcgccagattgtaattgttgtgcaagaccctgaccgaacgagcgcacaaaggcttgccattcgctacgactgaacaccgacaacctaccttcgctggtagagccgccggttttaaaaatatgcccactgttgatagggccggtgagtaccggccaattctccaatggctgcgattgctgccagtaagcagcaggatcgattaaaggtaagtccgtcagtgcccagccggattgtggcaaatcactataaagatccctaaaaaagggtgcgtggtgacgggcgtattccactaaatcgtgtaatgataaagtcatgattagctcaaaaagtcgttttggaatctattggatatattgtttcaggcgcgataatccagcactaacggcgttttgccactttgggaatggcggcggaactgtccggctggtgtagacgtgatttccaactgcaacaattcactactgacaacctgattcagcatttcatgtcgtagtagatgttgacgtacttggttaatatcgccatcagccaacacatggatatattcgccacccttatcgaggtttccgactaaccattgcaccggaaacgccagatcggctgacaatgccgtaggattcacaaaaatagaacctacccgtatcaacccaccatgccggcctttcagtctaaagcgtggtgtcggtaatccgcaggtacaagtttccggcaaccagtggcctaaatcgcccacttcatagcgttgaacgacctgcccttcccgtgccagaggggtaaacaccagtcggcctgtttcgcctgactgaacaggttgttcactgtccagatctaatatctccagccactgaatatcagataacagatggaattcgccctcgttgcaacaagtgcaggcatgacccaatggacccgcatcaacagaaccataaattgccgagcggatcacctgcacgccaaaactggataagaattgacgccgttcttcactgacatgttcgccaccagcgaaaattttgcgcacaccaccataagcgcgtaacgcggcctcttcacgttcaaacagctgatatatcgtgcttggcattcctaccaacgtattaacgccttgcgtgataataacttgcaggatctggctaaaatcgtcgtctatcgggccacccatcgggtaatgcggcacggacaatttatccagaacagtgaaaaagctaagtaggccaccatacaaattgccgccgtacaggagattgatgacgcgatcctgtgccgggtcgagaccggcggaaaataggccatctgccgcggcctgcatttggatgtgataatctctgtggctgaatcccgctaattttggcgcgcctgtactcccgccgctgcggaaaaacacttgtgctttcggtgttgtgccgctctgctgaaactgtgctttgcccatgattggcagccctgccagatccggcggcctgacggataatttatccagtgtgacatggtttggcagttgttctgcttttacactgactgagaccctgcgtgcaagtcgcgtcaatgcataaacaccatcatgaggttctccttcataaccctcatgcatagcgccgggctgacatatccggctgacacccgccgccagcaactgacggctcaaggccggcaattcgtgttctccggcgattaagccacaactctgtaaataggggcgccacggcagcaatacgttgatcaactgagcgcgtggtacaggacgaatttgcagagtacggtacagtggagatgccgccagttcccgacgttgagtccacgcgactcgccatcctgcgccttcagttaccgaaccggcaacgtcggcaaacgtgtgatccaagcgcagaaatgccatctgactgctgatttcagccgcttcttggatatctggctgtaaggctggccattccggtgcgcgtcgttccagtgccgaagccacggcatcagccactttgcgcaaaacattctcgtcggtactatcgaccaacagacactgtgggctggaacaagcttgttggtcaaaacggcaaacatcatcagccagagcatcgtagtcagcgttgctggcgaccattgggtcaagataggcaaaactgatgcgatgtccccaatcgatccagcggcaacccggtcgtaactggctgcggatagccgtcaatgcggcattactgccccaggcagacacggcatcggcgcaggcaagtaattctgacaattgatcggacggtagcggcattacggagacgtaagacgctaatttgccactgagatcatggcgcagaaattcagccaatatccgtgcattgaggccattatcactgctactggggcgcaaccagttgatattgccaactaacagactttctaatacagccataaatggcagcaatggcgcgttggcaggagtgatatgcaccactaaccccaaaggttgccaagtctcaaagcgtggctgggtataatcgaaacggcgcagggaaaacggctgttctcccaattcatggcgcagtttttcttccagtgcatcacgacggcaaaagtggcgtaatgtgctgattgtggctgaatccagtgcaaaatccgttgccagcgtatcgagattattggcaaaacgctcggcacaatccaacacttcttgcacagtcggaggacaagccaaggcgtcggcaagacggtttttaagatcggctaatgtggccgccggttccaagttagagataacctcgccattaactaaatacatttcaggattccttaatcaactcagaagcggcaatcgcacaactacggtttttacttataccggcacgtcccagcagttcaaaccaatcggtagccaatccacatccacactctgcggcaggatgcaataccgctaaatcgctcaccacgatactgtgtgccggactggaagtgatataaggtgatatcaggtgcagaaaacccggtttaccatagggttgcaccgccatgctggcggtatcacggacataagcacgggcataggacggcacatgaaaatggtgattttgacactcaacataaggcaccggatgctcaactgaaccatagccatcccggcagcgttcatcaggaatgcccagttgttcatgcaaacgccggtacagctcggatcttgaaatggctttatcagcgtgggttttccagccgccacctaaaaagaccaaagattcgggatgcaactgtagtgggggtaaattcatttcccgcatccgttccagcgtgaaccagaggaaggccgggaagcctaagaaacgcactggcagcccttgtgcggcaaattcctgcaaggcgcggatcacaccaaatgggtcgaattcattgcttttcccattgtggcgcagtgcataacaagcttgtgatacgggggcgtactgacacagatattgatcggtataggcggttcccagcgtaatcgctccggcgggttcatagctcaacagtatgtagttacaaggctgttgcggtgtattccagccgtaatattcgaaaatacgttcaaccattctctgggctgcctgtatgctgcgggtatcgtaccgcatacggctcttttgaccggttgtcccggatgaggtcaattccagcgcatcgataccggtgtgactcagcagcagctgatgtttgaaataattggcgaaaataggtggtaaatgcgaccagtcatgtaatttttctaatttttgagcatccaaaccatttgctttcaaccattgatagtaaccggggctgttttcacaatgatactgtgtcaattcacgcatagccgcgtcaaatagttggtcacaatcgctatcggcacgatagggatgatcaagcgaacaaagggcgtcaacataagcaagagaagtcaaaagtcatctccagaaaaagaaagaaaaaaggggaaactcccttcaataataagtaaattgatttaccatccagcaagcaaaaaaggactaataatccactaagagaaaattatggcatggcaaatacaattacgtgattaaatgaaaataagtcactgtttttagatatctaatatttgaaattgttaattccttgtaaataagatggcgaaaaatataacaattatatttttataaaatcccatataataaatgatgaatattcaattaaattatccttgaactcatctaaaattagtgatatttaaatggagaaataaataatttaacctcatatttttgtttaatgtttagtcaataaatgaaattataaaatctatgaaaattaatattggtaatgataaataacaacgttatttaattaccaattagaaattatcccgtcataaatataataataaaattcagggaataagatttttatttttaacggccaagttaattttaatccagagaatagctaacatattctatatttctattaattgatgaggaatattcggaattaatcatggcattatggtaaacgaaaattgagagtctatatctaatattattagagtctaagaaatattttttgatattgctaaaagtaattaacatagataaaaaaataaaataatttaaaaacaattacttgggtgtaagtgttgtatatttttggtttgttttttttattggaaatcgtcgctggattaattgcttatacattctaacctaaaaaaccgagcttgcatttacgggattatgatatcgctatttttaaatgaagctgaggttaaataacaaaatactgccataaccacttaatttcggcagtattttgacttcaatgaagatagtgcaaagtacaacggttacttacctgtgatctaaccgcaattgctgtaaattgccattgagtgataaatcagtgcgcagtgaagctacttcacggctgatgtacgccatttctttatgggtcgccaatttattgcgccatttatccggttgggcttccagatattggaaaaggttatccagcgagccagcttgttgcagcagaatggccgctgtttttggaccgatcccctgaacaccgggaattttactgctactgatcccggacagaccccaataatcggggagctgggcaggggaaacaccaaactcccgctcaacaaagggtaaatccagccagcgtttttggaagtaatcgcggatttggatagtcggtgaaagtagctggcagtagcctttatccgttgaaacaatggtgacgcgatgccctgtagaagtgactttggttgccagtgttgccgccaagtcatctgcttcatgcccttcggcatgccagcaagcgacgcctagtgcgttgaatgcctgtttaatcagcggcatttcctgctgtaaatcgtcgggcatggcagaacgcccggctttgtaatcgggaagaagctggtggcgccagctatggccacggtcatcttcatcgaataccgcaacggcgtgagtcggagaagaatgggtaattaattgctttaacgcatgttcacaggcgggagcacaagggcttccctgtaccgcatggatgcgtcggatcaagttcagtgcgtctacaatcaaaagatgtatcatggtcgttatgctccgtccgtggattgattccttggcttcagtctcattgggttttaatgaggacgtgacttatttgatgatttcatagcacggctcataagctgtgcctccaggcagtttcatacgatcctgccggacaaaatctttcagtagctcatccatacagcgcataatatccacatcaccgtggattttaaacgccccgtctttttcaatggcatgaatacccgcttctttcacgttgcccgccacaatgccggaaaaggcacagcgcagagcagaagccagtttttcggaaggctgattcggatgcaaattcaggttagccatattgctatggaatggctcgaacggatgctgcaaatcatggctgattttcagtgaccagttaaagctataggcatctccggtagagcggcgatgttctttaacctgcggcatggtctttttcatcactcgggcgacttctgaaggatcatccataatgatgcggtagtactgccgagcctgttctcccaaggtattgacgataaactgatcgagcacatggaagtaatcggcactctcttttggtccggtcaagatcagtggcagcacttgatctttattatcagggttcatcaaaatacccagtagatagagcagctcttctgctgttcccacccctcccgggaagataataatgccgtgagctatgcggacaaatgcctccagccgtttttcgatatccggcatgatgatcagttcattgaccagcggatttgggggttctgcggcaataatggaaggctctgtaatgccgataaagcggcttttctggtaacgttgctgagcatgcccgaccgcagcgcctttcatgggtgcttccattgcacccggcccacagcccgtacagatattcagttcgcgcagccccaactcgttacccactttgcgcccatacagatactctttttcattaatcgagtggccgccccaacagacgatcatattcggatcttctgagagatgaagcgctttggcattgcgcagaatagaaaaaatggtgttggtaatgtgcataccattttccatattcagatggtgtactttctgtgcatggtcaatctgcgcatgaacaaacagaatatcccgcagaaccgcgaacaggttggctcgcagagagcgaatgattttgccatcaacaaaagcgtcttttggtggattgacgagttctagtttgacaccccgttctctacgcaggacgttaatatcaaaatcttcatgttttgacagcaattctttgctgttatctgtttgactgccggagttgagtaccgccagtgagcagttacggaacaggcggtataaatcactgcttgcggtatgcttgagtgtatcgacttcaagttgagagagtaaatccattgaccctaacgggctgacatgtgtaatcaagaacgactcctttatgcccctggtggggttttctcaatttactggcgagccagtcttcctgtttctgggataaatgcttcgttactgcgccacggattgatatctaaccctccccggcgggtatagcgagcataaacagtgagtttttcaggtgcgcataatgcaattaagtcattgaaaatacgctcaacacactgttcatgaaattcgttgtgatggcggaaagaaaccagatagcgtaataatttttcctgatcgattttggggcctttatagcggatctgtacggaaccccaatcgggctgatgtgtgatcaggcaatttgattttagtaaatggctgaccaatatttcgtcaacgaccgatcctgttgctgcaccgttaagataatcgcgactgaattgataatcatcaatttcaatgtcctgattatcgatacattttccttcaaactcggcgattggctgctggctgaaatcgtgcaggggatgtaaaacaacattcacctcaccgtttgcgcagacggataaatcctgttgcagtgttttttgcacggtatcccaatccgcaaagcgggtttgattgaaactattcaggtaaagcttaaaactttttgattcaatgaggctcacactggccgcattcaggctgacatggccgatggcaacttgagggacaccgcgtgtgttgagccaggaaagctcgtacagcgtccagatatcagcaccgtgaaacggtagattatcaggaaacagcccaagtggttcacggttcatactgcgtggaaccgcttgcagtaaagtaggatcgtagtgatcgcggtaaggggtgggcttacccagagtaagttgggctagtgcctgattatcctgatacaaagacatagaattcctcaaaatgaatgatggcaactgagatagattgtagtgtatcaaggaatttcaaaggttcgtatttttattgtacattattcactgtgcttaccgagttagcgtaggacttctgtgcgaggctgagtcttttattttcgatggaattatggatttgtttttttccatcaatgatgtgggtcataatgtgatactcagaccttttcctattctttaatttgtttattctattagtgattttatcagggtagcaattcaaacaaatattcatgttttttattgaatatttatttaaataatataaaaataataagaatatatctgaagatgtattataaatattatttttaattatatcgataagtgatactttaattttatgataatggagtgatttcattttaatattttatttatttgaactaattgatggaatgatggcatcattttccggttgttattttgctgaaaactgtataggaataagcgatataatgtgatgaacttaaaatgatggatgaaagaatcatatgatctccaatgtgacagaagcactttctgattttacccgacgctatgttgaattgtggcaggaagagactgggctgccgccagtcagtagtgatctttatggtgttccttcttcgtgtattgagcggacaggggacggggttgtgtactggttgcccaagctattttctgttcacgaaaaactcagcaaagtggagaccgcgctggatattcgcttacaggattcgattcatgattattatgttacgcagcttgctggtgacatgaccgccagttttgaggggcagaatctcagtttgattcaggtatggagtgacgatgattttatccgtttgcaggaaaatctgattgggcacctcgtgacacagaaacggcttaagctttccccgacggcatttattgcgacgattgattcggatatgggcatgatatctgtgtgtaatctgaccgggcaggtcgttcttgaacagtttggcaaacctgagcgaacgatcttatctgccgatttggcgagttttctgtcggttatcaagccagccacatcgctataggtgcagacatcagtttgtttttttgtgagagatgtctcacatggatcgtaagatatctctattaatcatggagtgaatatcatttgctaatattatttttattttatatcaatagcatgaaaatgatgatcacgatctccattttgtaaagtcacttactgagccaattcaggtggcttgtttcaactctctgaataatagatcctttcactgttctgttaggaaccacagtaaaaaaataaccagggaagataccaacaggaagtgggttcaaggatgatgaggtataggcaggaacgccaatactatcaatataatgattttgtaaggaataactgacagggacgtattttgtcagggaatgagcagggagcgaccaatttagccggattgctatgacaatcagtaagaggggagattttatctcccctctttttgtttcattttatcttgccgcaagttttccgctgaaatcatatcagtgatattcttattgccctccaatgatgtggtggcagcttctgtcatctgatcaatagccaagtatcagacgaaatatcatgaatatcgaacaacaaattctacttaaattacagctaattgaagctgacatgaaagcggctggcctgtggcggagtcaccctcccaagccggaagcttttgaaagtaccgagcccttttcgctagatacgatgtccgcagaagagtggcttcagtgggttttaattccaagaatgcgagccatgatagaacaaaacgccaaccttccgacggcatttgatatcacaccttatttcgaagaagtctataaggaagaagcagaacgttatctgccgctgcttgaacatcttcgggaattggacagcctgtttacacaggatatttgatatgctggatatcatttatcaggacgatcatattgttgcggtcaataaacctgcgggttggttagtgcatcgcagctggcttgcccgccatgaaacggtttttgtcatgcagacgctgcgtgatcaaatcgggcaacatgttttccccgtccatcgactggataaaccgacatccggcgttttgctgatggcgctgtcaagtgaggtggcaagaacgctttcccaacaatttgaatgtcaccatatacaaaaaacatatcacgccattgtacgcggttatgttgaaggtgatggtattatcgactatgcactaatggaagagctggacaaaattgctgataaattcgctgatactgacagggaagcacaatcagcaatcacccactatcgttcattggcaaaagttgaatgtccggtagaaatagggcgttacccaacatcacggttcagcctgctggaactgatgccaaaaaccgggcgtaagcatcaattacgacggcatatgtcgcatctccggcatcccatcattggggataccacacatggcgatttgcgacaaaaccgaggagttgttaagtattatcagactggcaggttaatgctgcacgccagtcaactccaattggcgcatccggtgacaggagaagatctgcttctgactgccagatgggaagcttcgtggcagcatttgctggagcaatttggctggcagggtattgtacctgagttagaatgtccaaccactcatgaatgaacgcagtacaaataggctaaagagatcaatatttatggcaaagattggtgttttcgttggtacagtttatggcaatgcgctggcagttgcggaagaggcgcagcaaatccttcagcagcaggggcatgacgttgaggtttttgaagatgcgaccttgacgcagtggcaagagtaccagcaacaggttgttctggtcgtcacatcgacaaccggacagggcaatttacccgataatatccagccactttattcagatatgaatgataagttgggccatcagcccgatttacgttatggcgttatcgctcttggtgacagtagctatgacttcttttgtggcggtggccgcacatttgataaactgttacaggaacagggagcaaagcgtgtgggcgaagttctgctgattgatggtattgacgtggttgaaccagaagtctttgcccagaactgggttgaggagtggggcgctttactgacagaataaatgccacaccgcttatgcagggaaggataagcggtgtaatgacacagctggcgtgattacttgcgagtcagtttttctaaatccgcttcaatttctgcaatcttattggcaacaacatgctcaaggtggcggagatcgtcgaggatcttgtgtttcaaatccacttccacttggtcatgcctgcaaatttgatccagttcttcaattacataacgcaggttagtgttaatctctttgacttctttgtaaccttgcgctgaattgtcgtcagagatagttttgagttggcgtggatatttgaatttaacacttttggcaaaaaattcgcctttatccttacggaaataaatcttcagaatatcgttattcgcttcctgacggaggctatagcgatcaatatcttcaggatgggtgatccccaaacttttcaagttatcgtacatagagcgcctcacctaattgagtgctaaaaaatagagatattaaaaaaatagcggatttattatccgctattttaaaatttagtctatgtttctgagcagctcattaaggccaactttaccacgtgttttggcatcgacctttttcacgataaccgcgcaatacaagctgtaactaccatctttggaaggaagattacctgataccacaacagaaccggcaggaacccggccgtaatggatttcgcctgtttcacgatcataaatcttggtgctctgaccaatataaactcccatagagatcacggcaccttcttctacgataacgccttctacaatttcagaacgtgcgccgataaagcagttgtcttcaatgatagtcggattggcttgcaagggttccagaacgccaccgatgccaacaccgccagacaagtgaacgtttttgccgatctgtgcacaggaacccactgtagcccaagtatccaccatcgtgccttcatccacataagcaccgatgttgacgtaagatggcatcagtacactgttgcgggcaatatatgccccttggcgaactgcggcagggggaacgacacgaaaaccttctttttcgaaacgagcttgatcataatcagcgaatttcatcggaactttgtcgaaatagcggctttcagccccttcgatgacctgattgtcattaatgcggaaagagagtaatacggccttttttagccattgatgtgttacccattgccctgcgattttttcagcgacacgtaatttgccgctgtccagcatctgaatcacctgattgacggcgctacgggttgcttcatcaacagtgccgggggtaatgttagtgcggttttcaaacgcattgtcgataatggattgtaattgctgcatcagtatggtgttcctaattgtcagtcaaattgagaatattgttatactttatccttggtgttaagggcttctgtcaacctttctgataattctcccttgattttgttatccagctcctgatggtctttatctgccagtataaaaaagtcttcaacgcgttctccaatggtggtaatccgcgcgccatgcagggaaacgcccagttcggcgaaaatattgcctacgcgtgccagcagaccgggttgatccagtgcaactaattccatataagaacggcgggcattttgtgttggtaaaaaactcactttggtcggcacatcaaaatgacgcaatttagcgggcagattacgcgctttgggcgctttcggatgcggatcattcacgactttcaataatgcccggcggataggttcatgacgatcgagcgccagcggatgaccattgggctccagtacaatgaaggtatccatcgccatttcatcgcgattggtaaagatttgagcatcgtggacactgaggttgcgtctgtccaactctccgactacagccgcgaaaagcgaaggtctgtcctgacaccagataaaaatttcggttccaccatgggaaaatgcggtgctgattaacaccatgggctctgcagattgatgttggatcaaatggccggcatgccaggccagttgatccggcgtatggcgcaggaaataatccgcatgacagcggctccagatattgtgtaattgctcttcgtcagctctttcttgtcgcagtagcgccaatgcctgcaaacgattatggcggacacgttcacgcaagtcaggtgtattctgtataccttggcgcaactgggtttcagtggcgaaatagagttcgcggatcaggctctgcttccaactgttccacaatttagagttggtggcgcagatatctgcgacggtaaggcagagcaggtaattcagtcggtttttatttttgacctggccggcaaattgttggatgacgtcaggatcttgaatatcccgccgctgtgcagtgactgacatcagcaaatggtcgcgaaccagccattctactaattcggcttcacgggtagtcaggccatgttggcgtgcaaaggtaaacgcatctttggcacccagttcagaatgatcgccattacgccccttggcgatatcatgaaaaaaggcggccagccgtaaaagttccggctgaggaatgcggggatacagttcgacacataagggatggatcacacggttgttttcatcagcaaaactttcgagtttttgcagtacccgaagggtgtgctcatcaacggtataagcgtggaaaaggtcaaattgcatctgtccgacaatattgctccagagcggcatataagcacctagaacgctatggcggtgcatcgggatcagtgcgtttttaacggcacgaggatggcgcaggatatccatgaaaagttttcgtgcttcgggcaactcacacaaaggatgtttgaggtttctacgggcgtagcgaagctggcgtaatgtcgtggaatagatccccttaatttcccgatgttcagccatgtgataaaacatttttaaaattgaggttggatcttggataaacagggtttcatcgcttaagtcgataagatccccccgcaactgaaacgcttcgttcaagggacgtggtttttcatcgggctgtaatgtcagaatcgcttcatcaaagagttgaagtagcatgtcattcaattcactgacacggcgggtcacgcggtagaaatttttcatcatcctttcgacaggttgattgcgttctccttcataaccgagcaattgggcaacattgaactgacgttcaaacagtagccggttgtcatagcgcgtgacgactaagtggagggcaaaacggatgcgccagagaaaattctggcattcatttaattcattgcgctcctcacgggtcaggaagccgaaatccaccatttcatccagtgaggctgccccaaaatggcggcgagcaacccaaagcagggtatgaatatcccgtagcccgccggggctgcttttgatatccggctctagattataactggtgctatggtaacgctgatggcgttcccactgttcgcggagttttgctgcgaagaacgttgaggaaggccaaaaatcatcgctgaaaatgtgcttttgtaaccgcaggaacaaaggaagatcaccgcagatcaaacgtgattcaatcagatttgtggcaacggttaaatccgataacccttcatgcaggcactcttcaaaggttctgacactatggcccacttccagacggatatcccagagcagggttatgaattgcccgatattgtgggcttgatcttcagtcagttggctttcgctgagaatcaataaatcaatatcggagagaggatgcaattcgcgtcggccataaccacctactgcaatcagggaaagtgaagtgttctgatcgaaaccgtgagcctgccatagtcgcgtcaggagacgatcaatataatcactgcgggctgaaatcagtgcttctggtgagatccctgccttgaatgcctgctggagccacaattgaaattcatcaacatgctgtttcaatactgggcactgaagatcatcgagggaaaattccacaggagacaggggaggaatgggcgcgtgtgcaaaggtgatatcaactgacatatgcagaaacctatgatgagaaaaacgtgagatgaacagacgttattggcagataatgaagcccttggggacagtttatgtacaagggcttcgtttatcaacgccgtcttatctacgtgatttctgccaatgattgcaaaatcgcgccagccggaaattattcgttaatcagcaccgctgagatatgaggttcttcttctttgcgcaatgtcatgatttcacagccattttcggtgactacgatggtgtgctcatactgagcagaccagccgtgatctttggttttgactgtccagccatctttcatggtgcggatacgggaatcgccggtattgaccatcggttcaatcgtgaacgccatccctttctgcaatacaacgccgccatcatcagcgtcataatggagtacgtggggttcttcgtggaagaccctgccgataccatgaccgcagtattcgcggacgacagagtaatcctgcccttccacatattgctggatcgctttgccaaggctgcgcaggcggatgccgggttttaccattttcagcgcaaggtacaggctttcctgggtaacgcggcacagacgctcaccctgaatagtcgatttgccgacaatgaacattttggaggtatcgccgtgaaattcctctttgatgacagtgacatcaatgttgacgatatcgccttctttcagcaccttgtcatcgctgggaataccgtgacaaatcacatcattgacggagatgcatacggatttcgggaaaccgtgatagccaagacaggcagaaattgcctgctgtttattggtaatatgatcgtggcaaatacgatcaagctcaccagtggtcacaccaaccttaacgtaaggttcgatcatttccagaacttcggctgccagacgtccggcaacgcgcattttctggatgtcttcatctgttttgatagaaatagccatgaaatcggtccattcaagtcggaactttacccgactgcttgatgttaactaaggaaaaatgctggtagttatggtatcagtccacagaatatctgccaataaccgttgatagatctgcctaccagaaagcggtaacaaatgttggaatttgggggctgtttgtggtataaagcgcgccggcattctgcataattgtttctgccagattcggtttttcagagatgctaaattaactcatttgtgtaaataacacacacggatcgacacatacaccggggtgctctcatgtggttcgctcttctatgaatagcttcgcagtcaaagagtcggtgttatgggatctgtggaggcataaccccaattaactttatagaggtttaaaatggcaactgtttccatgcgcgatatgctgcaagcgggcgttcacttcggtcaccagactcgttactggaacccaaaaatgaaacctttcatctttggcgctcgtaacaaagttcatatcatcaacctggaaaaaactgttccaatgttcaatagtgcattggcagagctgaacaaaattgcttcccgtaaaggcaaaattctgtttgttggcaccaagcgtgcggcctgcgaagcaatcaaagaagaagcactgggctgtgaccaatactttgttaaccaccgttggttaggtggtatgctgactaactggaaaactgtgcgtcagtcaatcaagcgtctgaaagatctggaagttcagtctcaggacggtacttttgacaagctgaccaagaaagaagcgctgatgcgtactcgtgagcttggcaaactggaaaacagtctgggcggtatcaaagacatgggcggcctgcctgatgctctgtttgttatcgatgctgaacatgaacacattgctatcaaagaagcaaataacctgggtatcccagtattcgctatcgttgatactaactctgatccagacggcgttgatttcatcatccctggtaacgacgacgcaatccgtgcagtaaaactgtacttgggcgctgtggctactgctgttcgtgacggtcgttcacaagatctggctgttcaagctgaagaaggtcttgtagacgctgaataataaggcatgctcattcttgagcccttattgaccaggtattgaaatatattggttagggggcctgtcacggccccctttacatatctgatatagaactatccacgcggaatattatcttcccgcgagacacatcgaggaataaaacaaatggctgacattaccgctgctctggtaaaagaactgcgtgagcgtactggcgcaggcatgatggaatgtaaaaaagcactggttgaagcaaatggtgatatcgagctggctatcgataacatgcgtaaatcaggtcaggcaaaagccgctaagaaagcaggccgtgttgcggctgaaggtgttattctggttgaagttgcagctgacgctaaatatgcgggtattgttgaactgaactgtgaaactgacttcgttgctaaagactctggcttcctggcgtttggtaaagaagtgattgctgccgttatggcggacaaaaatgctgatatcgatgcactgaaagctcagttcgaagaacagcgtgctaacctggtagcgaaaatcggtgaaaacatcaatatccgtcgcgttactattctggaaggtgacgcagtaggttcttacctgcacggtgctcgcatcggtgttctggtttccgctgaaggcgcaagcgaagaactgatcaagcacgttgcaatgcacgttgctgcaagcaagccagaatacgtgaacccaactgacgttcctgctgatgtcgttgcgcgtgaacaccagatccagatggatatcgcaatgcaatcaggcaaaccgcgtgaaatcgcagagaaaatggtttctggccgcatgaacaaattcactggcgaaatctctctgacgggtcaaaactttgtgatggatccaagcaaaacggttggtgacctgatgaaagaaaataatgctaaagttatcaacttcatccgttttgaagtcggtgaaggcattgagaaagttgaagctgatttcgcagcggaagttgctgcaatgagcaagcagtcttaatgttttgaacggaaccgccgattggcggttccgttttatctcatgatgaatttttacatctgggctgcatagcatggatgtgtaattgtaataaatccccaatatccttatctgcttaggactgaacaccatggcaaccaatgcaaaacccgtatatcagagaatcctgcttaagctcagtggagaagccctgcaaggcgcagaaggttttggtatcgatgccagcgttttagaccgcatggctcaggaagtcaaagaactggttgagctgggtattcaggtcggtgtcgttattggcggaggtaacctgtttcgcggagccggtctggccgaagcaggaatgaaccgtgtagtcggcgatcacatgggcatgttggcaaccgtaatgaatggcctggcaatgcgcgatgccttacaccgcgcctatgtgaacgctcgtttgatgtctgccattccactgaatggagtgtgtgacaattatagctgggctgaagctatcagcttactgcgtcacggtcgtgttgttattttctctgcaggtactggcaacccattctttacgacagattccgcagcatgcttgcgcggcattgaaattgaagcggatgttgtgttaaaagcaaccaaagttgatggggtctattctagtgatcctgctaaagatactgaagctgttctttacagtaagctcacttatcaggaagtactggagcgtgaactgaaagtcatggatctcgccgcctttactctggctcgtgaccatagtatcccaattcgtgtcttcaatatgaacaagccaggcgcacttcgtcgtgttgtgatgggggaaagtgaaggtacgttgatttctcacggataatgctcagagacaccgatgaaatttgacggtatgatcagcgtactaatgcgccaaacttaatgatacagggccatgatatcttatgttgatattcgtgggctacaaaataaccagatcccaagggtttgtaacgtgattaatgaaatcaagaaagacgcacaagaccgcatggaaaaaagcgtcgaagcactgaaaaaccaaatcagcaagattcgtactggccgtgcttctcccagcctgttggatggcatcagcgtcgattattacggctctgcgactccattacgtcagattgccagcgtcgttgctgaagatgcacgtactttagcgataacggtttttgatcgttctatgacgccggctatcgaaaaagcgattatggcttccgatctgggtctgaacccatcttctgctggaaccattatccgtgttccactgccagcactgacagaagagcgtcgtaaagatctgatcaaagttgtgcgtggcgatgcagaacaaggccgtgtgtccgtgcgtaatatccgtcgtgacgccaatgataaggttaaggcactgctgaaagacaaagaaatcagtgaagatgaagaacgccgttcacaagacgaaattcagaaattgactgacagcttcatcaagaaaattgatgaagcattggcaagtaaagaaactgaattgatggatttctaattgccatttcacgaatataacgccgcagtccttgcggcgttattctttgcatcacatttctttctcaggcgatggacataccgatcgagacggctcaaactattgacattttatgtcagtagaatactcagagtattaaaatgaaacgcttaactatccttggctcaacgggctcgattgggaaaagtaccctttctgttgtcagaaataacctggataaattccaagttgtggcactcgtcgctgggaaaaatattgaaatcatggcacagcagtgtctggagtttcgtcctcaatatgcggcaatggcggatgcgcactcagcaacggtattacggcagttattacaggagcagggaagccagacagaagtgttatccggtagggaagccatttgtgatttagctgcgttggatgatgttgatcaagtcatgtccgcgattgtcggtgttgccgggttattgccgacgctggcggctatccgcaaaggtaagcaagtcttgttggccaacaaagaagcactcattaccagtgggcgtttgttcatgcaggcggtgaatcaatatcaagcgcaactgttgcccattgatagtgaacataatgccatcttccagagcttgcctgaatctgttcagcacaatcttggaaatgcaagcttaaaacaacatggtatctccagtattatcctgacgggatcaggtgggccgttccgcagaacccctctggagacattgcttgatgtcacacctgatgaagcctgtgctcaccccgtctggtctatgggacgcaaaatttctgttgattccgcaaccatgatgaacaaagggctggaatatatcgaagctcgttacctgttcaatgcctctgctgatgaaattgaagtgctgctccatcctcaatcagtaatccattcgatggttcgttatcaggatggcagcatcattgctcagttaggaacgcaggatatgtgtaccccaatagcttatgcaatggcttatcccaatcgtatcgtttctggcgtaaaacctctggattttactgaactgagcacactcacttttgaagcgttggattatcggcgttatccttgtctgaaactggccattgatgcttgccatgaaggtcaggcggcaacaaccgcgttgaatgccgccaatgaagaaacggtcagtgctttcttgaaagatgggatccgcttcactgatatcgcgatgattaatcggttggtcgtcgaaaaattaaatttacctgaacctgaaagcatcgaagaggtcttagaaatcgataaagtcgctagagaattagcaaaagaaacgattaaggcctgctccaaatagcgaattttgctaataagtatatatttgtttgcgttttggcaaatggtatagttcgcgggtaaataatagttgttataatagccagttcaatatttgtcacacgttttctgagtgtgtgccaaagatagaggctttcattcgggccatgccccagaaatagccgtggtaagtgttgacacggctttttcatgtttggaagtatttgaacccatagaagaaccagcttagttatttaaggatcattttgagtgatatcttccagtgactgtaactcattgctaacgttacccagacatgttgccattattatggatggcaatggccgctgggcaaaacaacgtgggaagttaagggtttttggccatcgcgccggtgttaaagctgtgcgggttgccgtgagtttttcggttaaacacaatattgaatcactgacattatatgcttttagcagtgagaactggaatcgcccacagcaggaagtcagttcattaatggaattgtttgtttttgctcttgataatgaagtgaagagcttgcataagcacaatgtgaaattgtctgttattggtgatatcagtcggtttagctcacggttgcaggaacgtattcgccgttcagttgaattgacggcgggcaataccggattgcagcttaatattgccgccaattatggcgggcgttgggatttggttcagggcgttaagcaaatcgctgaaaaaatcagggcaaatgagctggagcccgaggaaattactgaagccacagtgggcagcgtcatcaatttgagtgagcaacccgaagttgatctggtgatcaggacgggcggcgaacaccgtatcagtaattttctgttatggcagatagcttatgcagaattgtattttaccgatatactttggcctgatttcgatgaaactgtttttgaaggtgccattaatgcctttgttaaacgagaacgccgattcggcggaacaataccagacgatgccgaagtgggatcataggaggaaaacttgctgaagtaccgtcttttaactacgttgatattaattccaattgttattgcagcactgtttttacttcctccatccgggtttggattggttgttattacagtctcagtacttgccgcatgggaatgggggcaatttgccggccttttcacacaagccaaacgtattacgctggccgtgttatttgccgtagggctgctggccttacagtactctttgtcagatttttcccacctcattgaaaaaccacagattgtatatctgttgtgggctggtatgatttggtgggctgcggctatcctgttggtcaccacttatcctgcttctgcctcaatctggaagtcatcaactgcactacgcctgttgtttggcgttctgactatcgtgccattttattgcggaatgatggtgctccgaactcagggatatgaaaacaacacctatcatggtgcatggtggctattgtatgcgatgctgctggtatggggagccgattccggtgcctatgtttttggccggacactgggtaagcacaaaatggcaccgagagtgtctccgggtaaaacacttgaaggtttggtcggaggagtattgactgctgcgcttatttcgtggttgttcggtaagtttgcgccagtaccggtaatgcctgaaaacttattattgatttctgctgtggttgtgattgcctctgtcttcggtgacttgactgagagtatgttcaaaagagaatcaggcatcaaagacagcagcctgctgatccccgggcatggtggggtcatggacagggtagatagcctgacagcagcagttcctgtgttcgcgggattggtactgttaatttcttctggatttgggctctgaggctacgtaatggatattctctggaatctggctgcatttattgttgcattgggtattcttatcacagtgcatgagtttggtcatttttgggttgccagacggtgtggtatctacgttgaacgcttttccatcgggtttggtaaagcgctctggcgtcgcacagataagcagggaaccgaatacgttattgctcttatccctctggggggatatgtcaaaatgcttgatgagcgggttgagtctgtttctcccgaacgtcgtcatatggcattcaacaataaaaccattggccagcgcgcggcagtcgtcagtgcagggccaatcgctaactttattctggcagtcattgcttattggttggtttttgtgattggcgtgccttctgtgcgtccggtggttttggatgttaagccagattctattgccgctcaggcaaatattttgcccggaatggaactaaaaacggttgatggtatcgaaacctttgattggaattcggtacgtctggccttagtgagtaaagtgggtgaatcttttgtgtcaatggatgtgatgccaatggatgctgctgccagcatgcaaaaaacattagatttacgtgactgggcatttgatccatccaagcaggatgtcttgctgtctttgggcattatgcctgttgtaccacgaatcagctctcaggtagagaacgtttatccggactctcccgctgaaaaagcaggtttacaacgtggggacaggatcgttaaagtcaacggtcagaatgtggatgtctggcacacttttgtatcttttatcaggaaaaatccgaatgttcctctaaaattggacgttgcgagggcaaatagcatcattcctctgtctttgacgccagaggtcaggcggttgtccaatgggcgtgaggaaggcttcgctggtgccgaacttcacgttattcctctggcggatgaatataaggtaattcaacaatatggggctttctctgccatttatcaggcaggagacaaaacttggcaattgatgaagctgactgtcaatatgatcggtaaattaattgtgggggatgtgaaactcaataacctgagtggccctatttccattgccaaaggcgctggagtatcggctgattctggcttggtgtattatttgatgtttttggcgctgattagtgtcaaccttgggatcattaatttgttcccattacccgtactagatggtggacacttgcttttccttgctattgagaagatcaagggagggccagtctccgagcgtgtacaagacttcagttatcgcattggtactatattactggtgttattaatggggcttgcacttttcaatgatttctcccgcttctaaggtgggagaccggttaggaaaacgcataacaacgatggcgatgaaaaagttgctcatagcgtcgctgctgttcggcagcgccactgcatacagttcagacggattcgtggttcgggacattcattttgagggtcttcaacgtgtcacttctggtgcagcattactgaatatgccagttcgcgtaggtgatacaatcagcgatgaggatatcagtcgcacgattcatacactgttcgcgactggaaactttgaagatgtccgtgtcttgcgtgatggcaatacactcgtcgttcaggttaaagaacggccaaccatcgccagcattactttctccggtaacaaatcggtgaaagatgacatgctcaagaaaaaccttgagtcctctcgtgttagtgttggtgaagctcttgaccgcaccatgctgtctaatatggaaaaagggctggaagatttttactacagtgttggtaaatacaatgctacggtgaaagccgttgtcacgccgctgccccgtaaccgtattgatttgaaactcatattttcagaagggatctcagcgcagatccagcagattaatattgtcggcaataaagcattttctacaaatgaattgctcaaccgtttccagctcagggatgatattccttggtggaactttatggctgaccagaaataccagaaacagaaattggcgggtgatcttgaaactttgcgcagtttctaccttgatcgaggttatgcccgcttcaatattgattcgactcaagtcaatctgacgccagataaaaaaggtatctatatcaccgtgaatatcaatgaaggcgctcagtacaagatcgccagtgttgatttgaacggtaatttggccggttatcagtctgaagccacaaaactgaccaacattcagcctgggtcgctgtataacggtacagaagtgacctcgatggaaaaggcaattaaaaacctgcttggtcgttatggctatgcctacccacgagtgattacacagcctgaaatcaacgatacagacaaaacggttaagttacatgttaatgtggatgcaggtaaccgtttctatgtgcgtaaaatccgcttcgaaggtaatgatattagcagagactctgtgcttcgccgcgaaatgcgtcaaatggaaggggcatggctaggcagcgatcgcgttgaacagggcaaagagcgtctggacagactgggcttttttgaaacggttaatgtggatacagaacgtgtatccggtagcccagatttggttgatgtggtttataaagtcaaagaacgcaatacgggttctatgaactttggtgttggtttcggtactgaaagtggcatgagcttccaggtcggtcttcagcaggaaaactggctgggaacgggtaactctgtggggatcagtgccagcaaaaatgactattcgacctctgcggatttgtcctttaccgatccttacttcacagtggatggcgtaagtctgggcggtcgtgtgtactataacgatttccgtgcagatgatgccgaactctctggttataccaataaagcctacggtactgaaggtattttgggcttcccgctgaatgaaaataacaggttggccatgagattgggctatgcccataactcactgtcgaacatgcgtccacaggcagcgatgtggcgttatttgaaaaaaatgggcaaagagccacctttgaagggcaaggcatcgttcgattccaatgatttcccactgacattcagttggatatatggcaactttgaccgtggtttcttcccaacttcgggtttcaagtcttcagtggatgccaaagtggctctgccaggctcagacaaccagtactataaacttacttggagcgctacaggttattatccgattgatgataaaaattcatggataatgatggggcgcacccgcatgggctatggtggcggtcttggtggcaaggaaatgccattctatgaaaacttctatgctggtggttctaatagtgtccgtggtttccgttcgaataatatcggtccaaaagcgatttatttaggtgagaacaaagaaccagaaaaaaatagtccatcccgtgatgctgtgggggggaatgcgttagcgactgccagctttgagctgattacgccaacaccgttcctggatgcgaaatatgccaatactgtacggacttccttctttgttgatgcgggaaccgtgtgggataccaactggaacaatatttcccctggtctgcctgactacagcaagccaaataatatccgtgtttcggccggtattgcattgcaatggttgtcaccgttggggccattgaccttctcttatgggaagccaatcaaggaatacgaaggtgatagagcggagcagttccaatttaacatcggcggcacttggtagtaattaatcgtttttggcggaaaatcgccttattactagataaggtgattgttaattttccaacatgtaaaaaatagcgtgggtcaaaggagtttatagtgaaaaaagtattgtgtgcggcaagctttggtatcgcattagctttctctgcgggtgttcaggcagcggacaaaatcggagtcgtgaatgttggtgaaatcatccaaaagttaccggctcgtgaagctgctgtaaaacagttggatagcgaatttaaaggccgtatatccgagttgcagagtatggaagctgatatgcagaccaaggtgcagaaacttcagcgtgatggttcaaccatgaaagccagcgaacgcacaaaattagagaaagaagtgatggcacagcgtaacgactatgcccagaaggcgcagtctcttgataacgatagccgtcgccgccagatggaagagcagaacaaactcctgacgcgtattcacgatgccgttaaagtggttgcaggtaaagaaggttacgacgttgttcttgatgctaataccgtattatattccgtatcgggtaaagacattaccgcagatgtactgaagcaggttaaataagtagatggtttcaattcgattagctgatctcgctcagcagttgaatgcgcaattacatggtgatggcgatatcgtcatcaccagcattgcgccaatgtattcagcaaatagcgaacaaattacatttttatctgacagccgttacactgacaaacttgcagaatgtcaggcagcggctgttgtgctgcgtgaatctgatcttactcattgtaaggtcgctgcactggttgttgataatccttatcttgcctatgcacgtatggcacaaatcatggatacgacgccacaacctgcgcaggatattcatccatcagccgtgatattttctgaagtgcaattgggaaaaaatgtggcggttggtgcaaatgctgttgtcgaatctggcgttattctgggtgacaatgtcattgtcggtgcgggttgctttattggcaaaaatacgcgtattggtgcaggaacccgcctttgggccaatgtatcggtataccataacgttgaaattggcgaacagtgccttattcagtcaggcactgtgatcgggtcggatggttttggctatgccaatgaccgtggcaactggattaaaattccacagttaggctcagtggtcatcggtgaccgcgttgaaatcggtgcttctacgactatcgatcgcggagcgctggataacacagttatcggtaatggtgttatcattgacaaccagtgccaaatcgctcacaacgtcataattggtgacaacacagccgtggctggtggtgtcactatggcgggtagcctgaaaattggtcgttattgtatgattggtggagccagcgtcattaatgggcatatagaaatctgtgataaagtgaccgtgactggtatgggcatggtgatgcgtccaattacagagcctggtgtatactcgtctggtatcccattacaaccgaacaaagtttggcgtaaaactgctgctttagtcatgaatatcaatgaaatgaataaacggcttaaatctgtagaacgccagcgtgaaggtgaaaacgagtaatcatacaaacgttttttggttgtgtttttattttttgcggcctgcctgataactctgcatttggagttaacgcaggccgtgtcgttaatactatgattcttatatagacaggaagagtatttagatgagtgataatcgtactctgcaaattgaagagattttggatttgctacctcaccgctacccgtttttgctggtagaccgtgttttggattttgaggaaggtaaatttctacgcgcagtcaaaaatgtatcatttaatgaaccattctttcaggggcattttccgggtaagccaatttttccaggcgtcctgatccttgaagcaatggctcaggcaaccggaattctggcattcaaaagcgttggctcgctggctccgggtgagttgtattactttgccgctatcgatggcgctcgtttcaagcgtccggttctgccaggtgatcaaatggttctggaagttgaatttattaaagaacgtcgcggtgttgcgcgttttaagggcgtagcaaaagtcgatggagaagtggcttgcgaagctgaaatgatgtgtgctcgccgtcgtgaggcttaatatatgattgatcaaactgctgttattcatccctcgtccattgttgaagagggtgcagttattggtggcaatgtccgtattggcccattttgctatatcggttctcaggttgagatcggtgaagggactgaagttaaatcccatgttgtgatcaacgggatcaccaaaattggccgtgataaccagatttatcaatttgcctctattggtgaagtaaatcaggatctcaaatatcagggtgagccgactcgcgttgagatcggtgatcgtaaccgtattcgtgaaagcgcatcgattcatcgtggcaccgttcagggtggcggtttgactaaaattggcagtgacaatctgctgatgattaacacccacattgcccatgattgcatgattggtgatcgctgtatcattgcgaataacggcacgctgggtgggcatgtcattctgggcgattacgtcattatcggtggaatgacagctgtccatcaattctgtcagattggctctcatgttatggtaggcggttgctctggtgttgcgcaggatgtcccgccttatgtcattgcacagggaaaccatgccacacctttcgggttgaatattgaaggcttgaagcgccgtggatttgataaagaatcgctgcatgcaatccgtaatgcctataaagcgctttaccgtagcggaagaacgctggaagaagccagaatagaaattgagcttcagacggcaaataacccacatgtgaaagcattcagtgattttctggaaaattcagcaaaatccagccgtggcatcattcgttaagtagatgaaggatactcctttggctaccttctcttctgttaacaatcagcgcccgctgacaattgctttggttgccggagaaacgtccggtgacattcttggagccgggctgattcgcgcattgaaagctcaaattcctgatgctcactttgtgggtgttgctggccctcttatgcaggcggaaggttgtgaagcctggtatgagatggaagagctggcagtcatggggatcgttgaagtattaggacgcttgccccgtttgttgaaaatccgcaaagatttaacagcacgatttaccgcgttgaagccggatgtctttgttggtatcgatgccccggattttaacatcacgttggaagggcgattgaaacagcgagggattaggacgattcattacgttagtccatcagtatgggcgtggcgtcagaaacgggttttcaaaatcggccgggcaacggatctggtactggcatttttgccatttgaaaaagcgttctatgatcgatttagcgttccatgcaaatttattggccacacgatggctgattcgatgccactgcaaacggataaaatggcagcccgggaggctttgggtgttcccttaaatgcccattgtctagcgatactgccgggtagccgccatgcagaagttgagatgttgagtgctgattttcttagaaccgtgcagttgctgaggaaaattcttcctgatctgcatgtattggttccattggtgaatgccaagcggcatcagcagtttcagcgtattaaagatgagattgcgccggatttatctgtccatatgttggacggtaacgccggtaaagccatgatcgccagtgatgcgactttactggcctcaggtacggctgcgctggagtgtatgctggccaaatgcccgatggtggtgggctacagaatgaaaccttttacattctggctggcaaagcggctggtgaaaacgccgtatgtttctctgcctaacctgctggcaggcaaagaattagttaaagaactattacaggacgaatgtgagccacaagcattgtctgaggcattgttgcctctcttgcaaggtggtgctgatgtggaagcgttgaaacaaacgtttctgcatttgcatgaaagcattcgctgtgatgccgatgaacaagctgcacaagcggttctggaattagcgagaagataatggattttgtttatcctcaggcgaatttgattgccggtgttgatgaagttgggcgtggcccactggtcggggcagtggttactgcggcagttattcttgatcctgccaaaccgattacaggcttgatggattcgaaaaaacttacagaaaagcggcgtgaagcactttatctggaaattaaagaaaaggcgctgtgctggagccttggtcgcgctgaaccagaagaaattgatcaactcaatattctccacgctaccatgcttgccatgcagcgagcggtggaaggtttagctatcacaccggattatgtcctgattgatgggaaccgttgtcccgcattgccgatgtcggcactggcggtgatcaagggggatagtctggtggcggaaataagcgctgcttctattttggcaaaagtgacacgtgacagagaaatggctgagttgggtaagcaatttcctgattatggtttcgcgcaacacaaaggttatccgaccgctttgcatctggaaaaactggctttgctgggcgctacggaacatcatcgtaaaagctttgcgccggtcaaacgagcgctgggtcttggataagtaatctgggcaaactatgacagaaccacgttttgtacacttacgtgttcacagcgactattcaatgattgacggtttagccaaaacagggtcactgataaaaaaagtggctaaattggatatgcctgcttttgcgatcactgattttactaacctgtgcggcttggtgaaattctatggcagtgcccatagtgcaggtatcaagccgattataggcgctgatttttatgtggaaagtgatctgctgggggatgaatatgcccatctgacgatccttgcccgtaataacgaaggttatcaaaacctaacctttttgatctccgaagcttatcagaaaggctatggtgcgattggtccgacgatcaaacaagaatggctgataaaatacaaagccggcttgattcttctgtctggtgggcgaatgggggatgtcggcaaattcttactgcgcggaaatcgggcgatggcggatcagtgcctcgatttctatcaggaacattttccggacagctattaccttgaattgatccgtacaggacgtcaagacgaagaaaattatcttcatgctgccgtcgaagtggcagcagaaaaaaacttacctgttgtggcaactaatgacgtttgtttcctggaaagtgacgactttgaagcccatgagattcgggttgccattcatgatggctatacgatggctgatccaaaacgccctaaaaactatagccctcagcagtatctgcgcagtgaacaggagatgtgtgagctattctctgacattcctgaagcgctgcaaaatagtgtcgaaattgctaaacgctgcaatgtgactattcgtctcggtgaatatttcctgccacagtttccaacaggggatatgagcactgaagactatctggttgaaaagtcgaagcaaggcctggaagatcgtctgaattttctctatcccgatccgcaaatcagagcggaaaaacgttccgaatacgatgagcgtctggatatagagctggaagttatcaaccaaatgggcttccccggctattttctgatcgtgatggaatttatccaatggtcgaaagataatggcgtacccgtagggccggggcgtggttccggtgcgggttcccttgtcgcctacgccttgaaaattaccgatattgacccgttggcatttgacttgctgttcgaacgtttcctcaaccctgaacgtatttcgatgcctgactttgacgtcgatttctgtatggaaaaacgtgatcaggtgattgaccacgttgcggatatgtacgggcgggatgcggtatcgcagatcatcactttcggtacgatggcggcaaaagccgttattcgtgacgttgggcgtgtattggggcacccatatggctttgttgatcgaatatcgaaactagtgcctcctgatcctggcatgacgttggaaaaggcatttgcggctgaacctcaattgcctgaaatttacgaggcggatgaagaagtcagggtgctgattgacatggctcgcaaattggaaggtgtcacccgtaacgccggtaaacatgcgggtggtgtggtcattgccccgaccaagatcactgatttttcaccgatttactgtgatccggaaggcctgaaccccgtcactcagtttgataagaacgatgtggaatatgcgggtctggtgaagtttgacttccttggcctgagaaccttgaccattatcaactgggcgcttgatatggtgaacgcccgtcgtactcataaaaatctggaaccgattgatattacggcaattccgctggatgaccagataagtttcgatatgctgcaacgctctgaaactacggcggtgttccaacttgaatcccgtgggatgaaagatctgatcaaacgcctgcgtcccgactgtttcgaagatatgatcgcattagtggcgctgttccgtccggggccattacaatccggtatggtggataactttatcgaccgtaaacacgggcgggaagagctttcatacccagatgttgagtggcagcacgaatccttgaagcccgtactggagccaacatacggtattattctgtatcaggaacaggtgatgcagattgctcaggtgctggcaggttataccctcggtggtgcagatatgctccgtcgcgcaatgggtaagaagcagccggaagagatggctaaacagcgctcggtatttgaagagggcgcgataagccaaggtattaatggcgaactcgccataaaaatcttcgatttggtggaaaaattcgcgggttatggtttcaacaaatctcactctgctgcctatgcgttagtttcttatcaaaccttatggttaaaagctcattatccggcagaatttatggcggccgtgatgacggcggatatggataacacagaaaaagtcgttgggctggtggatgaatgctggcgcatggggcttaaggttttaccaccggatatcaacagtggtctgtatcatttccatgtcaatgacgaaagcgaaattgtttacggcattggtgcgattaaaggtgtgggtgaagggccgattgaagcaatcctcgaagcacgtcaaaaagaggggcatttcaaagaactgtttgatctgtgtgcgcgtgttgataccaaaaagctgaaccgtcgtgtgatggaaaagctgattatgtcaggagcgtttgacaggctgggaccacatcgtgcggccttgatgtcttcgttggaagacgcgttgaaagcggctgatcaacatgctaaagcagaagccattggccagacagatatgtttggtgtgctggctgaaaaaccagagcaggttgagctttcatatgccagtacaccgaaatggccagaacaagtcgtgttagatggtgagagggaaacgctggggttgtatttaacgggtcacccgatcacaagttatttgaaagagattgaacgatatacgaatggattgcgtctaaaagatgtgagcccgacacctcgtggtcaagtcacgactgtggtaggtttggtgctggcatccaaaatcttgacaaccaaacgaggcaatcggattggcatctgtactttggatgatcgttcaggacggctggaaatcatgctgttttctgatgcactggaaaggtatcagcatttattggaacaggacaaaattttaattgctaccgggcaagtcagctttgatgacttcagcggcggccttaaaatgacagtccgtgaattaatggatatcagtgaggcgcgtgaaaaatttgcacgcgggatagctatctcgttatcagacaggcaaattaataaacaattatttaatcgtctccgtggcgtattggagccgcatcgttcaggtacgataccagttcatctttattaccagcgggtagatgcccgtgcccgtttacgattcggtgcaacatggcgggtaacgccgacggatacccttttgacagatctgcgaactctgctgggtaacgagcaggtagaattagaatttgactaaaataggaacgttatgagtctgaattttctggattttgaacagccgattgccgagttggaagcgaaaattgattcgctcaccgcagttagccgtcaagatgaaaagctagatataaatctggatgaagaggtccagcgtctgcgagaaaaaagccttgaattaacccgcaagattttctctgatctgggggcatggcaaatatctcaactgtcacgtcacccgctccgtccctatacgctggattatattcagcgcgtttttactgactttgaagagctggcgggtgatcgtgcctatgcggatgacaaggcgatagttgctggtttggcacggcttgatgggcgtccggtcatggtgattggtcatcagaaaggccgtgagacaaaagaaaagatccgccgtaactttggtatgccatcgccagaaggttatcgcaaggcgttgagattgatggagttggcagagcgtttcaaactgccgatcattacctttattgatactcctggcgcgtatccgggcgtaggggctgaagagcgtggacaatcagaagccattgcccgtaacctgcgtgaaatgtcccgcctgtccgtacctgtcatctgtacggtgatcggtgagggcggttctggtggtgcgttggcactcagtgtgggtgacaaggtgaatatgttgcaatacagcaccttttctaccatatctccggaaggttgtgcttccatcttatggaagagtgccgaaaaagctccactggcagccgaagcgatgggtaataccgcaccacgcctgaaagagttgaaattgattgattccgttattccggaaccactgggcggggcgcatcgtaactatgatgcgattgctcaagcattaaaagcgcaattactggctgattttgctgatttggatcatctgaacagcgaagaattagttaatcgccgttatgagcgtttaatgcaatacggttactgctaagtcctgaaagctgtttttattacaatccagctttatttttaatattgttatttgcaggtggacagtactggggagagatagaacttcagtatttccacctgttttattgtttataggtaatgaaatcagcactctccatactgtctggtattatcattctgacaaaattgggatgaaataggctgttttatcagctagactcgaaaaataataaattgggtttttctatggacaaatataaatatattatttacgcgttttcctgtgtgttgatctggagttttgttccctccatatcccgtttgggtcaaaaagggatggaccatttccaatatttgttctggtcaaatattctatccgttctggcggttttctttgttgctgtcctgatgggtagaaatttgaaacaacttttatttattccctttccagttatgtttaaagttttgatattaggtactctggactgtttcttctatttattgctctattacggttattccatcgaaaacggcgttgctgtcttggtcgttcaatatagctggccgctgatgatcatcgggttgtcgtttttactgttaaaagaaaaattgtcaatccggcagatgattggcatcacgcttggttttattgccgttgtgatcacgtttacgcaaggaaatattacccggattgcagtagaacatccgcaggctctgttgctggtattcagtggggcattttgttttgccttgatgtctgtgttatcgaaacatttcgcgattgacccttatataaatacattttgggtatttgcttgttctaccttagtatcggcggtgtttttattggtatttagcagcttcaattggccagtgggtgattcactgatgccaacgctgctcaacggcatcatattgaatggcgtatcctatattatctggtttaaggctatgaatagccctgattcgcctaaaattgcctcaatcttatttttatcaccggtgttgtcgatgatatggcttattctgttctttggtgatgcatttgtccccgcttatgttgtgggtttagtgcttgttatcatatcggggctgctctgcatcagtgcaaagaccgaacctgcgacacagaataaattgagtgatgatttgattgaggattgataccgccaaatgaaagaaggttttcactcacaatgatcaatactcatatacctctgttaacgatgttaatcgatcagttagggcgacataaaaaagtcttggttggatttagcggtggattggattccaccgtattgctgcatttgctggttcagttacgttaccaatcccacagcggagtcattcgtgatcaaatagagctaagagcaattcatatccatcacggtttaaatccaaaggcggataagtgggttgaacattgtcgccagatttgtgccgactggaaggtcgattttcgggtcgaaaaagtcagccttgatatccggcaaaatggcattgaagcggcggctcgtgatgcccgttatcaggcattccagcatgaattgcaacagggtgaaattttggtcacggcgcagcatcttgatgatcaggcagaaacctttctgctggcattgaaacgggggagtggccctgccggattatcatctatgccttcttccatgccattttctggaacaacgctgattcgtccattgctgaatgccagtcgtgcagaactcgaaacgtatgcacaaacacagaggttgcaatggatagaagatgatagcaaccaagatgatcgttatgatcgcaattttttgcgtttgcatattatgccattgcttaaccagcgctggcctcatttccctcaatctgcttctcgcagtgccagcttgtgtggagagcaagaacaattgttggatgaattgcttaatgaatcgttgaatgagctgataactccggaaggtgcgatagccatttcaccgttggtggattgttctgaggccaagcgtaatgctttattacgtagatggttcaatcagcatggtgtgaagatgcctgcgcgtgaacaactccagaaaatttggtcggaagtggcgctttccagacaggatgccgagccacgttttagattggggcagcacgatgttcgccgttatcggcaacaactctggctggttcctcaatgccaatcgttggcaggaactctacttgaatgggatatagcacaagaactgcgattacccgatggtttgggcatgctggtgttgtcagaagaaagtggtattaatgtcagaatgcccgatagaaatgagcgggtaaccattcgttttggtgtacagggaaatattagcatcgtgggtcgtcggcattcccggcacagtaaaaaattatggcaggaattaggtatcgcaccttggcttagggaaagaacaccattgctttattatgatgaaaaattggttgcagcattggatgtttttgtaaccaaggagggacagcctttggcggaaaaggagatactttcaatcaaatgggacagaatgccgtattctgcttaatctacctatttcagccttaaattaacgcaacctcctataaagacatccataaacacttatattctggatttacgtaccatgctctatttatcaatttaccctcagtatctattaaaggttactgaaggtaaattttattctttactgaatatatattatgggatttgatttataccacagtgataaatgaacaaattgctggagtcatagctggaaaaaccaaacgtagataaaaatagtcatttgaaaagaaagccctcatttgatatatgaggactttgtgtgtgattttgtgtatcaatgtgagctttctgaacacggtcaggtcgagcaatgctcaatgctcaataacaatcgtaccaatttccgggttgctgaaactgatgatgtgatccaaccttaattcacgggtttcttcatttgattctacgagaatatattcgactttttttcttaaaatcagcttactagcttttccttcaaatatgccaccaccttgcagttggatgtgtaaatgaagctggtgctggcaagctagctcaaggttatcataatcatcacaattaattggttgatattcagtatctatagacatattttctcaccactatgttagtggcggttattgtgccgcccgtgattgaccaagatcaaacgcaaaaatgctacctacgactatagcacagtaaactttccgtgattactgaattaagtctgttgaattgcgttggaaagcaagtagattaaatctaagtcttatcattacgcaacgaaattacgtcatattatttgatttttttccctatgcattttgagatacggtacagtaatgtcaatcttgttaagaaaagttcatgttttacatggtatggacgttatgaatattaggttatctgctggatttattggatgaaaatgatgatgaataaaaaaatattgctcgctgtgggagtgttaaccgcggttgggtgtcagaacaaagtggcctctcaagataatgctacgcttcaggagaatacacttcagaataaattgcagacagctgagagagtgtttactggcgttgtaccttgtgcggactgtacaggtattgagactactttgcagctttcaagtgatggctcatatatattggggcaaatttatctggaagctaaaaatgaagaaaacacttttttcgaaacaggtcattggataaaaagcggcaaaaagatagatttgacgcatgaggatggtaagaaatcttattatcagatgaaaggtgaaaatctggtcatgctggatatcgacggtgaaccaatccagtcaaatttcaattatgaattgggaaaagttacgccgaaaaagatggcgggggaatacagctatatagctgacagtgcgacatttacagagtgtcgtaccggaaaacactatgatgcgtctgaaaatatcgatttggaacgtggctacagtgcgactggtgtggaagggggagagcctgtttatgtggaagtcgaaggttactactcgcttcggccttcgatggaagatggtatgtttgatcatgcactgattcaaacaggcaaaatccattttgataagtcagcctcttgtcagaccagaaaataacaaaacttagccgttatacataaaaaaacctgcgtattgaatacgcaggttttttctgaacttgaacaaaggcgcttaaacagtattaatgctgtttaatttgttctttcagatattcaataataccttccagtttaagcatttgcttatcaccattacgacggtatttgtattcaacttcgccgttatccagattacgatcgccaataaccagagtatgcggcacaccgatcagttccatatcagcaaacatgacacctgggcgctctttgcgatcatcgaaaatcacatcaataccattggcacgtaagtctgcatataatttttcagcaacttccttcacccgataagatttgtgcatattcataggtaaaagagcgacttggaatggagcaatggcatctggccagataatgccacgatcatcgtggttctgttcaatagctgcggcaacaatacgggttacgccaatgccgtaacatcccattgagacaacttgattgtgaccatcttcattttgtacagtggctttcagggcatcagagtatttggtgcctaactggaagatatgaccgacttcaataccacgtttgattagcagtgtaccttgaccgtctgggctagcatcaccttcaaggacattacggatatcggcgatttcaggcagtggtaagtcacgttcccagttaatgccgaaataatgtttatcatcaacatttgcgcctgcgccgaagtcgctcatgacagatacgctacggtcaatgataacaggcataggcaggtttactggccctaaggaacctgggcctgcctgtacaacggcacgaatttcttcttcggtagcgaaactcagcggacttgccaccaatggtagtttctctgctttgatttcattcagttcatggtcaccgcgtaccagcaatgcgaccagttgatgactgctttcttttgccgcatggacgatcagagttttgacggttttctcaatcggcaagttgaattgttcgaccagttcagcaatggttttagcatttggtgtctctaccaaatgcatatcttctgatgggacagctcgttcgtgggatggcataactgcttcagccaattcaatattggctgcgtagttagattctgtggagaaggcaatatcatcttcaccgctgtcagcaagaacctgaaattcatgggaagcactcccgccgatagaaccggtatctgccagaacagcacggaaatccagcccaatacgggtaaagattttgctgtaggcatcatacattttatcgtaagtctcttgtagagactcttggctggtatggaaagaataagcatctttcataatgaattcgcgtgaacgcatgacaccgaagcgcggacggacttcgtcacggaatttggtttggatctggaacaggttcagtggaagttgtttatatgaagtcacttcattacgaaccagatcggtgatgacttcttcatgagtcggcccgagaacgaaaggacgggcaccacgatcttcaaaacgcagtaattctgggccatattgttcccaacggccactttcctgccacaaatctgccggttgaactaccggcatggaaacttcaatcgccccagcattattcatctcttcacgaacaatgttttcgactttttttaatacacggacacctgtaggcatccagttgtacagacctgaggcgagtttacgtgtcatgccggcacgaagcatcagtttatgactgacaacctccgcatcagcaggcgtctcttttaaagtagagagcagatattggctagtacgcatagtaagtttccattggacagcaaattgcttctgggcgacaagattgtgccacccaacccagaaaataaagataaaccgctagtctaccagcgagtttgctatgtcaaaaggggttttaacggtgttcaatagaaaccacttccgtcatggcgtcacgtatctgccagcgaacattgaaatccagaatatgaactgcatatatccggttttcctgttctttcttacgataggccgggcgaggatcctgcgccaatatctgactgatgaaacgtcgtaaatgaggataatttgcctgatgggacgatagttgatgttcagctattggcaagaacgagacttccattccggtgtctggcgccttctgtgcaaaacccgctctggcttctgggcgagattcggcaaaaggcagatagggcttgatatcgataacgggtgtaccatcaactaaatccagactgccaagttccagtatgacccgattgttctggcattgaatacctttcaattctaccagcgacataccaatcggattggggcggaatgtcgagcgggtagcaaacacgcccattttggcatttccccccaaacggggtgggcgaactaatggattccagccaccattcatagtttggtgaaaaacaaaaataatccataaatgactgaattgttcaatcccacgtatcgcatcaatctggttataaggagccagcaactctagttgtcccgccccatcttctaccaaacccggttggcggggaatggcaaacttctctttataaggagaatggatggttcctatttgagtaaaatgaaaatcggccatgagcgtttttttaatcatcgttatttagtggtaagcagggcagatccttcacaaatcgcagtctggtagcagttgtgattagacagtattgcgcattgatgaagtaatactgcatcagctttcagagatgcggcttttaccagcatgtttttccgtgcaactgcaatgctggcaggcggatcttgtcgtgtagtgcgacaggattccccgaaaacgatgcctaaatttttaaatggagtgcctaacagttcttctgtcttagtgtatagctgaacgtaagacgacactttacttttcttggctggctgatgtttcaactttgagcctgtctgagtaggtttttcgacctgagttgacagagaagtacacccaaccataaatagtgttatgaaacagataggtagcatacgcatcgcgttgaatccttattctggtaaggccggtgagtgggggactgtgaatgtcgatacatgaaactgcgataaaaagcgtttggctcccccaatcaaaatagggcggataataatatccgccctataattttaatcttgattgactgaagatgaaaggttaccagccttttagcgcaccacccttgaaaattctctgggcagcttgttctacttcctcagattgataggctttaacaaacttttgaacattttcagcgtctttattgtcttcacggctgacaatgatatttacgtaaggtgaatctttgtcttccacaaataaaccatcttgttctggcgtcaaaccaacctgacccgcataggcattattgataatagcaaaggcaattttttgatcatctagcgagcgtggtaattgcggtgcttctaactctacaatatctaagtccttagggttattgataatgtccaaaacggttggtagtagacccactccttcttttagcgtgattaagccttgcttttgtaataataaaagcgcccggccttggttggttggatcatttggtatcgtaatctgattaccattttctagctcacccagagatttaatttttcttgaataagccgcgattggatagatgaaagagttaccaacaatagtcagcttataattgcgttctttcacttgctgatctaaaaaaggtttatgttggaaaacgttaacatcaatatctcctttgttcagtgactcatttggcagaacatagtcattgaacgtaatcagctcaacatcaagtccatatttctctttggccacttttttggcaacttctgccacttcaagttcaggcccaacaattaccccaaccttaatgtggtctggatctcttggttcctgatcgcagcctgcaagaattaatgttcctaataatgcactgattgcaacgatggatttcaattttactgacataatttacctctgtttaagtcactttattatttgtgattaactgctataatcaagcgatcaccgcctaactgaattaagaacactaaaacaatcaacaatgctaaaacagtattcataacaggtgcattgtagccaatgtaaccatattgataaccaatctggcctaagccacctgcgccaacggcacctcccattgcggaatagccgaccaaagtaatcaaagtaatcgttgcagcatttattaaactcaactgggcttcaggaagcaggatttttttgacaatctgtaaaggcgttgcacccatcgcacgtgcagcttcgatcaatccaggcggaatttccaataaggcattttccaccatgcgggcaataaaaggtgctgctcccacagtcagagggacaatcgccgcttgcaagccaatggatgtaccgacaattagccgggtaaacgggatcatccataccaacaaaataatgaagggaattgaacgaccgatattcactaaggcggaaagaatacgataaagtgtaatattctccataatctgtcctgcacgggtgacatataaaagcacaccgattggtaaaccaattacaaaaccaaaaaaacctgaaacaaaagtcattactaaagtttcccagactcctttaaacaataagaaaatcattccatcagacataaccgagaacctctacttttacatggtgttcttttaaaaactcaattgttgattcaatgctactgtattcaccgcccaattcggccaacatcacaccaaatttaacgccaccagcataatccatttgtgaactcaatatgctgacatcaatattaaaacggcgtacagccatagaaattagtggggcatcaaccgatttgcccgtaaattccagtttcaataatggtagactatctggcgtgcattcaggttttaacttttttagataactttccggaatatcgatatgcagcgttgatttaataaattcttgcgcaacaggcgttttagggtgtgaaaaaatttcgcttacaacatcttgttcaattaacagacctgcattgatgaccgcaacttggtcacaaatacgttttacaacatccatttcatgagtaattaacagaatcgttaagcccagacgacgattaatgtcttttaatagttcaagaatagaacgggttgtggctggatcgagagcgctggtggcctcatcacataacagtattttgggtgagtttgccaatgcgcgagcgatggcaacacgctgcttttgtccaccagataaatttgccggatacgcatcatgtttgtcagagagaccaactaattcaagcaactcgctgactcttttatttatttcgttttttggcgtattatccaactccagtggcaatgccacattaccaaataccgttctggatgacagcagattgaagtgctgaaaaatcataccaatatggcgtcgggcgtgggtcagctcacgatttgacattgaagtcagatcttgaccgttaaccaataccttgcccgatgttggacgttcgagcatatttacacagcgaatcagggtgcttttgcctgcgccagaagaaccaataacaccataaatttgtccctgaggaacatgtaagttgatatttgaaagcgcgttgatagaacgcgtccctagttgaaatactttatttatttgagtcagctttatcatgtttttctcaggcaacaagtcatgaattgaagtggatgttaaggtgtctagacgtctaagtcaactgtgaataaattaaattataaatgaattagcatcatcaatcgcttcctaatcaaagcataaaactatggttctgaattatcactagaaaaaaggcagcattttacatattagagtgctataccacattagcgtttaggagaaaaatgcgttttcaaccaaatgctgggaaacgatagagttcattattatattcctactttattttacgatttttgggattaataatttggattctcattccttatcatttaagttacttaatattactagcctcaatacgtagggcgcgagcacactattttaggtgcttttctaagattattatttcttaaaaataaactttaatagtgttttcattgagcaatatttaatcacgaaagcaattatttacactcttttagcaaacaaaagagttaaagaacaatattgatattttaagtttaaatattaatcaaagtatgctcgcaccctgcctcaatacgttagcaaatgctcattcttcgttccttcaaacatgattagatttggtgaccatctaagtggtcaccttaacttttttacgctattaacctgatacagaagccatttgtcaattttagaataattgcatattggcactgggaaattagttacagattctgtatcgaaggaattcatacagatataaataataaccgaatagcaaaactgataagtacaatccccattactctttcaaaccaataccctttttccatgaatttattacgaatcaatacattcgaaaaaataacactaaccagcacaaaccatactgtattagctatacacatccacaagccataaaagacttgtatcagaataggtgtattaatactcaccacggtcgtaaaaactgctaaaaagaacaatgttgccttagggttaagagcatttgtcataaaccccatcagaaatgcttgccatttactttgtgaggtctgaataatatttttactttccaaagtatccggattgacaggtttacttttaataaatttgataccgagccatatgatataaagtgagcctaccagttttgccatttccattaaccatggggtggaatgcattaatgaactgattcccaccagtgtatagactacatgtactgatatacctgcaccaatacctattgccgtgcataccccagctaaacgaccaaattttacactctgctgtatggtcacagcgaaatctgggcctggtgctactactgctaaaaaatgaatcattgctagccctagaaattctccccaataattagatagcatgttaactccagaatgacagaggagctgcttctccacgataacctataaagcaagacagacttaaacgtgagctaccgataccagcagttacagcgtgcatacattgggcattaaaaatcaaaagttcgcccgcgtccggttgaacctctagtgccggttttccaagcaaagaaggttcaataccataactatccctgcgcatagaatcaaattcttcaggagataatttatttttccaaacttgtaaagcaccaccttcattaggcatagaaagataaacattagcggcaaactgtgcctgaaggctcttggctctgaaactatctggagcatctttagcaaaaatatcatgatgtgcaagaaaagtcactccgggttcaactacccttgacaatcccacatacattttcttcccataaagtgtttcgagttgagcccctgctggccaaacttcgtctaaaacgcatctcagttgatctattggtgatagataaggtgaacaacgctgcctcagttcgttgatattattgagcacattttcaaaataatctgctacacggagtgccttattttctgtctcgtaaaatgccatcccgatccgacctatactcggcgcatttaaatatttatcaaatccttttcctaatattttttcacttattttttcagctaaggaagtaggaataaatttttttatacgtatggctaaaatttcttgtttagcaagtttttctatacatgcgctattaagacgatctgtttctataatcataattatctcttttttatttattaatgaaattcgaaagtgttgctagttacaaaccactttataatgtactatttcgcatttttatgtttttatatctttttatttttataaatgtctttatataatagtaatgttctcaaaaaggtatatttcgtactccgcactgtatacagaatataagagtcttctacaattttaaaatgttatttagtcatgtctcatgcgagagtctcacttattatatgaattcaggttttaactcttattccagggcgagagcgtgaacgttttctaatcttaagttatgtgtaatacaatttatatatggattaaaaacgctcaatttagtcttgttcaagtattgaaaagtatttcatttaaatcaattaaccaaaaaataatcatttatgctctctatatgaacgcgtttcatttgtaagataatagtgactttgacatcgacggtagtctgcagttttatattattaccgttgcccctgcaacctttttgcattcatcctcgtagttaattaaatcaaatgtcagtaatctttatcgctacggattttctgggctgctgaactgccatccaaattgtccgtgaatccatcacgtcatttttgtttcccatcatatcgggaatgctgtcacaaatttggcctgaaacagacgaatctcgaaccctaatttttgagttctcacgcccaatagtgagttcccctacaggcttctatgccgataaggctcccggttgccagggaggggaattactgccgctggagctacttatcgacgacttcactagtatattcatcgacaaaatgaacctgcatcagatgttttgcaatatcgaagccaaacggagtatatttcatgggtggttcttcctgttatcagggagcaataagcttcacgtatttaggcactataaggttggaaatctgtgagcaaccatgcctcatctctcacttccaacactgtggttgggatgcgttcgttacattccctgtcattgtgaatatacatcaataacaaggaatttgaataataacatagaacagatattcgccattgtgttttcatattctattatgtcaaattataagatattttattattttaaatcacaaagtgtcttattagctctcctattaatctacataatagttatattaaattcaagtgataaatatactattttatagtgaaaagattatttggtgtgattttctgtgaatataaaattgttataatataactatttctataattaatttaaattaaaacaatgtattgcattgttttaatgactaggattacattaatgtttatttaaaaaataataatcaatgtaaaaaataacaaatattattatgctattattaaataattaatatggtgaattaaaatttcggacagagtagtcgcaaaaatatatcgcacatgaaatcccagattaagtaaccttatatcttgattatcacttttacagagcgataatcccctgactgatcatcagggatgctgttgtgagtttgttattattaatctgaacctgaaatgggtcattcaatggagttcgtcattcagagtaaatcacaatttatggcctcccacgtttttgcaacactgattttgatacattgttggtttgcttcaatctatccggagtctcaatgagcaaatgtgtccgcgccttagtgaggtttgcacctgacctgacgaatctaacaacagccccagcttcactgagccattgacatttacaggtttaacacggccacctgttcctgtttgccggggaaccaaacccagataggtggaaaactcccggcctgatcggaaagtggtcggatcccccatcgtagagatggccgctgtagtccgtgtcccttaatgcaaattgatagtattatcatctggactgttttcaatacgggaaaaagatgatggcacgttacgacattcctgatgaggcatggatattgatagaaccttgcttgcccctattcattcaaagcgagcaggacgtccacatgctgaacaccgccgtgtcatgaatgggatgttctgggtgctatgttcagggacactgtggcgcgacttaccggaatgttatgggccttggaaaacggtctataaccgatttaaccgttgatcaaaatcgggcattatcaataagatatttaatcggttactgtccattctggatgaaaaaggtttgattgactgggctgaaatttttctggatggcagcaatattcgcgcgagtaaagatgttctgctcaagacaagaaaaatcggacactattacaaaggccatttcatcttccacaggtgttaaatcattattggccgtgtgcaatcgtgttaaattgtaataatgcagataatccaatacatttttttcatctctgcctggttttcatgatgggttttgaagagctaatcatgtttcaaactgccaaagaaacgttcgacaaaagcgttatcccaacatgccccgacatccccctggcttgctcttatgtcataactgctgagcaagtcccggtattgctggcttgtatattggctccctctatcacgatgaaaaacacagccttgtgacggctgacgtaagtaacctgagatcggtttaagccattacttgaagtcctgttttctcggtatttgagagattcagtgatggcttttttggcttcaaacaataggcaatcaaaccgcccagcaaattcaacatgaagccatgtaagctccgatggcgagaatgctcaatctgagtgatatttttcagttggtcattaatagtctcaataatgaatcgcttagcgagcatcgctctatcccaagccgctaataatttgggtttcatatttttgcgttgccctgtgaccaatgtgatgccttccatttctaactcttccgttaaggctttgcttatataacctttgtctgcatagagtttatctaaaagccccttggaaagcgccttaactggggttctatcatcaacattagctgacgtgagcttcgtggcgacaatctcaccaagatggttaacgataatgtgtagcttaaatccgtagaaccatcccattgttcctttccctctagctgctgcccctttaaaaacttgatgccgtggtattcgcaggttatggcacactttaatgcgggttgaatcaatgaattcgaggcctgttggctggccttttaggtgggtaaagaaggagcttaatggagccaaaaccgtcggcatgacctcaagaaaacgtgtgtagctcaataatgagggaaagtcttttttgtggtataccgtcatgaacccaatataaaaatgtttaaaatcacgctgatgggacatatggaaggcaatgataatcgtcatgatttcactggttgtcattcttgttgggcgtaaccgctggcattgaccactttcaatcagatatttttgccattgaggcatgaacaatttgcaaaaatcatcgacatgacaaaataagtcaactaaattatgcatagcgggttcctcagtgaaaagtttcttttttggtcaaaagatctgatcacagaacccgcttttagttctcttcttttttgtttctcttatcccgagttcaggttaagtaatacgcattcattaaagcctggctgattaaggtcgtatctatttccgttgagatctgccatcccactgtccgacgtgagtacaaatccatcacaatagctagagataaccaaccttcgggcgtcttcaaataggtgatatctccagcccaaacttcattcggcgccaacggattaaagttccggttaagtagattacaggctgttgatatcgctttatctttgcgcggagcccggtagcgctgccgctgtctgacggataatccgcgctgattcataagctctcgggtccgatagtcactgatggtaaggccttctttgcgtaattttttcgccaacatccgatagcctaaactttcccggctttctttaaagagcgccgtcgcttttcggtttaatgcttgttgctcatcagaaagtaaccgaacgggttttgcctgccaggcataaaacgtggaacgactgactttcatcacgcgacatatattggcaaatgggaaatggctctgcatgttcctttatgaacccacattttacagcagttctcccgcaaagaaggcgctcgccttctttaagatctccttctccattttcagctgtttattttctttacgaagctgcaacaactcctgtcgctcatcgggggttaaagcactgggtttagattgctcaacatcatgtttccgccacgtatacaggagttttgttggaatacctaaggtttcagctgcctgtgggactgtatagctctgttcaacaaccagattgaccgcttatcttttaaagttatcggtaaatttttggggtgattttcgtttcataaagacactttaattaaagtcattctattcctttaccaaagtgtccgaatttattaaagcacaataccgccttcggactttgtgatagctgacaaggggtacgatagtcaggcattcagaactgatattgaacaacaaggggcaacagcagttattccctaccgaaaaataatctaaaatcggataaaaaggttgataatggtttatatcgttatcgtcatttagtcgaaaatgggtttgccagaatcaaacattttcgtgcaatcgcaacaagatacgataaattggcgcgaaattacgccagcacattggcactggcatttgtcattatatggttacccatgtggctcgagtaaatgatgaatgtaaaacgtcaacacgccctagtatcatctaatttatatcctcaccttattattcagtcataaatcatgcgatactgtctgctttgtacgttcttggagcaatcaagtgactcaaagtattcccgctgtatttttggatcgtgacggcacgattaacatcgatcatggttatgttcatgaaatagacaattttcaatttattgatggcacgattgaagccatgctcgaattgaaaaaaatgggttacgcactggtattggtaactaatcagtctggtattgctcgagaaatgtttacagaagatcaatttttgcagttaacagaatggatggattggtctctggcagaccgaggtgtcgatcttgatggcatctattattgcccgcattatcccgaagggagtgctgacgcatataagaagaactgtcattgccgcaaaccgcaaccgggtatgttattggatgcacagaaagaattaagcatcgatatgtcagcttcttatatggtgggagataaaatagaagacatgctggcagcaaatgcagcgaatgtaggaacaaaagtgctagttcgtactggaaaagcggtaacagaagcagtagaacaggctgctgatctggttattaatagccttatagatcttccaaatgcgnataaaaaataggcaaaaatagcctttttgcctgaattataatcacttgggtaaataattcanaaaaaagctgtctaaagggtccgagctcgaatcgtatca

SEQ ID NO: 14978 - DNA, 125893 bp, Xenorhabdus bovienii
  unsure (1)..(125893): unsure at all n locations
  Genomic contig Name=Xb4151_4152.C437
actcttgcgaaaaagccctcttacccaaaagtgagcgtcttatcgcggaagcgttggaacgcacgccagaagaaatttggccttcacgctacgtcaaaaaataattgaaattagacccagcatttgctgggttcatttacaagcaatcaacttgctaatttcaaaccaataatacctgcaacaatcaaaccaaggctcagtattctggcagaattggctggctccccaaataccatgataccgaaaattgccgttcctacagcgccaattcccgtccacacggcataagcggttcctgcgggtaaatttttcatggaataggctaataaccctatactgaccatcatcgcgctgatggtgatcaggctgggcatcaaacgggaaaaaccctgagtgtatttaaggccgactgcccacacaacttcaagcaaacccgcaaccagaaggattaaccaagacataccattttccctttatcaaaaaggcaatggggtcgtccccgatgagatgatatttatccgggtcgtcccggataataataagaaatgccgctggattataactagcctttctgatagccgcaatgatagttcctgattaccagcaataaaaatctatggtccccaccttttttgcaacactgatttttgattgatgttggcttgcttaaatctatccggcgtcactatgggcagggatgcccgcgcctcgatgagttccgcacctgataagcctaaaaaaccgcacggcttcagagagccattttttatgtcaggattccatcaggtcgataagccgttcatgtcatcaataatcagtcttcgcaaaaccagattgggaactgctttaattaacgattaacctgccagtcagactggcgtcgtcgttacctttcgaacacagtttgccgtgttgtgattgcccaggctatccgggctaatttgttggccagcgcacaggccacaacatttgagtgttttcgctcaagctgagcctttacccattcagccagccttcctgactgataatcgattctctggataaagactctggcgcactggacaagtaaccgtcgcagatttttgtctccgcgtttacttatccctaaaagcgtatttttgccacccgtgctgtactggcgtggtaccagaccggttgaagcagcaaaatcccggctacagccatactgcttaccatcgcccagctgcgatgataagacgctggcagttatcggacccacgcccggtattgtctgaagacgctgtcctgtttcatcacgtctcagctcctgctccagtgccgtctcaagctcggtgagctgttcgacaagataaagataatgggcatgtaaatctatggtccccaccttttttgcaacactgatttttgattgatgttggcttgcttaaatctatccggcgtcactatgggcagggatgcccgcgcctcgatgagttccgcacctgataagcctaaaaaaccgcacggcttcagagagccattttttatgtcaggattccatcaggtcgataagccgttcatgtcatcaataatcagtcttcgcaaaaccagattgggaactgctttaattaacgattaacctgccagtcagactggcgtcgtcgttacctttcgaacacagtttgccgtgttgtgattgcccaggctatccgggctaatttgttggccagcgcacaggccacaacatttgagtgttttcgctcaagctgagcctttacccattcagccagccttcctgactgataatcgattctctggataaagactctggcgcactggacaagtaaccgtcgcagatttttgtctccgcgtttacttatccctaaaagcgtatttttgccacccgtgctgtactggcgtggtaccagaccggttgaagcagcaaaatcccggctacagccatactgcttaccatcgcccagctgcgatgataagacgctggcagttatcggacccacgcccggtattgtctgaagacgctgtcctgtttcatcacgtctcagctcctgctccagtgccgtctcaagctcggtgagctgttcgacaagataaagataatgggcatgtaaacgcatcagcaactgtgccagatagggaggaagttcgttctctgccaagacggttgaaagtctttttatcacggcggttccgatcggcatactgatgccaaattccagtaaaaaagcgtgcatctgattagtggttttaaccctgtctctgaccagtgattctctgacccgatgcagggcgcgcatagcttgttgcgcctctgttcgtggttgcacaaatcgcatggagggacgagatgcagcttcgcatatggcttcagcatccacaaaatcgttcttgttgctctttacaaaaggacgaacaaattgtggagaaatcagcttcgcttcgtgaccaaaagcagcgatccggcgagccataaagtgagcaccggcgcaggcttccattacaacagtcgctgatggcgatcccgctaaaaactccatcagtctggcgcgggtaaattttttacgcagcagggcctttcctgatttgtcctgacagtgaacgtggaaagaatgtttgccgagatcaataccaataagcgtaacgttttgcatgatggtcttctcctgaaagaaacaccctgccagcataccgctcacagggtggtggggaccatctcattaaccgcagtctctaaacgaggatactgcggttttttcaatagcaaatgcgattatttcacgcgagaaacgtattcgccggaacgggtatcaactttaatgacttcaccaatctgtacgaacagaggaactttcacgacagcgcccgtgctaagggttgctggtttaccaccagtgcctgcagtatcccctttcagaccgggatctgtctcaataatttccagttcaacaaagtttggcggagtcacagaaataggacgtccatcccacagggtcagaatgcattcagcctgatcgatcagccactttgtgctgtcaccgacagatttttcatccgcagccaactgttcaaaagtctcattgttcatgaagtgccagaactcaccatcgttatatagataggtcaggttcatatccacaacatcggcactttcaacggaatccgttgatttgaaggttttctctagcagtttgccagagatcaatttacgaagacgcacacgggcaaatgcctgtcctttacctggtttaacaaattcgctttctagaatagcgcacggctcgccatctaacatgattttaagacctgaacggaattcgttggtactataagtagccatggatatcctctaatttttaacaaaatggcttagccaaaaaatggcacacattataacccatattccccctgtcagagaagtctggctaaaacaacttgcagatgtcattactgatcctgatgagctgctacaattattatccttaaatacgcacgccatgctgaaagaaggcaatgaagcgaagcgtttatttcccctgcgtgtaccaagagcgtttgcagcacggatgaaaaaaggcgatcctcatgatccattgttattgcaagttctgaccgcacaggaagaatttgaaactcaccctggtttttcaaccgatccgttggaggaacagcacagcgcagttcccgggttactacacaaatatcgcaaccgtgctctgctgctggtcaaagggggatgcgcggttaattgccgttactgtttccggcgccatttcccctatgaggataacaaaggcaacaaaaacaactggcaactcgcactggattacattgaacagcaccctgagcttgatgagatcatcttctccggcggtgatcctctcatggcaaaagatcacgaactagactggttaatgactcgccttgaatccatttcacacatcaaacggctacgcattcatacccgtttgcccgtggtgatccctgataggatcacactttcattgtgtaatcgtttcgaaaaatcacaattgcagataattatggtaactcatattaaccatgcaaatgaaattgataatacatttcgcgacaaaatgatgtggctaaaacaggctggcgtaacgctactgaaccaaagtgtgctgctgcgtaatgtaaatgacagtgcagatactctggcagatttaagtaatacattatttgatgcaggtattttgccttactacatccatatattagataaggtgcaaggtgccgcacactttctggtaggcgatgaagaagcaaaagctatcatgcgggaattattgactaaaatatccggttatttagttccatgcctggcaagagaaattggcggtgagccaagcaaaacccctctggatttgggattgaagcaaaaaagttgacatggcaagcgtagccattagacacgttcaggaacggacaacgccagaaactaaaacgtacacagagccaaccatgctctgtcacgtttttctggctgctgccctgactgactgcttattaaaccaaacaataacactgtaaattatctctcttcacgcaatgatacagtacagagcctctgtcttttatcaatatttatgggcacttataaacctgacctaccattttgctatcgagtggcacaaaaatgcccaacaggttttctgtccgactaagtgggctatttgcgccataaatgacgttcccacccaattctgccgctttattacgcaagtcattggccgcattgcgcattgaactgctttcattatcaataccattaagccaattgctttgcatccctatcacttcgcccaatcgctgacattcactgcccggctgagtatccacaaaacgtacattggaacctgcggctgttaattgattgttcgttacacatccagccagcaataagattgacgctccgagtaagatcttaattcgcatgtctttccccattattgttgaaaattctaccgtgatgataaatagactcttttgtattccattaagacaaaaaagtaaaaaggcgagcagaaaaatctgctcgccttcaaagtttatcctattggatggacaattccatcatcaggatcagcagcactacatcatgccgcccattccacccataccgcccatgccaccagctccacctaagtcagctttgtcgtctctaggcagatcggtaatcatcgcttcagtcgtgatcatcagaccagcgatagagcctgcgaattgcagtgcagagcgagtgactttagttgggtccagaatacccatctcgatcatatcgccgtactcttcagttgcagcgttataaccgtggttaccctggcttgctttcacgttgttcacaaccacagatggctcttcacctgcgttttctacgatctgacgcattggcgcttccattgcacgcagagcaacgcggatacccacgttttgatcttcgttgtcgcccgtcagagcagagatagcagcagcagcgcgaaccagtgcaacaccaccaccagcaacaacaccttcttctactgctgcgcgggtcgcatgcagagcatcgtcaacacgagcgcgtttttctttcatttcaacttcagttgcagcaccgactttgatcactgccacaccgcctgccagtttcgctacgcgctcctgcagtttttcacggtcataatcagaagttgattcttcgatttgctgacggatttgagtaactcgtgcagcaattgcggccgcttcgcctacgccatcaatgataattgtagtgtctttattgataacaatgcgttttgcctgacccagatcttccagagtcgctttttccagctccagaccgatctcttcagaaatcacagtaccgttggtcagagtagcgatatcctgcaacattgctttacggcgatcaccaaaaccaggggctttaaccgcagccactttcacgataccacgcatgttgttgacaaccagcgttgccagcgcttcgccttcaacgtcttcagcgatgataaccagcggcttacttgccttggctacaccttccagaactggcaacagttcacggatgttagaaattttcttgtcaaccagcaggatgtatgggttttccagctcgatagaacctgcttctggtttattgatgaaataaggagacaggtagccgcgatcgaactgcataccttcaacaacatccagttcatcttccagaccagtaccttcttcaacggtgattacaccttctttaccgactttatccatcgcttcagcgatcaatttacctacggtttcgtcggaattggcagaaattgtaccaacctgcgcaatggcagtggagtcagagcaaggtacggacagttttttcagttcttcaacagccgcaataactgctttatcgataccgcgtttcagatccatcgggttcatgccagcagcaacggctttcagaccttcagtgacgatagactgtgccagtacagtagcagtggtagtaccgtcgcctgccgcatcgttggctttagaggcaacttctttaaccatctgtgcacccatgttctcgaatttatcttctaattcgatttcacgcgctacagatacgccgtctttagtgattacaggcgaaccaaaagatttatctaaaacaacgttacggcctttaggacccagagtcactttaactgcatcagccagtacattcacaccacgcagcattttgccgcgagcatcattaccaaattttacgtctttagctgccattgtgtctttcctttaaattcgttcaattaagaagatctaagagcaaaatgttcaattacgcttcaacaattgccagaatgtcgctttcagacatgatcaacacgtcttcattgtcgatcttttctgccttaacaccgtaaccttcgttaaaaataacgatatcacccacttttacatccagcgctttcatttccccattttcaaggatacgaccattgccgactgccaaaatctctccacgagtagatttgctcgccgcagagccagtcagaacgatcccgccagcagattttgattcaacttctttacgcttgacgataacgcggtcatgtaatggacgaatgttcattgatagatctcctgtaaataaagtccatatcaggtaagaggattgatactagagcctaataaaaccagtaccatgaagctacaagttggggcttgcaggcagtacttcaaggggcggacagtaaaaaatatttcactttcttcttacccactgaaatctcagccaaagcaagtacaattactttttgtcgtgctcgttgccatgttcatcgtgacgtttctgaccatccagtgtataggaagcatcatcctgcctacgctcatactcgccctcaaaagtctgcccatgatggccgccctgaccatcttgcccatgattattcggacggtaaaaggtgatatgaggcagcaattttgctgtcagcagcttctgcgcgggtggcaataacaacagcaatccgagaaagtcagtaaaaaacccgggcaatattagcagaactcccgcaatcaccagagaaacacttttgatagcctctttcgcagggctttcgccagcagcaattttttgctgcatcgacataaaatttttgatgccctgattacgtacaagggaaacaccaacacaagaagtaaaaatgactagcagcagagtcagtaagactccggcttcagaggcaatgcgaacaaataagactgattcgatgtaaaccagcaaacatatcaggacaaatgggagccaacgcacgtggttctcctttcattaatgagtgataaaaccattgggatgaaaatattccccttgaatattgttagcaaagagctacatggccagtaaaccacccttaaatttgcatgttcatcatttattgacatagttacggattacaaaatttgtaaatcatagagtggggatgataataacgcttttcaatacttgagacctttgactttacatctccgtaatcgtgacttcaatcacacatatgtcatttcattaataaaattcgcactataaagtgatccaggtacaaggcatttctggtaaatccacatatgatcgcgccagcaatccagtgataagtgattaatatcacggcagttgccgacggtgacattattctcaacaaaaacgtatatagaacagtaaaaaaacgtatccaaattaaagaaggttctcatgtcaaacaacattcgtatcgaagaagacctgttaggtaaacgagaagtccctgctgaagcctattacggtattcacactctgcgtgcgattgaaaacttttatatcagtgaccgtactatcaatgatgtgcctgaattcatccgtggcatggtgttggtaaaaaaagccgcggcactggcaaacaaagaactccatactatccctggaaaaattgcggatattattgtcaaagcgtgtgatgaagtcctcaacacaggcaaatgcctggatcaattccctgttgatgtatttcagggcggtgcaggcacctcactgaacatgaataccaatgaggtactggcaaatatcggtcttgaattgatgggacacccaaaaggtgaatatgagtacctgaatccgaacgaccacctgaacagaagccagtcaaccaatgacgcttatcctactggtttccgtattgctgtttataattcaatcataacattgattacctccattgagttattacaagtcggtttcgacaaaaaagccgttgaattttctgacatcctgaaaatgggccgtacccaattgcaggatgcggttccgatgacactgggccaagagttccgcgccttttccgtgttattgaaagaagaaatcaaaaacatcacccgcacagcagaattactgctggaagtgaacctcggtgctaccgctatcggtactggcctgaataccgcgccaggctaccagacgctggtggttgaaaaattagctgaagtcacagggttaccttgcctaccagcagaagatctcatcgaagcaacgtctgactgcggtgcttacgtgatggttcatagcgcattgaaacgtctggcagtcaagatgtccaaaatctgtaacgacctgcgtttactttcttccggcccccgcactgggctgaatgagattaacctgccagaattgcaggccggttcttccattatgccagccaaagtcaacccagtggtgccagaagtcgtcaaccaagtctgcttcaaagttatcggtaatgatatctgtgtcaccatggcatcagaagcaggtcaattgcagcttaacgtgatggagccagctattgggcaagcgatgtttgaatccatttctatcctgagcaatgcatgccgtaatctggttgaaaaatgtgttaacggtattacggccaataaagaagtttgcgaaagctttgtatttaactctattggtatcgttacttacctgaacccattcatcggccaccacaatggcgatatcgtaggcaaaatctgtgcagagacaggcaaaagtgttcgtgaagtcgtattggagcgcggtttgctgaccgaggcacaattggatgatattttttctgttgagaacctgaaacatccgacttataaagcaaaacgttttgacgactaattaaataatgataataacgaaatcgtcttaattactgaggcacgcaattccaatcggaaacgtgcctttttaattcatcatataaattattccacttttacttttataaaatgaaacgttatcggcggagcaagctcaccgttgggcgtcggtggtgaagggatgaaactgataccaaaatcaaaggaatggcgttacctttaccgtgcggtggattcagatggcaataccattgattttttgttgaccgcccatcgggataaggaggcggccttgcgtttctttaagaaagccatacgccagaatggacaacccgacggggtaacgatggatccgaatggcgccaataaagccgcagtggacaagttaaacaaggaaaaaatcaccttatcttcactcgtactttctttattaatgcgacagaaccatgttttttactatgattagatttgctctttttggcttcttaatttccctcaagcaattgtacaattcagatagtttctgattggtaacattttcctagggagcctatacgaaaaaacccgcttcacgagagcgggttttttatcactacagcttaactgctcaggctattgccctcatcgctattgtaaactttagcgaacttatcggccgttaaagcgcgataacattggcagcagacgggcctttagcaccactctcaatggagaattccactttttgcccttcgtctaaggttttaaaatcgttaccttggattgcggagaaatgtacgaatacatctttgctgccatcttctggagaaataaaaccaaaacctttaccagcatcaaaccattttactaaaccagtcattttattagacatagatatttcctttaattttaagccactttatgtggtgaacatggcctgtttgcagagatttacttattgggcacttaggaggaggctcacgaagaaggatatctatggataacacttaagctgaggactgctttactaaaactgctttcataaggtctgtgttccaaaccgatttactataataaccacgtaatgatttatttagcaagaattaattttcattccgaagcttcccgatcaagtaaacggcaagaaatgaggcactatttttcgcatatcgcaatgaaacgtcgaagacgccagtagtgtatcgtgtaatttataagcaattataagcatatgcaattcagcccgttgcaataccccaaaatttcgagccgcctccctaacttgatcaatacgctaaaaatccgatacattcccgatctcaatcctgataacctaccgtcctattcttccctactacggccttgccacatgagatagcagatgacaggcttgggaacggtttttctgactttaatttttctggccttagtttgcccgaacttggttttctggctttaatgtaatcaatcaaatccacagatgaatcacaccgattatcagtgataagataacgttttcgcccgggatgaggttcattgcgttccatccttagctgattatatttaggttttgtcattttagatgggttgactgagcgtcgatggcccaactgagtcaacaggaatagtagaattgaatgcgatcaatatgaaagaatcaccagcaaaggatttagacagccatactcccatgatgcagcagtatctgcgcctgaaagcccagcatcctgacattttgctgctttatcggatgggagatttttatgaactgttctttgacgatgccaaaaaagccgctaaattactggatatttctctgaccaaacgcgggcaatccgcaggccagcccattccgatggcgggagttccttatcacgcaatcgaaaactatctggcaaaactagtacagctcggtgaatcagcggcgctctgcgaacaaataggtgatcctgccaccagcaaaggccctgttgaacgcaaagttgtgcgcattgtcactcccggcactgtaaccgatgaagccctgctgcacgaacgtcaggataatctgctggccgctatctggcatgacagccaagggtttggatatgccacgctggatatcacctccggccgtttccgtgtctctgaaatggcagacgaagataccattgccgccgagcttcagcgtacccgccctgcggagttgctctatcccgaaagctttggctccatggcactgattgaacgctgtagtggcctgcgccgtcgcccaatgtgggaatttgaactcgatacagcaaggcagcaactgaatttgcaattcggtacgcgtgacctgatcggttttggggtggaaaaatctacgctagcactgcgtgcggctggctgcctgctgcaatatgtgaaagatacccagcgtaccgccctgccccatatccgcaatattacggtagaacgccagcaagaaacggtcattatggatgctgcaacccgccgcaatctggaattgacccaaaatctggcgggtggtactgaaaacacactggcttctgtactcgatcaatgtgtgacacccatgggcagccgcatgctgaaacgctggctgcataccccgattcgcgacagaaacgtgctgcaaaaccgccaacaagccatttcagctttacaagagattggctttgaattgcagccgtttttacgtcaggttggtgatttagagcgtgtacttggccgtcttgctcttcgttccgcccgtcctcgtgatctggctagaatgcgccacgctttccagcaattgcctgatattcatcagatcatggcatcatctgattcaccttatattcaggcactgcaacagcgtgttggtcattttgatgaattacagacgctactggagaaagccgttgttgaaactcctcctgttctggtacgtgacggcggtgtcattgccccgggttaccatgccgaactggatgagtggcgtgcattagccgatggtgccagtgattatctggacagactggagatccgcgaacgtgacaaactcggccttgatacgctgaaagtcggctttaatgcggtgcacggttactatattcaggtcagccgtggacaaagccatttagtcccgattcattatgtacgccgtcaaacgctgaagaatgcagaacgctatatcattcctgaattgaaggaatatgaagataaggtgctgacttccaaaggcaaggcgctggccatcgaaaaagcgttatatgaagagctattcgatctgctgttgcctcatctggctgaactgcaaactagcgcagaagcactgtcagagctggatgtgctggcaaaccttgctgaacgcgctgaaacgctaaactacacctgcccgacactgagcgataaaactggtattcaaatcacgggtggacgccatcctgtcgttgaacaagtcttgagtgaaccctttatctcaaacccactaacactttcgtcacagcgtcgtctgctgatcgtcacggggccgaatatgggggggaaaagtacctatatgcgtcaggccgccttgattacgctgctggcgtatatcggtagttttgttcccgccgaaaaagtgctgattgggcctgtagaccgcattttcacccgcgtgggcgcttccgatgatttggcatcagggcgttctacctttatggtagaaatgaccgaaaccgccaatattctgcataatgcgacagagcatagcctggtcttgatggacgaaatcgggcgcggtacgtccacttatgatggtctgtctcttgcatgggcctgtgcggaaagtctggccaatcgcatcaaggcgatgacgttatttgccactcactattttgagctgacaacgctgcctgaaaaactggaaggtgtggttaatatccatctggatgctgtcgagcatggcgatactattgccttcatgcacagtgtacaagaaggggcggcaagtaagagttatggattggccgtcgcctctctggcaggagttccccgtgatgtcattaaacgagcgcgccagaaattaaaggagctggaatctctctccaacaatgcgacggcaggccacgtcgatacaccgcagttgacgctgctgacggaagaggtatctccggcagttgaagcgttggaaaatctgaatccggatacattgacaccgcgtcaggcattggagtggatttatcgtctgaaaaatatggtatagcagtgaagtttgatacccgtcggttagaaccaagcaaaataaaagatgggctaaataagcccaccttttggttaaaccataatatccctttcatctttcaagttgctactttattagttgcaacttgaaatctattggagataaatacttaagtgcggaataatgattcaatattcaagccttgagtatgcagtatgtctctgagacggcgcaaaccctcaacttgaatttgacggactctttcccttgtcaaaccaatttctcgaccaacatcttctaatgtttctgcttcgtacccaagcaacccaaaacggcgagccaagacttcacgctgttttgcattcagttcaaacaaccacttcacaatgctttgcttcatatcatcatcctgaatggttgtttctggccctgagtcattttcatcagataaaatatccagtaaggctttatctgaatccccacttattggtgtgtcaacagaagtaatgcgttcattaagccgcatcatacggctcacatcatctatcggcctatccagtttttctgcaatttcttcgacgctgggttcatgatccaatttatgggctaattctcttgcagtacgtaaataaacatttaattctttaacaatatgaataggcagacggatcgtacgtgtctgattcataatagcccgctcaattgtctggcggatccaccatgttgcatacgtagaaaaacgaaaacctctttcaggatcaaatttttccaccgcacgaataaggccaaggttaccttcttcaatgagatccaaaagtgccaaccctcggttactatatctgcgagatattttaactaccaaccgcaaattactctcaatcatacgttggcgagcagcaatatctccccgaagtgcccgtctcgcgaaaagaacttcttcctctgctgtcagcagaggtgagaaaccaatctctccgagatagagttgtgttgcatcgagaacccgttggttaacctcttgcaacaaatccaaattttcatcagcgttggttaaaccatccccgtctttcagcaacgcttcatcaaagtcatcggcttccatgccatgttcgtctaaatccgcctcatcatacaactcattaactttaagcgtactttggctcatcagctactcctacccatgataatgcgggcaggaagtcaggatcctgccctggtttatcgctgcggaagatgacgcagcgggtttacggattttcccttgtaacgaatttcaaaatgtaatttgactaaacttgttccagtactacccatagtggcaattttttgccccgcctgaacatcctgcgaatcacgaaccagcatggtatcgttgtgagcataggcactcaggtagtcatcgttatgttttataattatgagatttccatatccacgtaatgcgtttccggcataaactacttttccactggcagttgcaaaaacgggctggccacgactacccgcaatatcaatgcctttatttccacccttagaatccgaaaaaccttcaaacactttcccttccgcaggccatccccaactactgctaccactgctgatggtgctgccaggacttatatctgttgccgatgataatttcatagctgaactttcgctaacagaaattgtttttcttggcaacatcttttcggaactctgtctatcaatgtttgcaggatacgcattacttttttgaaaatcaacctgctcaattttagattgggtactatttgatgctagtaatacaccattactggagtttacattacccattctcaggacttggccaacattgaggttataaggctctgaaatgttatttatgtgagatagatcacgaaaatcaatgcctgtaatccatgcaacatagaacaaagtatcgccacttttaaccgtgtaggtgctgccgctatagcttcctttaggaatattcccataattgcggttatagatgatccgtccctgatgtgagccattttcaacagcacgattcactaaataacgattttccgaagcacgatgctctgatgaacgatttgctgaaatagttgaaggagaagatggcatgggtgtcgagatggacgaggttctggaagggattcctctattttgttcctgcttatcaatactcactatcggcgctggacgatccgatgtattgctacagcctgccagtaccactcccataacagagcttatccactttatttttttcactgagtttcctaaattcataccttattcccccgtaaaggcaaatataagttttaagcataatgatttataaagaaatttcgaattacaaaagatttaaagcaaaatattttgcttaacttcagcaaaaatgacagccaatttaaaaataatgacaaaataaattagcagattatgctagttcgccttgaattaggggaacaaaacggacaggttcgatcacttcgctgtgaaaatcactgccatagcgatgcaccactttaagcgactgagagcgctcccccacaggcagaaccatcactccgttatctgcaagttgatacaatagtgcctgtggaatttcgggcggcgctgccgtgacaataatggcatcaaatggcccttttgacggccacccattccaaccatcaccgtggcgggttgatatgttgtgtaaatcaagctgcttcaacctgcgtttagcctgccactgcaaacctttaatacgctccacggagaaaacgtgtctggccagatgggcgagtatcgccgtctggtaaccagatcccgttccaatctccagcacattggcttcaggagttaagctcaacagttttgtcatgcgagcaacaatgtaaggttgggatatggtctgtccatgtccaataggcaatgccgtattttcataaactttatgcgccaaagcttcatcaacaaaacattcccgaggaactctggcgataatttccagcaagtgctcgtcctgtattccttgctggcgtaattgggtcagcaaatttttcattgaccgactcagcattctcccatatctccgacttttaccaaccaatcgttgattaactcctgtgccttataagcggttaagtccacctgtaaaggagtaatggagacaaacccgtcttctatcgctgcaaagtctgtttctggccctgcgtcatgtttctcgccaggaggccctatccagtaaagcatgttacctttgggatcttccaaagcgtaaacttctttagcagcacatcgactgccgcatcgtgttacccgaaaacctttgatctgctcaatagggacgtcaggcacattgatgttcagaatattgccggcccttaagggagatttttgcaacaggtttaataggcgcatcgtaacttctgcggctgtttcataatgtctgtcaccattgagtgataccgccagcgccggtaatcctaaatggcgtccttccatcgcggccgccactgtgccggaataaatcacatcatcaccaaggttgggaccacagttgattcctgaaaccacaatatccgggcgaggaagaaccaggcgattaacgcccagatagacacaatccgtcggcgtaccttcctgaacggcaatatcaccattattcatcgtattgatacgcaagggacgatccagcgttaacgcattcgatgctccgctgcggttacgatcaggtgcgaccacctgaacatgatagtgttcccgcaatctggccgctaaggtttgaatacccggtgcggtaacaccatcatcgttactcagcaatatccgcagcattagcatatctcattgattttattaagagtggcataagtgggtactatatattgtcctgcatgttgtcctatttgattggagtgaccaataatcagacaatgtttggctgttaagaaatcgattgatcttaacagaggatgcttgcctatataaaggaaagaatctaatgggttctatcgcattaacaaagaaagtacgagtgaagataaggtgattgatttttactcagctaattgatagaaaaatgccgcgagtgaaatcggacacccttgcccctgttcaccattttgtcggtattgccctttgcgcaacatacagactaattcaatccctgccaacacggtctgggctcatctgaagtttttaaatcccagcataggacgtgtccgccgtttgacgttgcggtgatcctgttcaagcagattattaagatatagcagaatcaacataacctgacctattcaatatgctccgtaaacaactcatcaactgaacatctttttgcctccttatcgcttttgctccgccccatttgtgttctatagggtttaaatccggactataagcgggaagccattccagttgacatctgctgtctgctatcgcttgtgtcgtgtcattccgtttatggaaaggcgcattatccatcactatcactgctccgtgtggaagctttggcagcaaatcttgcgtccatccacgcataaaaaacatcggcattaatattcccggtaaataagcttaaggtgacgaaggtattttcgagaatggcgccaatgacgttgagacggccttttgcgtgccagtcatgcgtaccaaaacagcgtaacccttgccctgtttacgtggcatcgattgagcaaaaccactttcatccaagtaaacaatgggtctgccagtctgttcatcatcgctgatgcgctcgataaatgcctgacgagcttgaggagcagcgcgagggtgttggagcgttttttttctgggtgatccgaagccgtttcaaggcgtaatgaatagccgattgtgaaacacttaagcgttttgctctttcccattgatagtcatcaggaaaattttggacatccgcaatgagtacctcatcagggattttcgtggcgggtttatcgcgggtcatgcaaggttctattttattgcaccaccggaacaaggtacgcatggagatctcaaaatgggcactcgtttgttcgaaagtcaacgaatgcttgtctttgtatgccagtactcgctttcgaaaatctaagctgtagcccatctcattttatgccttgttatcttagagttagatattatgtcatattaatatgatttagctataacgccattgccctttgattttgatatacgtttcatccatgcgccaccgacgtccaacgtcaggcttgcttcgccgataacgtttcacgatcaacggaaccaagcgatgaacccaccgagagagcgcagcgtgatcaaccgcaattccccgttcagacatcatttcctctagattgcgcaggctcagggcgtaggccagatactagcggacacactgggcgataatatcaacaggatagtgcaggcgtttgaacgcttttcggataaggaacatcgctctggactcgctcaaaaacaggggagcttacctgatgaccgcttaatgcgacagaacccagtttctgcataacccaaaacggttatcattttattaagctaaagactttttctggctggcaatctgttttttaccacttgctgtatgcatattatttaattcatttgattttctttcatgttttaatttaacattagtcacatgtttaatcgtggtagtaaatttattaataactcttttttattcatttaatatgatagaacaagtgagtgtataaaatatgaaacaatcatttgaatcaataagttagtcattattatcccctttaggaaatgctatttttctaataatcacttttgttattttcattgttattttttatatataatgtttaaatctaaatcaggattttcaatattaaataagctatggttatttgcagtaaaaaacaaaaaaacatctgatgacgatctaataaatgaaataatggaagtggaaaagtttaatttttactacaatacaaacgcaacatcaataagacagaaggaaaattttgaaggctggataagaagatatgaattggattttaaaattatctctaaaatgaaaataaactttgacattgatacgcttaaaataaaaataatatcaatctcaattccatttctgtttttattttttatgtatttatgtatttatgtatttatgtatttatgctttatatcagcaatgcctgtggctttaaagcctgcaggcttgataaagataaatgatgatgacgggtggttttggattaataaaaatgaagctatggaatatggttttttaaataaacgaaaagacttatgggttgttactccagaaatgggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgtcctgatttgtggcaataacggcaatagacatcaactttggccatacttcatccttaaaaagccggaagcatatcacagcaactaaccatttaatacatgacccagaaatgggtcatgactctattttattgatagtgatgaatgttcagataatatcctataattctgtcatgcatttctatggattttgaaaaagacaatgttttgcgagtcagtcttgccaaatgttgacgaagattcaggttatgcctctctatgcgttgggtataacgcttgctggccacatggcgtttccctgcgagtgctttttcgtaacttttccagctatctgtcatgtaaataataatgttgaaaggtgccagtaaagctaataggcgcattaatgtcttttttgttcttggaccaaaaacatgggcgatcacttttcgccttatcctgtcgtcggcataaaagagccaacgaggcggcttctttgactttacgtaagaccattgttcatccatttcgcagcagacaatcacttcagtgccaggtttaatcgcttctgttaccgatttgggtttgagttttttaaatgccgaagtacggtattcaggccaatccccatcactcgtgctgtcgcccgacatcccattccattcatagccatatcgacgatttgcttatgggtaccgagacgacaagcggcataagtgaactcctgttgccaggagtgacggcaggattggcaaagataacgttggtgaccagaacgcgagcgcccattgcgatggatccctttcactgcggaacaagaggggcaagttacatcaatctttgccatttgaatgttttccaaatagacagactatacatgattcaataaattgatgtcacgacccaagatgggtgtgattatcaagaagttcctttacccatgcatattgtggatcagtttgaaactctgtcccaaataaaatatacatatcaatatagaactgaacgggaccgcgttgatcaaaaccgtcgttttttgctttttctacggcgtttgtcagtgcggtgcttaatccctccttacccaattttatttcaaggtagggataggattcattacaatacgctaccaattcatcaatataagcattgaacgcattatttttagtttattacattgctcttcattaaattctatggccatatttatggtatctccaatcataatgactaaggctatagtcgctggtgaaatatattgtttatgtcattttcagttcagcgactatagtttccaatttattatttatatgaatcaatcttaccttctaggtaatcgcggcaggtcataatatctctatgactattatgccattcattttctctattaataaaatttataggctggtaaaaatagccattatcatatgagctaattattcttattgttagcaattaatatttttttctttgtgggaaaatttaattaaaaaataatgggtgagggattttacttttttctttttcaatttttttggcgatatcgtttttccagtctgataagactgaggtgagactgttttttttccttcatgatgcaattccttttacaatataggcggtgttattaagctgatattgccattcttcaatatcctgagtgaaatgagtcaactgttccggcgtaaaaaggtgtggaatttgattcagaacgcggggatcgtaaaaacgcaacaacgctgtttcccccgtctttaactggatattcaagtaggattcgagatgacgggtcagtttatccagtgactgtgtggtatacagccaggaaacagccggtgcagcgctttccagccgcaggaatttgtcttcccatgcctgagcctgacgcatatcaaacagccacggcccggcaaaggcgacgctcaacgccgatagagccaaagaagaaaccatccctgtccgacagagacaatacctgaacaactgagtggagcaagatcaccgcaatatcaaacgtcggacacggccgatgttaggttttaaatcgtttcgccggactcaaacgattttagcggggatagagctcgtttcaatgctgcgtaaaggacaccatttgatagcgtattatcttaaacggcagtcgctaaggctttatccatcacatgatgaaaatcacgtttaaaataaatcagcccgtggccttcttccttgaccgcgatctgtttgacttccaccagatagacataatgcgtgccgatttcctgtacttgttcaatacttccttccagattggctagtgtttctttcagcatcggttgtcccagagcgcctgttttccagatattccagccaaagcgctcttccatgctgacgcccgtcattccggcaaaatgacgagcaatcaattcttgttcatgattcagaatattgacacacaggcgcccattttcctgaaatatcggattcatagcgctattgcgattgatgcataccatcagagtcggaggcgtatctgtcacagagcataccgccgttgcagttataccgcattgccccgcagggccatccgtggtgatgatatttaccgcagcggaaaggctcgccatcgcattccgaaaacgcaggcgatgttcattttctacagacataatagacctcctgctgctgatttatttcagcagcttatctaacaggttaatatcacggttattgtgtaaatggggttttgtccagccattcaagtcatagtctgaaagacagcgatccaccaattccgtcattttcttcatattaccggagccataggcatgacgcaggcactgtaggcgaatctcatcttgactgccggcataattgatttcatacaattcatgacgcccgccgaattcgctgccaatggcatcccacattaatttcaaaatcttaattcgctctacatggtcaataccgttagaaccgcgtacatatttctcaagatacttattgatttcaggattattcatatcgcgtacactggatggcagataaatcaagccgctggtgacattgctctcaatgatattcttgattttgctataagccatcggtgccatgacacgataagtctgaatcgcctgagtatccggcagataagcgccgccttcccacggtttggcttctgcccacatcgcatccgtcagtgaccagaacaaattacgccatgccacgacttcccccaaatcggcctgaaccccccggaaatctaccacaccagtacattcaaggctcttttgcagcaatcccgtaatgaagtccagtttgacagccaagcgtacacaggcctgcatggggaacagacgggcaaaaccgccttggacagcccaattgcgggcgcgatcaaaatcgcgataaattaacacgttttcccacggaattaacaccttatccatgaccagaatggcgtcattttcatcaaaccgactggaaagggggtaatcgaaaggtgaacccatggcgccggcaaccaattcgtaagaagcgcgcgagatcaatttcacgccatcggcatccatgggtgcgacgaacatcaaggcgaaatcaggattatcaccgataacttgtgcagaaccaaaaccaataaaattatagtgagtgagcgccgaattggttgcgacgactttggcaccactgacaataatcccggcatcggtttctttttctatctggataaaaacatctttaacctgatcggctggcttatgtcgatcaatcggtggattgacaatggcatggttgaaatagataccactttcctgaatgcgtttataccatgtgcgagcgttatccgcgaactgcccgtaaaattcaggataagcacctaatgcacaacagaatgccgctttatagtcaggagtccgtcccatccagccgtagctttggcgtgaccattctgcaatggcatcccgctgctggcgcatttcatccgggctggttgcaaagcggaagaacttgtgggtatagccgccattgccggtatcggtatcccagcagagtatatcgtgggtttccggctcatgcaggacatcatacaattgacctatcgaggctgcggcattacggaaagcgggatgtgtcgtgacgtctttgacgcgttcgccgtaaatataaatttcccggccatcctgaagcgatttcaggtactctttgctggtaaacgggcgtttatgatcggcacgcaaatcttctaatctcatggctacctcacaagtcaaaaattccccgttttgatttgttatccatatgggggtgtggtgttaattttatgtttacttccattgcttgattgaagcgactaagtggttgcacttgaagagactttcagaaggttagctggtacttttcggtgagagtgggtgatttattacaaaagtgtgatcatctttgtgttttagcggcagtcttaaagtgcccggtcatgtattcaatatgtgtattgtgagttttattgtgttgagccaattgctgcttataacactaaaatcaccttatgatcttggtagtagataatactggagtcgccaagttcaacatattaaatacacaaccaaaacatgaggtgagatacagtgagactaacaaacctcagctatattgatattatagtaatatctgagatgtagtgagattgcatgaggtgctagtgcagattactcagcaatatccgcagcattattttgatcctgattgataagttctctgacgacactggttgcaaaactgcctgatggcagtgagaaatggagggtgacggttcgctcatccaaccattcccagttcagattgagtggttgcaccaagattgctctacgcacactttccacgcgttcacgtttgaccaatgaccatagcgatgcgtaatctaacaggcagtgctgttcgaaatccaatgcctgatgctgagtacccagcgttttatcgcctggcaaaggtgctgttatctgcaattcaccatccatgattcgttgctgtaatacaggcagttcaagttcatctgcaacaaaccagctaccgcgtcccgttagctgtaaggcatccccgttcaatacctgctggtgcgtatcctgagcgatccgcagactggcaatagtattaaacatggcactgcggctggcagacaggtaaaaactgcggcggctgcgttccttgacctggatttcgttatccgcccagcgctgtgcctgaacaagattttgcccatcccgcccaaaacgctgttcaccaaaataattcggcacacctgcctgtgcaatctgctgcaagcgtttttccacagattgcctgtcagaaatttgcctcaatacaagagtgaagtcattacccttcaaggtgccaatccgtagtttgcgtttttggcgagaagcggtcaaaacttcacatccctccaactggaacgcagttaaatccggatcttgttttcctggcagatgcacgcaaaaccactgctctgtgactgcgttacggtcttttaatcccgcgtaactgacagagcgcgccggtattttggcaaaacgagcaaggtgatcagcaacaaactgggtgttacatcctgtcttacggatatgtaccattaaatgttcgccttctccatcaggagaaaatcctaaatcttcacgaacaataaaatcttcgggtgaggctttaactacgccagtcgcttctggctgcccatagagccagtgtaattcacttaatgtcatgcttattccttcaccagcaaagccacggcttcgcaggcaataccttctttacggccaacaaatcccagtttttcagtcgttgttgccttaacgttaatatcatccatatggcattcaagatcttctgccagattgacccgcatctgaggaatatgcggcagcattttcggcgcctgagcaataatggtgatgtcaagattaccaatccgatagccttttttacggatatggcgataggcttccttcagcagttcacggctatccgcacctttaaaggccggatcggtatctggaaacaattttccgatatctcccagtgctgccgcacctaataaagcatccgtagccgcatgcagggccacatcaccgtcggaatgggctatcagcccttgttcataaggaatgcgaacaccaccgatgaccagaggcccttctccgccaaatttatgcacatcaaaaccgtgtccaattctcatacgatatgttcctttgattttcgggataggtaaaactccgccaatgccagatcttcgggttgagtgacttttatattgtctgcccgcccatgtaccagcaccgggtgataaccacaatattccagtgccgaagattcgtccgtgatacacgcttgttctgcaagcgcttttgtcaggcagtcacgtaataactgtaagggaaataactgcggggtcagagcatgccagaggcctcggcgatcaacggtatgatcaatggtggatggctcctcctcggatgccatcaccatacgcttcatggtgtccctgacaggagcagccagaagcccaccacagacagccggagacggtgcacttctattgatgagctgtagcagattatcgagatcgtcacgatgtaagcaaggacgggcagcatcatgcaccaaaacccaagcagagctgtctgtcgaaaggctcgccagataatccagccctgccagtaccgaatcagctctctccgctcctcctaccactgtagttattcgtgggtcagaggcaatcgcaagccgcccgaactgattatcagcagagttcagcgcaacaatgactcgctgtatgcggggatgttcaagtaatgctgccaatgtgtgttcaataatagttttaccagcaagagggaggtattgttttgggcaatctgatttcatccggctaccgatccccgcagcagggatcaatgcgacaatatcagcaagagaagtatcagcaggagaatgaaatattgggttattcattttggttattgtttactattttctttcaaagattgttgcgcattgtgtttagaggtatcaggcaccagacggtaaaaagattctcccggcttaatcatacccaattcattacgagcacgttcttcaatcgcttcttgaccttttttcagatctttaatttcagcaaatagctggttgttgcgcgccctaagggtaatatcagcgctattccgcctgacaacctcatctttaacccacacataatcgtgaataccatttttgccgaaccacagcgagtactgtaaccagccgagtaaaaccaataatagtagcgttagtttgcccatctcctccccctgaaaaacccgctaatcatcccacaactgagggaatgacgccactatcacaaaacatgatcacaagatgtgatggaaaagtactggatgagatgagtgtagaaacacattattccacgcgcaataatgtgtttcttaacggctcaatgggtatggtgttcaaataggcaaaaagttgtggttatgcagcgcagcaagcaatttttctatcgatgattcaacaggtagtgagccatccaaatagatgtcgggctgttctggcgtctcgtaagctgaatcaattcccgtgaagttaagcagctcccccgcccgcgcttttttatacaagcctttcggatcacgggcttcacatatcgccagcggcgtatccacaaagacttcaataaatcgatcggctcccatcaattcacgtagtttttgccgttcagctctatggggagaaataaacgccgttaagactactagcccagcatcaaccatcaattttgagacttctccgatacgccggatattctctcgtcgttcagtttcagaaaatcccaaatcgctgcacaagccatgacgcagattatctccatccaataaataggttttgatcccccgcgaaaacagggcttgttccagtgcgcctgcaagtgtggatttccctgagccagacaacccagtgaaccagatgactaaagcaggatggccattcaccacttccctttgctttctgtccaacgtatgtgaatgccaaacgacattagaaaacgagtgttccttgatctgagacacttatttacctcccagtaaatcacgcgcaccccagtgtggaaaatgacgacgaaccaatcgattgaattccagttcaaattcgctgtactccttcggctcttcgtaaacttcagtttgaatttcacgtaccagacccgcaccgacagtcacattggtcagacgatcaatcaggatgatgccgccggtatcggcgttttgcggataactatcgatcagtagtggctcatcaaatgagaattccaccagcccaatggcattcaatggcaattcaaccgccactttttgcgtcagatttgtgatatctacctgatattgaacattatcgactttcccacggcttttcttgcccgcaaccttgatatctaaactttgcccctgaatcagcggctgctcagacatccatacgacatccaccaatgcatgacgtgctacggtcatgtgatcttcaacggcaatcagcaggtcaccacggctgatatcaatttcatctttcagcacgacggtaatcgcctcaccaggtacggcaaatggcagatctccgtcaaaagttacaatccgttctacggtggaaatcacacctgaaggcatgactttgatttgctggccttgacgtaaaatacccgatgacagtgtgccactgtacccgcgaaaatcgagatcagggcgattgacatattgcactggaaaacgcaggggctgctctgttgcttttttctttacatcaacgctttcaagagtatccagtaacgtttcccctgtatgccatgccattttttcgctacgactgacgatattgtccccctccagtgccgagataggtacgaaataaacgtgcaggtcagtcggtaattggccggcgaaattccaataatcctgtttgatctgttcataaatatcctgtcgataatccaccagatccattttattcaccgctaccaccaagtgacgaatacccaacagagtactgataaaactgtgtcggcgtgtctgctcctgtacgcctttccgcgcatcgatcagtaaaatggaaagatcactggttgaagctcccgttgccatattacgggtatactgctcatgccccggtgtatccgcgatgatgaatttgcgtttttccgtggagaaataacggtatgccacgtcaatagtgataccttgttcccgctcggcggcaagaccatccaccaacaacgccagatccagtttctcaccttgtgttcccagccgtttgctgtcgttttgtaatgtcgcaagctgatcttcataaatttggcgggtatcgtgcaacaggcggccaattaatgtgcttttaccatcatctacgctaccgcaggtcaaaaaacgcagtagtcccttttcctgctgtatccgcaggtaggcttccaccccaccctgctgtttgatctggctggcgatggtttcattgtgtgcaagtgcgggcatatctggcctcctcaaaaataaccctgacgttttttcaactccatcgagccggactgatcactgtcgataagccgtccctgccgctcactggtggtcgatatcaacatttcttctatgatttccggcagcgtttcggcttctgattccacagcgccagtcagtggccagcagcccagtgttctgaagcgaacttttctttggctgatgacttcacctgatttcagatcaatacgagcgtcgtcaaccataatcaatgcaccatcacgctgaatgaccggacggtgtttggcgaagtaaagagggacaatgtctatctgctccagatagatgtattgccagatatccaattcagtccagttggataacgggaatacacggatgctttcccctttgttgatctgaccgttatagttacgccagagttctggacgctggtttttgggatcccaacgatgggaacgatcacggaatgagtagatgcgctctttggcccgggatttttcttcatcacgccttgccccaccaaatgctgcatcaaatcggtatttatccagagcctgtttcagcccttccgttttcatgatgtcggtgtgttttgcactgccatggataaaggggttaatacccagtgcttcaccttgtgggttacggtaaaccagtaattcaaaaccgtatttttccgctgtatgatcacggaagtcatacatttcacggaatttccatcctgtatcaacgtgcagtaaggaaaaaggcaattttcccggatagaacgccttgcgggcgagatgcagcatcaccgaggaatctttaccaatggaataaagcattacgggattagcaaattcggcagccacttcgcgaataatatgaatgctttcagcttcgagttgctgcaagtgtgtcagttttttttcgtccattgacagctccttatacgagatcaacaacagcagggcgatttatttgagcaacagattgtttttgatcaacagactgttgcccgaaccatgctatctggtggtggagttgagccacctctcccaccaccagaagtgcaggcgatggtgctttttgtgccaaccgatccagttcggatagggttccggtcagtacctgctgttctggacgagttccgcagccgatcacggctactggggtattggcatctcgtccgtgtgaaatcaatttttggctgatcagggcagcttttatgatacccatgtaaattgccaatgtttgattaccccgcgctaatgcaggccaatccagttcatcgccattttcacggcagtgtcctgtaataaaggtgacactttgggagtgctctctgtgtgtcagtggaataccggcataagcagaagcgcctaccgctgcggtaataccgggtactacctgaaagggaatacccgcttcagcagcaacctgcaattcttctccaccacgaccgaaaatgaatggatcgccccctttcagacgaactacttttttaccctgacgcgctagtttaataattaatgcattagtctcttcctgagctactgagtgattccctgcccttttgccaacacagatttgatctgcatcgcggcgtaccaattccaaaatatctgcactgaccagatggtcataaagcacaacatcagcctgctgaatcacttgtaaaccttttaaggtcagcaatcccggatcgcccggccctgctcctactaaagccaattcgccctgtttgccggctggcgcgagttgttcgttggctcgttgttcatcgatcaattgttcatcgagttgtgcttctgcctgctgtagttgtccattagctaccaatgtggcaaaacgcccattcaaggctttttcccaaaagtgacgccgctggcgtatggaagtcagacgctgtttcacgcgctcacgccagcgccctgcaatctctgccatgatgccaagatgaaagggcagtagggattccagtttttctcgcagcaattttgccaataccggggattttcctgcggatgaaatcgccaccataatcggagaacgatcgataattgaggggaaaatagccgagcaaagcggttgatcatccactacattgaccaaaatagcgcgagcattggcctcagcaaaaatatgctggttcaaatcgtggtcatctgttgccgcaataaccaaaaatacgccatcaagatattctgttcgaaatccaccctgcctccattcaaattccgctttttgatagcgttgttgcagctcagaatgcaattcaggggcgactattgttagcgacgcacccgcacgtagcagcaggcttgccttacgagcagctacctctccacctccaaccagcaatacaggtcgggattttaactcaacaaataagggtaaatagtccacggtgacatgccatccagtgttagagtcctctcataattttttattattatgatgatgaaagaatgaatatatgaggctgagatccggttatgaaatgacaaaaaggaattattagttcctgaatcgcataagctgaattttttagtctgttaaaaagttaactattcggaatattcagggtaagggcaggccgccgcacctcttttttaagcagcacgccccaatagaaatccctgacatcatccgtcatattggcttagctttcgtgcaaaccacactcacgttttaagccaaaaaagcgggtttgctcttcgctcatgcccggctgccacttttgagttgtatgggtatcccccacagagaggtagccctgctcccatagcggatggtattcaagaccctgctgcgccaaatattgatgcactcgacgattatcccaatcaacaataggcagaattttgaaaacatcgcgctgaacggccagcacaggtaaattagcgcgactttccgattgctggcggcgtaaccctgcaaaccagctttgtgcatgcagtgatttcaatgcttggttcatcggctcaactttgttgatctggttatagcgctcaatgccttccactccctgttcccacaatttgccataacgcgcttcctgccaggcaggagaaagttctgcccggaaaaccgtcaagttcagtttcagttcgtcagtcagcttatcgataaattggtaagtttcggggaacaaataaccggtatccgtgaggataacgggaatatcaggatattcttgtgtcaccagatgcaggcagaccgcagcctgaatgccaaaacttgaagaaagcacgaattcgccagatagatgttccaatgcccagctaacacgctggcgggcatccagtaattccagttgttgattgatgtcagctaatgcttcggcacgctgatcatgattcaatgccagcaattctgctaaatgaagctggctcataacgcctcctgccagtcataaaaatcaagggctgaattcaagacaggtttgataatgtcggcacgaaccaagaaatccccaaagcattcatggacattgcgttccgctgaccagcgaccaatcaattcatccagtatcaccagaatctccgctgaagtgatattctccctgtacatgcggggaattcggctgccaatccggtttccaccgaggtgaaggttatagcgatcctgagctttacctaccaaccctatttctgccagcatcgccctgccgcatccattcgcgcagcccgtaacacgcaggacgatatgttcgtcagaaacaccgtgtttttccattaatgcatcaacataatcgacaaatgtcggcaagaaacgttcggcttccgccatcgccaatgggcaagttggaaatgaaacgcacgccatggaatgatgacgcaggaatgtcacgctattatctattaagccgtgtgtgcgggcgatttcttcaatgcgtgctttttcgctttctggcactcccgccacaatcaggttttgattggccgtcagacggaaatcacctttgtggattttcgcaatttctgcgatccccgtttttagcggtttaccgggataatccagcaagcggccattctcaataaacaaagtcaggtgccattgatcatctatgcctttcaaccagccaatttgatccccgcgacccgtaaattcatacggacgaatagcctcaaagtgcactcctgcccgtttttctacttcctgtctgaaggtgtcgacaccaactcgttcaagggtatatttggtcttggcattttttcgttctgttcggttgccccaatcacgctgtgtcgtcaccacggcttctgcaatcgccaatgtgtgtttcagtggaataaaaccaaactcactcgccagtcgaggaaaagtcttcttatcaccgtgggtcatcgctaatccgccacccaccagcacgttaaagccgatcaactggtcattctctgcaatagcgataaagttcaggtcattagcatggagatcgacatcattttgtggcggaatcaccacggatgttttgaattttctaggcagataagttgacccaagaataggctcttcatcggtagtcgctactttttctttatccagccagatttcggcataagcgctcgtgcgtggcaataagtgttccgatatctttttcgcccattcataagcctgctggtgcaaagccgattgcaccggatttgatgtgcaaagtacgttacggttgacgtcattggccgttgccaatgaatccagccccatttttgccagcaactgatgggcaggttttaggttgcttttcaaaatgccatgaaactggaacgtttgtcggttggtcaaccggatgctgccgtataaggtatcttctgtcgcaaactgatcaatacccagccattgactgggtgtgataatgcctcctggcaagcgacaacgcagcatcatagcgtgacggggttcaagtttttgttccgtccgctctgctctgatgtcacggtcatcctgttgatacatgccgtggaaacggatcaggagaaagttatccccctcaaacccgcctgtcagcccattttttaaatcttcgctgattgtaccccgcaaatagtcgctatttaatttcatgcgttcactgtcagcgagtttaccttcaaccttcaaaggaccttgtttttcattgctcatattagtaaacatccctttgataacggcgctcaaggcgcaattcactcaagaattcatcagcctgttcagcatccatgccaccctgttgtgaaatgatatccagcaatgcctgctccacatcttttgccatacgattggcatcaccacagacgtacaaatgtgcaccatcctgaacccagcgccagatttcttttccctgctcacgcagtttgtcctgtacatagattttatgttgttgatcccgtgaccatgccaagtcaatgcgggtcagcaagccatctttggcatagcgctggaattcaacctgatagagaaaatcttcaacgaaatgtggattaccaaagaacaaccagtttttgccttcagacccctgattgtcacgctgttgcaaaaatgcccgaaacggtgcaactcccgtacccggcccaatcataatgacagatgtctgtggatcggcaggtaagcgaaagttatcgttatgttcgataaaaatacggatgttgtcgtcttcctgcaatcgatcggccagatagcccgatgcgccccccgtacgggcacgcccttctatctcatagcgaaccacgccaaccgtaacatgtacttcatttttaacttcagtctgtgaggaggagatggaatagagacgcggcgtcaaggggcgtagtaagtcgataaactgctgggcttctggatgtaaggccgcttgcctgaccatatccacaataggcgttttttgtgcgtactgttgtaatgcctgtttgtcagcaattaaagcgaaaagtttttgatctttcgccaataccgcatatttctcaacaattaatcccgtattctgggtcagctcaacatggctaatcagcgcctgacgcagtggcagtgatttcccatgtacattaacctgctcagatccggtcagccaaagcaattcaatcaattcatccaccagtgccggatcattttcgaaccagacacccagcgcatctccgggctgataatgcaggccggaatcccccagatcaatttcaatatggcgaacatctttgtctgaaccgcgccccgttattttttggttggtcaggagcgaagcggtcagtggcgcgtctttggtataagggctggaaatgatttcactgaccgaacccgcttgattgacagtgatgccggcttgtgtctgggctggcaggcgctgctttaaaacttccgttatttgttgacgccactgtgctgcctgttcttgatattccacatcgacatcaatacgctccagtaatcgttgtgcgcccagttcattcaggcgatggtcaaagtctttaccagcctgacagaagttttcataagaggtatcccccagaccaaatacggcataagccgtctctttcattgatggcgcttttttggaattcaaatacttatacagtgctaccgcttcttcggcaggttcaccttcaccttgtgtcgaagcaataataatcaatacccgttcttgtgcgatttgcttgaatttataatcgcccgcattaaccaagttcacatttagcttttccgccaacaacgagtctctgagttgctcggctaaacgacgggcatttcctgtttgtgaggcagagatcagtgtgacagtttccgatataggggcagctggtgtaacgacttcagtttgtggcttttgatttaccattccccagaaatagcccgataaccacgccagttgatgtggagaaaaatcaccgattgcagattgcagacgtgataattgttcaggagaaaccggtagtaatgcagttgaaggtggttttgtggtcatgatcccgtgccctttgctatagccaatatccatgattttgaaatctatacatggattaatcataaggttatcccagataaggaggagattttaaagaaaggtttgcaatatctcataactaaaatgcctaactttatttacagatttcatatatcgataaagtcgttaagcgttgtgctttattcctccagaaaaatcacgttatgcttgtaaagttcaggtagaatagccggccttttggaatcagagaaaagcatcatgagcactaccatctttaaagattttcaatttgaagcggcgcatcgcctgccgcatgttccggaaggacataaatgtgggcgtctgcatggacactcattcatggtacgtctggaaattaccggagaggttgatcctctcagcggatggatcatggattttgccgatgtaaaagtcgcatttaagccgatttgggaacggctcgatcataactatctcaatgaaattcctgggctggaaaatccaaccagcgaagttttagctaagtggatctgggaaaagctaaaacccactctgctgccccaactcagtgccgtcatggtaaaagagacttgtagcgcaggttgtatctatcgtggcgaatagaatactcagcaccagattctggtgctgagtgaaatatcaggcgatatttaagtatttgtgtgtctgcatcgaaaaacgccagttacgggcaatacaagtttcaatacacaggcgggttgcttcttctttctgactgatgggctgtaaggcaataaccggatctgccttttcatcgagcatcgtcagcagttcatccaatgcttcaatatcgcgctcccgcccgactgggtgcttgatttcatttgcacggttcatcgcttcaggtaatacctgatatccgccacgcatttttactttcggtgaaactgtgacccacgttttttcagaacactggatcgcatgtgtaccactggtttctatctgacactgatagccttcactttccaatgtttcggtcaagggacgcagattatacaggcacggttcacctccggtaacgacgatatgacgcgccgtataaccctgacggatgaataagttaataatttgtcttgcagtggctgctccccatgtatcactatcctgcgatttcacgaggatgttttccataggctgttgtttatcagcctctttttcccacgtatgtttggtatcacaccaactgcaccctaccggacatccctgtaagcggatgaaaactgaaggcacaccggtaaacacaccttctccctgcaaagtttgaaaaatttcatttattgggtaaatcataaaaaaactctggttttactaaactgccgggtattattacagatatctatcccgcgaacatccatctttatggtattgtacggggttgcttttgctggtatttgacgccagacagagcattgtatgcctgaaatactctctggcatgaaagatagatgggaataacgaatgcaacataatgaaaatcagcttaaacagggtctgagcgtacggcatattcgctttatggctttaggctctgcaataggcactgggctgttttatggctcggcagcggcgattcagcatgctggccctgctgtattgctggcctatttaatcggtggtgctgctgtatttatggtgatgagagcacttggcgaaatggccgttcaccatcccgtttccggttctttttcacaatatgccagccattatctgggaccattggccggctttctgaccggttggatttatgttcttgaaatgctgtttgtttgtctggctgatatcaccgcattcggcatgtatatgaggctatggttcccacacgtcgatcaatggatttgggtgctgggtattgtatgttttatcggtgccctaaatctgtgccatgtaaaaatattcggtgaaatggagttctggctttcgatcgtcaaagttaccgccatcattgctatgattatcggcggcatcataattatgatctacggttttggtcaatcaactgaacatgctaccggtatttccaatttatgggagcatggcggcttcatgccaaatggtatcagtggggtggttgcctcattcgcaattgttatgttcgcttttggtggcatagaagtgatcggtattactgccagtgaagcgaaaaacccagaaaaaacgattcctaaagcaatcaatgccgttccattccgtattttgatcttctatgtcctgacgttgtgtattctaatgtgcatctatccatggaatcagattgatcagaatgcaagcccatttgtacagattttttccaatctgggaattaattcagcagcgaatattttaaatgtcgtcgtgattactgccgctatttcagccatcaacagcgatatttttggtgcaggaaggatgatgtacggcatggctcaggaaagacaggctcctgaagcattcaagaaactgacccgtaatggtgtaccgtggatgaccgtgcttgtcatgactatagttctattacttggcgtatggctgaatttcttgatccctaatgatatttttatccttatcgcgtctgttgcaacatttgcaaccgtctgggtatggctgatgattttaatttctcacgttgccatgcgccgtcaaatgagtgcaaaagacatcaagtcattgaaatttcccgttccaatgtggccaattgcgcctgcaattacgatcgttttcatggtcggtgtcatcatgttgctcggctattttgagcaaacaagggatgctctgtatgttgggataggttgggtgttagtcctcacactggcttattctttctgtgtgaagaagaaattatcaaaaaatcatctttctactaaccaataagactagaaaaagtgtcggtacgttagagctgccggcgcttttctttatctagccatttcctccatcgtttataaagagaaattaacaattaatggattgtgatcagaagccattgtcgttaaaactgccgcatttaaaactttcaattcacgataaaaaacaaaatctaacggtttgccaaaaacaatcgttcggtgatcatcattaaaatagacttctttcaattgcatacgctgagcaaaacgcaccaatactctcaaccgccgatggctccacgcattaaaatccccagcaaaaatcacgggtccatgatgcaaattgatatgaataccaatgttattcaattgccgactgtaaacgtcaacaccaaagctaaaattgatcgcatgcacgtttattaccatcaattgacgattatctggtaatggataaatcgtaatcagtgaggattttgagagtcgcagtatcggctctttttcacgtagtgggtagcaataaacgggagaagaagatgctaaggtcattacgccagatggatgctgagggatggaaaatgcagggacttgatctgcaactaacccactgactgtaacgaatttcagtaaatcaggcgttgtttgcgcttcctgcaataaaataagctggctgctctcaatcaaagaacccaaaacttcttgccatgatggacgctgttgtttgtaaatattccagatggcaacacaaagctcatgattgaaagcaggtaacggttgcccatgtggtaatgaattgtcttcaagtaatcgtttagatgtaggtaaaacccgctctactggctgatttgcaacataccgtattgcatagttttttggggctgagtttttcttagcccgcctccttcttgcatagcttctaaccaagctaacccccgtcacatatcaacaacctattcatctaatatgacatgtcaattattgatttcaatctattacgtacaaaaaggttctgtcgcattaacagagaaaatctgagtcaatgtggggttcgttgtattttatgcagcatcgaaacgagctctattcccgctaaaatcgtttgggcccggcgaaacgatttaaaacctaacatcggccgtatcaacgggataatgtaaacgtttgaaggcttttcgaattaaatacacggtttgctctgcaaaaggtcatatatttttcaatgaatgtaagacttttgctacgttcttttagaaaaacgagcaaaagtcggtaaaacactcactcaaacatcgataaataacgatctcttgaccagcgataatataaggccagcttattattaatttcttctacatcgaatttctcaggggaaaaaacgtcatcaggggaaatatcagcatcgccattaacccattcaaacatgtcctgatagtcttcatgagtgggatctttaaggatgttaagcagttccatatagccatataccccaccggaatcttctggtgggcaggcttgttcaccttcaacgcaaaaaataggcatcggcaatttttcgggagaatagttactgttttccagtacaatctcatgctcccagctgtcaccaaaatcataaagataagcaaacttgctgcctttgcgcttgattagcgaatccagtttgaattttccttcttcctgaccattctccatttcttccggcatttcggtaaagcgtttggcgctaaaaatgaactcgtgtaagtggctgtcttcccaacccatcacagcttgtatcacatcgtgcaaacgatccaatgaaatattggatggaacaacaaaacgacgccatataaccggttcggtttcggtaagcgtaatttttaactgataaaacttttccatttatcacccctatgagttgatgaattgacgggaaagggctaaatattcgcatatttccattacgatatgaagtgatcctgactaaaattcgaacgatttttatattgataaaattagctgtccgctatttagttgattttttagcaacattgttttactgatattctttatcatcaataggttctactatgaatatattggcagaaaaaagggatattacggcgacagcagtattacgttttgtgttggtgacgtgccttctcatgccaaacgtttggtgaaagtaacacaagagtgtctatataaagctattaaacttgtgaagcctggtatcaccttgggggatatcggtcatacgatacagcaacatgctgaggcgaataattacagtgttgtgcgtgaatactgtggtcatggcatcggccgtaatatgcatgaggagcctcaagttctgcattatggcagtgcgggagagggagttgtgctggaagaaggtatgacgtttacgattgagccaatgattaatcaggggaaaaaggagataaaacagcataaggatggctggacagtaatgaccaaggatcatcgattatcagctcaatttgaacatactattttagttacccgtaatggtttcaaggtgttgactctgcgagacgaagaacgtgaaatttttaaacgctatatgagcatcaatcattaaatctattggatatagatattgttattttgttaagttaattgtttttctgtcaataaattctctttttcaaagagaatttattcctttgtgaaaaatatcatttttttcgcattgaagactgtagtaaaatcgagctcattttatcgcctgacaaaaatcagtaagtgatgaatgtagtgcccatggtttttgtcgggttttcattttcaacgacttctttttgttatcgtttatcctgaatgatctcgcaataaatggatagggtttggagtcaaaacgattgacgctagcaaaaatttatctacggttatctaaaataacaggaaatttatgtttttttttgataaaaacaagaaggcatcttgttttgtttcgctattttttcttatttttcttatacataaatgctttgggtatcaattaaagctgatatatgtcttcagtgcctttgctttattcttatttttggcggcgctcagtaaacgtgtatatctctttttgattactttcttttctcttgtggcaatactgtacgcgccagttggcctgaattacggttttccagatattaatgcggtaggctcactgctttacacaaaccagaatgaaacgctggaatatattagtggatttcctatttcaacttacttaaccgtaataggtatttttgccttgatgatgttctcattcaggctaaatgtaaacttatcaggaaaaaataaaaaatggttattttttctgttcttcattcctgcattttggtcaccagccaaaggatatattaaatctggttttgaaaacggtacggagcttttgaacaccagtttacctgaagtccgctttttcagtgatgcttaccagagttatactaaagtaatgtctgaaaatagccgtttcgccaaaattatcaaacttcaggatgattggcagcccgtagtcaaagaagaaaaatacgacacttatattatggttattggtgaaagtgtccgaaaagattttctgggcgcttatggtttccccgctaaaaatacaccgtggctggataatgcgaatgcaaccctgtttacccactatatttctgccgcaccatcaacccagctatcactgacaaattctctggcaatccggcagtcgaatgaggttaatttgaataacagtattgtcacgctggcaaataaagcggggtttgaaacttactggctctctaatcaagggatgaagggagggtttgattctcctgtggcaatgattggccaacaggctaaacatccgatgttcttgaaagaaggtagttcagatgacaggagctatatgccggatgaaaatttattaccttatgtccgtaatgcactgaagaatgatcagcatgataaaaagaaaaaactggttatcatccatttgatgggttcgcatccgcagccctgtgccagaacgaataaccaatacagtactgatttccattccaaaaatatctcatgctatgtacagagtatccataataccgatagcctgctggctgaaatagaaaacatcgccaatcaaaaccagttgaactggacaatgctctattttgccgatcatggattgtcttttgtacataaaggaacggataacgagaacttgactcatggcgataaaaatcaacagaattatcaagttccttttattattacctcttatgactattctgccagaaataaaatagatgcccagcgcagcggcctgcatcttttgcccatgttatctctatggttagggattgaagagcctcggctggtctcagagtgtgactggttttccaatcaaaaatgccagaatcaacataatgtcatttcatttgagggtaagcatatggactttaatcgcctgcataacgacgccattcattttggtttataaacagtgaattaactcacaaaacgtcacccattgcacccgtacccgaaccactgattagaggattctgaccgtttaatacggtattcagccgttggctcagatcctcctgatatcgtgggtgaaagtttcatatcatagtgcagtgtggcgaggagtatagcttccctatggctatcagatagctggcttataaaaagggaagtgaaagattaaatcatgacttgctgttcgtcttaccttaaaaagggtgtcttatgaacaataataaatttttaaaacatatcccctggatgatattggggataattggcgcattctgccttggcgtcgttgcgctgcgccggggagaacatgttagtgccttatggataatcgttgcttccgtggcggtttatcttgtggcttatcgatattacagtctttatatcgccactaaggtgatgaagctggatgcgacacgggcaacccctgcggtcgtcaataatgatggattgaactacgtaccgactaacaaaaatgtcctgtttggccatcactttgcggccattgcgggagcggggccattggtagggccagtattggcggcacaggtcggttatctgccgggtactttgtggttgctggcaggggttgtgcttgctggggcggtacaagattttatggtgctgttcatctcttcccgccgcaatggggcatcactgggtgaaatcatcaaagaagaaatgggacaggttccggggacgattgccctgtttggttgcttcttgatcatgattatcattctggcggtgctggctctgatcgtcgtaaaagcactggcggaaagtccgtggggcgtatttaccgtttgctccactgtaccgattgcgcttttcatggggatctacatgcgatatatccgtccggggcgtgtgggtgaagtctctgtgatcggggttctcatgctgattgctgtaatctggtttgggggtgttgttgcggctgatccttactgggggcctgcactgacctttaaagataccactatcacttacacactgattggatatgcgtttgtttccgcattactgccagtctggctgattttggctccacgtgattatctggctaccttcctgaaaatcggggtgatcatcggtcttgcgattgggatcgtgatcctgaatcctgatttgaaaatgccggccgtgacgcagttcgttgatggtaccgggccagtctggaaaggcacactgttcccattcctgttcattactattgcttgtggtgcggtatctggcttccatgcactgatcgcttccggtactactcctaaattgctggcaaacgaaaaagatgcccgttttattggttatggtgcgatgttgatggaatcatttgttgcgatcatggcgctggttgctgcatccattattgaaccgggcctgtattttgccatgaacacgccaccagcagctttgggtattactatgcctaatctgcataatctgggaacggcagaagcgccgatgatcatggcatcactgcaagaggtgacagcccatgcagccgcgactgtaagctcatggggctttgttatttcacctgagcaaattctgcaaacggcgaaagacattggtgagccatcagtgttgaaccgtgcggggggagcaccaacattggcggtgggaattgcttacgtattccaccagattattccagcggcaaacatgggattttggtatcacttcggcattctgtttgaagcgttattcattctgactgcactggatgcaggtacgcgctccggtcgttttatgttgcaggatttactggggaattttgttccattcctgaaaaaaaccgattctctggttgccggtatcatcggtacagcgggctgtgtcggcttatggggctatctgctgtatcaaggtgtggttgatccgttgggtggcgttaagagcctgtggccgctgtttgggatttcgaaccagatgctggcagcggctgcgctggtactggggactgtcgtactgattaaaatgaaacgcgccaagtacatctgggtgactgttattcctgcaatctggttgctgatctgtacgacatgggcactggggctgaaattattcagcgacgacccacgactggaaggtttcttcttcctggcgaaagaatataaacagcgtatcgctgaaggcggggcagaactgacagcccagcaaatcagtaatatgaatcacattgtcgtgaataactataccaatgcgggcttaagtatcctgttccttgtggtggtctatagcatcattatctatggtatcaaaaccgcgataaaagcgagtaaaaacccagaacgtacagataacgaaacgccttatgttcctgttcctgaaggtggggtaaaagtttcttctacgcactgatatgatactcagactgatgccagccaagtaaggcttcatcggtaacggctatactgtaatagcgataccccgcataatcgcctttgtattatgtggggtatttatctttggagagcagtatgtttggtaatcttggcaaggcgggtaaatatttggggcaggctgcacgcatgttggtgggagttcctgactatgacacttatgtccagcacatgaaggaaaatcaccctgataaaccttacatgacctatgaagaatttttccgtgagcgtcagaatgcgcgctatggtggtgatggcaaaggcggcatgcgctgctgttagtgttttagtgagcagaagatcaaagagaagaaaatcgttgtcagtgaaacaggaaacgaaaatgaaagctatatccgtcacaatcctggcaggttttttgggttcgggcaaaacgacgttattgcgtcacatcctcaaggccgaacatggttataaaattgccgtcatcgaaaatgagtttggtgaagttcccattgaccatgaattaattggggatagggcaacccagattaagacattaagtaacggctgcatctgttgtagtcgctcaagtgagcttgaagatgccttgctggatttactggacggaattgacaaagggcagatcgatttcgaccgtctgattattgaatgtaccggtatggcagatcccggtcctattacgcagacctttttttcccatgaaattctgtgccagcgctttttactggatgggattatcacactggtggatgcgatgcatgctgatcagcagcttaatcgcttttccattgcgcagtcacaggtgggttatgccgatagaattttgctgacgaaaacagatgttgcccctgagcatgatgccctgtttgaacgtttacagcgaattaatgccaaggctcccattcataaagtggttcacggtgaggctgatttaagtttgctgtttgatattgaaggcttcatgctaaatgataagctgacggtttcgaactcggtattccggtttattcccaaacaacagaataccatccaatcgattgtcattaacttgacgcatccggttgggttggccgaggtttctgacttaatggaagagttactgctgagtttcgctgacaatctgctgcgttacaaaggtattctcgctattaaagaagagccacgccgattgttgtttcagggagtacaacgcctatatagcgcagactgggatagagcttggcacgataacgaggaacgtcttagcgtgctggtttttatcggcatggatttacctgaacagaaaatccgtgaaaagtttgcagaattgtagttgatcatattttattctttattgagcagtgaaatagtttgtataaaaatccgctgctcatatttaaatagaaaattatattatatatgcactcttttagtcttaattccttgtaaaaagataagtaatattttaacaaaaataagacaacaagaataaaacctattcataaattgaatttatcatatgtttaaagcaatttattatttatgttatggaggaattatccacccgcaatctccacaagttagctggtggagattgttgcaataacaaatcatgttagtggaaacgggaatgataaataaaaggcttactgcgtatgctactcccaaattctggaaaaacgtttcacattactggcagtgtaaatcaccgtatgtgaaatattacgatgcccgagataatcttgaatcagacgtgtatcacggccaagatccgccagtgcgtagccgcaggcatgccttaacatatgcggatgtggagaaacactgacagacgcctgcttcccatagcgctttaataacgcataaacttgctggcgtgaaatagagccggatttttgggaaagaaacacccacggcgcatcagcatcccgccatttctggcggatatcaagccattttttaagtgcttcaatttcttttggaatcagaggatgtgttgttgatagcccaccttttaaccgcctgatatgaataattgatgaatttaaatcgaggtcggataaacataaattacacaattcactaaccctaaacccgtgaataaaacacattaatagcatgcagtaatcccgttctgcatgacgcccttgttttgtttgctccaaaattgcgtctatttcgtatcgggttaaaaatttacgttgcttcatgacattatcattcctatgacatcagatagattaattttaaatagcaaggtatttaaaccaatcgaataaaaccagctattagtatttttaaacatgattagcaaaataccagattaatctaattggaaaacagtaaagaaaaaatttgcggcttctattcgtcttatctttaatgaaaatattgattgtaattgtataaatacgtgttaggtgaccctgatgtacagaatggggcaatcataagcataattccacaataaaaattgtttaattaaaattcgcgactaaaagttttgtctaattttatttttagatttttattcttgcaatgctccttttatgagtaatgaaatcgtatttttactgcatttgacgagaaaagtaaatgatttaactaatgcgttaaagtattaggcattgaatgatcaaaaaacaccctaatttcatttttaccaaccagttttcaatactaaattttgtttttttattatatttggtttttaattctaatctttatggaggtaatctaaagtcaacgtggcactcagatgctattaatagagagtgatttagtactaaataaaaagtaaagtccctaatttaggataaattagttataagtgttattatttgtaattaaaactattaatttgctaattaaaatggggtgtttttttattctatatggctcgtgaaatttaataaaataggtatggattataattaattaaatataatttcatgattataatcatttcttgaattatgtactgtcgaatctcattttttgacgctaaagaccttttgaaataaaggtctttagcgtgtttgcttattcaggcaacccttgccttatacaccataatttcgatgatttatgtatcggtttgttgcatcgcatgatgagcgagtggacaaaactgatcgtaattcacctttctcacgttaagaaaaggctagaaaaggagaaatacataacaaaatcccggtgaagataatcaggattagcgaggcgcttttataatggtggaggctaggtactttgtagaccagataagaggggatcaaacaaccgacgatgccaaatattgggctacagagggaagtgaagcttaagactggtgcattcaggataatggcaccccatgccaataagatggcaaaaatcataatgcctttttgcacccatttttcattgatcttttcagtgggcatcaggcgcccgagaatattcatagcaattccctgactggcttcgcgaaacccgagatacacaccaaagaaggcagtcattaccgcaaaaatgttgagaataacactgaccgtaactacccagccgtcagggaagaattgtgcagcgatagccagtgcagaaatattctgttcataggctttgacggcttcatcgtgacccattgccaaagtaaaagagatggcatagaaaaataccgtacaaaacaggacgccaaacgccacattcatggctcggagtgttttatagcgcgcaacttcacgattgtgctggtggttacggtaagaaatcaccattggacttagcgtctggataaacaggatggaagtgagtgtaaaaggtaacgtaataatggcttttttgatcagtatagcgaaaggtggcagcacgccgatattgtacagatgccacatcccaatcattgaaagacccaaggcggcgacaacaaataattttgtcagcaccatcaggctggaaattttgaacagccactgttctccacgggaggaaatcgccaccagaatacaaatcaaaatcagcccataaaacggatttttggataatagctcactggtaataccaaatgtgtgcagataagaggcgctatcgttggtaatggcagtcgagtacacaaacatccagatcaccagcatgataaagtagagaatacctaacaaaatgccccagtttttgccgagatagccactgatcacgctgggataatctttacattctggtgattccgcgagggtattgatgaacaatcgctgaaaaagatacatggcgggatagccaatgatggaagataacaggaaaacccataatcccatcaaaccgacctgaacaggcaggaaaacaattccggcaccgattgccataccaatactcatgatgatccaaccggtgtcggtactgtcgaattttatggcttttttccattcaacttcagtcatgttggcgcgcttggctgccggagaggtatgggtcgtaacctcattgttttttgttgctgttttcataatagctctcgcttacatctttggtgttgtaataggtattgaacaggtacagaaagaaacgcatcacataaacacaaaataaccgttcattaagtaagtgaactatcgtgtgtggatattagaggattttttttcaatgggagatagcaaagggaaaccatacagaaaaaaaatgcgggtttatttgtatcatcatgataaataacgtcattgcatcttcgctctaaggtattgtgattattggtgatattaacaattcaaacaattagagagaaaagttgtgcgctgtatcacgtctgctcctgctcaaaacaccctgtcagtattaaatcctttttattgttaatattatggggtagttcagcatgttaatctagatttttttccggctatcccgtgagacactagggatgaaaaacaagagaataaaatgcctatcgtttgggctattcttctgttcgtgctcaaataacctgtaattttgcgttctaaatggaatatgaatcttcagtataattattcattttattaattgccgatgttattattttagataatataatgatattgattttaatggtttcattaaattgaaaattggaaatatgttaaattttgtaagtcagtgaacatataaaagttatagattacgttccactgtaaataaaattttgttagaactgtcacattttaaaattaacttcataaggtatgattgcattgtattataaataaatttatttttttatttatagatttttaattcaatgtaatttcaccgatgaaatttgtatcatcgtgaaataatttttgtaacattaaatatagagagttttaatgaaaattatcggaatttcaggtttattaccgtcaagatgcgtaactaatggtgatgtacttaatttaatagagcagcattcaaaaaaaactttccagggtgattttcccaaaacactaagaacaattcaacggttactggaaaaaacaggacttgaaagcagatattggctgggtgaaggtgaaaaaccgatgcgtctgatggaagaagcttttgaacaggctttgagacaggcgaatatcaaaaaatctgaaattgatctattgatttaccctaacgtaactcgtggtttcactgagcctgcaaacagtacttttattgcaaaagctttaggattgaattgccggaattatgatgttcttgatgcttgtaatggttgggtaacggcaatggatattattaatggtaaaatgaaagcgggtgaaatacgttatgcggctattattaatatggaatttggcatgtctgaaggcggtccattcagaaagaatttttctttgaattctgcttctgaattggcctataaatatcctagttttacaataggtgaagcggcttctgtaaccatattgagtaatgaagatacagataattttaaatttgattatatcagcagacccgatttatgtgacatatgtaatatctctttacctaattgggaattgttttgcaatgatagtgatattgagcttatttcccctctgggaggtaaatatcagttcaattcatatgccgcagcactccatgaatatgcaggagaagaagtgcccaaggtattcaaacagcataatattgccagtagtgatatccataagattttcattcatacaggtgcaccaaatatgtgggatggctttggtaaagccgtcgatgccgccgataaaatgcacaatatcggccagaaaaccggtaacattattactgcttctattccttttggcatcgctgatgctcttgggaaagatcaggtcgaaagagataaactttgcatgggatgggcaggcagtggtggaatggtattttccgcgatgtcgtttaaattataattaatctttcttctgctttatttaactgctgactgaatatataaacttaaaatttatgataatgattctgcttgtttaatataatgatttctatatagaaaaataatacgatggatagatttagttagcaaatattaagaatgatttcagttggtctggtgaataaaaatagagtctttttgattgtgttagcaggggaatatttctccttaaatgacatagacagtcaatgacaaagtggaaaaatcacacgatttttccactatttgaattcaggtaatggccatgattaaaattaacttgttcaataatccttctataaatagcttaacgtgatgctaattatcggtaaatcagccttatcaatgtcgtgaatttattcggctaataggcattatgctcattttctatttaaatagacttttcctataacaatatctattattttaccgttttatgttagcggtatccgcctgtataagtaatctgacaggctcaattgaaaatttattcagattcaggaagacattataatgaaaagtaaattcactctggcttcactttgtttggcttctcttatgctggcaggatgtgcgacagaatcatcttcaactcttcaggttcaaaaagtctcttcgtataacactatttatcaaggtatccgcagtcctatcgctgtgggtaaatttgaaaatcgctcaagctatcagaatggcattttctctgacggtattgatcgtttaggcaatcaatcaaaaacaacgctggtgacacatttacagcagaccggccgcttcaatgtgttggagcgtaccaacatggcagaattgcaaacggaagccggtttgcagggtaaagcccagaagctgaaaggggctaactatgtcattacgggtgctgtgactgaatttggccgtaaggaagtgggtgaccatcaattatggggcattttgggacgtggtaaatcacaggttgcctatgcaaaagtgatgcttaatgttgttaatgttgaaacttctgaagttatcttctcctcagcaggggcaggagaatataaattatccagccgtgaaattattggatttggcggcgcatccggttacgactcaactctgaatggcaaggtgttggatttggcgattcgtgaagcagtcaacgaccttgtggcaggtattgaaagtggcgcatggaagccagttaactaattatatcgggaagatagtttaatgtttttgatgaaaaagacggggatattgttagggatattactgttggcgggctgtgtcaacgcgccgaagaccatttacgaatggggtgattaccagccaacagtttatcaatactatcaacaggacaaaatggggctacaggagcagattcaagcgttgcagaaggtgattgaattagccaaagcaaaagataagtcagttcctcctggcctgcatgctcaaatggggttgctttacagtcaaacaggcaaaattgatgaggcctttcagcagtttgtcatagagaaaagcttatttcctgaagcggcagcttatatggatttcctgttgagcaaaagtaagggagtgaaataatgaaccgtttttggggcgcgattggtgctttattattgctgacactgaccggatgtgttcaacaaaaaccttatgattatacggctctacgggaaagtaagcctaaatccattctggtactgcccgcagtgaacaaatccgtggaaatacaagctggaggcagcctgatttctcaggtgacttacccactggctgaatctggctattacgtttttccggttgcggtggttgaagaaacattccgacagaatggtgtgacagaagcgcaggatgtccaaaatatcagctataagaagctgcatgatatttttggtgcagatgctgcgctttatctggatatcacgcaatacggtacacaatatctagtcattagcagcgatactcgtgtcagcgcagcagcccgtttagttgatctacgcagtggcaagcaactgtggcgtggtacggcgacagcctcttcaacagaaaatgataattactccagtggtgggctggtaggaatgttagtctctgcggctatttctcaaatcgcgaatacgatcactgacagaggccatgatattgcaggcattgccagtcatcgtctgttaagcgcgggtcaatatggccgattgctgtatgggccgcgttcagaacactacggtaaagagaaattataattttttgtgttatcagcgtgaaaaatgccgcaaatattctttgcggcattgtttattttttacatctattccagatatcaaatatccaatcgcttggattgccatcttttggacttccagcgccaagcgttcacaagccctcgcacccattcatcgcagaagaagccaatccagatccccagaatgcccatattcatcacgatccccagaaaatagccgacaggaatggaaatacaccacatgaaaatcagtgcagtgtagagcgggaagcgggcgtcaccggaagcgcgcagggcattgaccatcacaatattgaaggtgcgccctggctccagaaataccgatagtaggaacagaggcagcagaagttcaataatctttttatcttccgtcatcatgttgaggagtggctcccgcagtatccagaaaaccagtacgacaccagacgtaacgataaccccgattttcaggctatttaatccgcggatataggcatcttcgaagcgttttgcgcccacaaggtgcccaaccataatttcattgccaatactgatggaaatgccgaacaacataatgaacagcgataactggaaatacatggtttgtgcggccagagaagtttcccccatcagaccgataaatgcctgcgcggccatatattgcagtatccacaccagattttcaccggcagcaggcaagccgatatgcaggattttgcccagcatatttttcgaccagtgtatgagcaatctggggttgaacttaatcttcaagccataaaacagcagcccactgagtaaaataatcgcgacagtacggccaaacacggtagaccacgccacgccttccagcccatatttaggtaatccaaagaacccatacagaacaaccatattgccgacaatggtgagcagattggcaatcagggtgacatacatggcagttttcgacttaccataaacccgcagacaggcggcgagaatgatagaaatagcttctggaatcagacagatacccagaacccgcagataagcgctcccatcttccatcaggttttcgggcaaattcatgatgtgcaggattttataaccgaagaaaaccgtgaccagcgcacaaccaagacccagtacgaaattgaaagcaatggagatatgaatagcttggctggctttatcccgctttcctgaaccaagatactgcgcgattacaacactgcaacctacactgatgaaattgaaaatcgtaatgcagagatcgaaaacaagattgcctccccccatggcagccagataagccgaagaaatatggctgaccatataggtattaattaataacgtcgccatgtgaagaaaaatatcaatgaagatcggccagctcagtgagaaaagcgagcgatcaacaacatcagattgatgcattgtaaaacctatctattgaagtgaaatgaatggtctttttacggtgtgacatacctagaaagtgtaggtgattctacaaggtttattggtcagttggtaggcggattacgttatttgcaccgatggcacagggaaggactggggataaaaaatctcctgcggtagaaaccgcaggagtctgacgccagactaactctaaatttcctcttccagaacaaacatgccaaccagatgaatttccagatagtactcttcaccgacacgcggttgcagttgtgtggcattgatctgtaacaacagggtttgcccatgccaatcaaccgtcacctcatattgcgctcccatataggccacataactgactttgcaacgttggctttcacttccctgttggttcagagtcatggcttcagggcgaatgcctaccgtaatggaagagcgggttgtcgtaaaatgcgcaggtcggggcaaccgatatcggaagatttccacataatccaaccctaatgtggccggaaaaatattggcgtcccccataaaacttgccataaatcgtgaggctggatggcgatagagtgtttgtggcgagccaatctgcataattttgcctttattcatcaccagcacggtatcagaaacggcaaaggcttcactttggtcgtgagtcacgtagagggaagtgatattaaagcgttgctgtaattcgcggattttctctcgcatattgcggcgcaggttggcatcaaggttgctcaatggctcatcgaatagcagaactttaggcttgaggatcaacgcacgagccaaggcgacccgctgctgttgtccaccagagatctggtcaacatagcgatcttcaaatccggctaaatcaaccaattccagcgcttccctgacttgctcgcgaatttctgcttttggccgcccctgcattttcagcccgtaaccgatgttttcgcccaaagacagatgaggaaaaagtgcataagactggaataccatacaaatatcccgttgctggatggaacgttctgtcacatcctcactatcaatgaaaatatttccttcgctgggcttttccaaaccagcaactaaacgtagtacggtggttttaccgcatcctgatggccccagcagagttaccatatgcccttgaggaatggataagttcagggagtcgatcacggcgttgctaccgaaccgtttagtcacattttttagctcgacaaaatgttgttgtgtcatcttatcactccgtgattactgggtgtttttggctttcgaacgggaaattcgcgcttcgccaaccaaatagtcaaacaggaaaatcaccgccagcatgacgacgatcagaatcgagccataagcgatagccagaccatattcaccatcttcaacgcggttcagaatataggccgttgccacgcgggtgtctggtgtcactaaaaatacgatggcgctgacggtagtaatggcacggacaaaactgtaaatcagcgcggataaaatggcggggcgtaagagcggcagcaaaatgtgaaagattgttctcatcgaacctgcccgcagactgagagaggcttcatccagcgatttatcaatttgcccaagtccggcgatacccgcccgaatgccaacggggacgttccgcattgtcatggaaacgataataatcaccgctgtgccagtgaggtaaaatggagcatcattgaaggccagtatataggacacgccagctaccgtaccgggaacggcaaaacagagcatggttgtaaattcaatggcttttttgcctcggaattcttgtcgtactacgacataggcaattaacagacccaaaatagccgtaatgggagcggcaatacccgcataaagcagcgtatccagcagtgaaggccatgcaccgtcactcattccctgaccaaatagattgatgaaattatccagtgttagtgtgtaatctacgccccagttcaccgtgaaactgccgtagaaaatactgccatacaacagaatattgaaagtcacccagataaacagagtagtacaaacgccccataccagagaaacaggtaatggctgcacatcaccacggtatgatttaccggaaaccgtgacgtaagaacgtttgccgatccacatatactggatacagaaaaccaatagcgagaagactaataatgatgcaccaagcgtactggcagactgataatcaagttgtgaacccgtaatataaaaataaatctgggttgccagtacatcgaagttaccgcccaataccagtggattactgaaatctgccagtgattgaacaactacaatcaggaaagcattggccagagcgggtttcagcagaggaagaaagacatggaaaaacgtttgatagcgattggctcgcagggtataggaggcttcttccagtgatgggtggatcgtcttgatggcaccatccagaatcatgaaggccatcggggtaaatgccagcacttgggcgatccaaatccctgtaaaaccgtataaccagttggtattcgtcagaccaaaccacgttgccataaactcggtgatataacctgagcgtcccatcatcagtgttacacctaaaccaacgacaaaaggtggtgtgacaatcggtaaaatagaaaaaatacgaccgatgatggcggaacgtttggcgattctggcggtataaatggccagaatcagcccaaaaacagtacatcccacacccacagcaacggaaagcagaattgagttggccataactttaatgatgtggggctgccccaatatagaaataaaggcaaatggcgcgaattgatcagcttcatccttaaacatagggataaagatagcgatactggggaacagaataaatacgccaaccagcgcggtgatcgctaccagtgaaccaatcacaaaactatcaccgccgagccattccagacgggtcagggctagagtgatgatggctcccaatgcaataaacagcacgatagtagcgtaacctagcccacgtccggccaatgtagcactagtgatgatgaacagcgtacataacagggcatacccggcatcaaaatagtgacgctgacgttggttgcgactggcgggagtcagtggacgtaataacaatagggatggcagcaggaaccacaatatgctgctattgacactatgccaactataagctgccagtatttcttcttgtgtcgactcgagaaggccgtaatccagactccatgatggcagcagagcaaatgatagccatgccagcataatccaccagaaaacggcatcccgaccctgcttcttgggcaaggtaagggtatgagacataatttccccgataatatttaaatcacgttattgggcagcgaggcatattcaggctcgctgcttgagcgggtgtcaccgatgatgtgacaaaaagggattatttactcattttcacttcaatcacccatttgttgatcaattctttgcgtacttggctggagccgtatttatccatatcataattgatgaggtttaattcagcagggttcagtgttgtaggtgaagactctgcggtggtattggtcaggatctgataggattttcccttcttccagctcaactcttgagcttctttggacagcacccaatcgacaaataatttggcgttatccagattgcgcgcattcttgataatactgacgccgccgatttcatagcctgttccttcacagggagcaatgagtttcattggcgcgccattttcaacttccagtgaataatcatgcaggaagccaatgccaatggcggtttcaccacgggcggtgttacgtgctggtgcaatgccggatttggtatattgtgaaatattaccattgagttttttcagataatcgaacgcattgtcttcaccccacaattgggcgaaggtggctaatgcggtgtaagctgtgcctgagctttgcggatcagctatctggatttcgcctttatattccggtttgatcagatctttccagcaggttggcacgggcagatttttctctttcaggcgttcggtatttacaccaacgccgagaatgcccatatagaccgcagaggtatagttgcctttgcgtttcgccggatcacggaattgaggcatgatttgcgccaaattcggggattgataaggttgtaagagatctatttcacccgcctgggaatggggatcgagagtaccgccgtaccatacatctgcctgtggattgcgtttttctgcctcgatttttgccaatgtgctaccggagccattgcgaacgaaggtagtttttacattatatttttcaccgaaagctcgggtttccgcttcgcacatggcgttggtagcattgcaatagacattcaaacggccagccgcctgtgcgttattggtgatcaccgtcgcagttaatcccatagtgatgagagtaaagagagatgtcaatttcattaggatgatgtccttatattcggaattttttgttttgaatttttttaatgcgggtactaataagcctaattatttcttgttaaataagattgaattgttaattcaggtgaaagacatcatgaatagtaaaatctctttgtgcaaatttatagacaaaatttgtaatcgtgataacaaattaaaaatagttttgcatgatataatcacgtaatttatttatattcatacttaaataaatgatataaatacctataatgattcagaggtaattaatcgatatatgcaatatggctgcaaaaaaaatatatgatatggcagagaatagagaatcacttgatcctgatggttggtttagtccttatctgaaaaacagaggaaattacgttttttctctgtttttcagatatcaattatatgattaattttatttattctaatatcatcattaatccaagaataataagaataataccgggaatacatccgagaatgaatattcagataatattctataattctgtcacgcattctatggattttgaaaaagatattgaaaggggtcagtaaagccagcaggcgcattcatgtcttttttattctgggaccaaaaacatgggcgaccatttttcgttttatcctgtcgtcagcataaaagaaccaacggggcggcttctttgactttacctacgaccattgctcatccctttcacagcagacaattacttcggtgccagatttaatggcttctgttaccgatttgggtttgagttttttaaatgacgaagcacggtattcaggccaatccccatcactcgtgctgtccatcctattcatagccatatcgacgatgtacttataggtgtcgggacgacaagcggcatcagtgaattcaagttgtcaggaatgacggcagtattggcagaaataacgttgatgaccagaacgtgaacacccgttgcgatagatctctttaactgcacaacaagaggggcaagtcacatcaatctttgccatttgaatgttctccaaataggcaggctatacataattcaataaattgatgtcacgacccaaaactaagttaagaatatattctccttttgaaatgggaatgctggatattgccgtagctgaaaatatctattctgatttgaaggatatatctggcgttacaatctcagattttcaccctttacccgtaatgagatgaatatattttaaatagattgattaacatcctaaatcaagaggattattttttttaatataaaatatacgatatatcgcatatgatggaggctcggtagtatttttccaattgccctttaagcatacaagagtcaaaagaaggtcatacagatgaaagcacttatcgtaatcgacatgttgaatgattttgtaacaggtgtcctcgccaatgaagaagatgcgatgaaaatgattccgtctattcagcgcatgatcaaacatgccagaaacaatcctgattggttggtggtctatgccaatgatgcccatcgtgcggatgatcgggaaatggaaatctggggaaaacatgccatggctggtacgtggggggcggatgtgattgatgagttggctccaatcggcatggagcgtgaaattgtttctcccaagcgattttataatgcgttcgacggaacggggctggaagatgttctcgcacaatatggcgtgactgaagtggtgctgacaggtcagcatatccattgctgtgtccaccatacggcttacggtgcatttattcgtggttatggcattacggtattatccgatgctgtttgtgcttttcccggtatcgatcaacaagctgcccttgattatctgaaaaccatctatggggctgaaattacgacaagcaaagcattcggagtatgacctgagtgaatatgaatagtttgtcgggaaaatggaatatataactggcagattaattatctgccagtgaaattattttacataagcgagcaagctgagagaggggcgggcaagcgcctgacattttgtcttttggggcagattgattcccttcagatcgttgtaaccggactgattcagttcttccattaactgactgttgtagttattgagatcccacttattacgttgagcaaaataaataactgcacgcctgatctcacgatctgggatctggctatagccacaatcatatttcaaataaatgtagacggctgtcatatcagcaagactttcagcctcttcctcagacagagcttttgcgggttgagcgaaactgaacagaaccagaatgtaagtgagtaaagcaattttttgcataatgtctattatactgattttctactgttttgcctaaaataacatattaatatctttgttagccaaactttattttcttaactttaattggtagagcggagccatgaatcagcgatagccatattaatttcctcaaaaaccaacatgaccactcactgtagtttatgtacatcaatatgtacatttttcttatgacacaagatgaatgcgtatgactacctctgatgaaataaggtatgaaaataaaaatatagtcatttaaaatcagtttcttatataaaaacatgactaaaaatgactattgaagaatattaatgattaatcaaatctattcatcttccaaataggtgtagccatacagtccactttcgaattcttgcaggaactgctcctgcaaattttcatccagatcagccgctttcacctgatcacagaagcggctcatcagtacctgcggctccagttttacatattggagcatattggctacagaatcaccctcttcgctctgcaagtaggtcacttcgccgtgttctgaaacgtaaacatcaacggcagccgtatcaccaaacaggttatgcatattacccaaaatttcctgatacgccccgaccataaagaaaccgatcaagggaggattctctggatcataagccggcattggcatcgttgctgctataccatcaccatcgacatagtggtcaataatgccatcagaatcacaagtgatatccaacagaactgcacggcgatccagtggcttatccagcccttcaatcggcagaacagggaacacctgatcaatcccccacgcatccggcatcgactggaacagcgaaaaattcacatagaatttatccgccatacgttcctgcaattcatcaatgaacggacgatgcgcacggttacttgggtcaagatcccgctgaatatggcgacaaatatttaaatagagttcttctgcccaagcccgctcagacaggttcaacatcccgtgtgcatattgggtatggacatcctgaagatcaaactggctatcatgcagccactcacgcagggaacgagaatagccgccatcctgcatttcctgccacgtatcccacaaacttgccagaggacgtgaagcatcttctgctggcggtgttgtttcagtaaattcgttatgctctactccaatgacattagagatcaagaccgtatgatgagcagtcaacgcccggccagattcagtaatcacggttgggtgcggcagaccatgctcttcacacgcatcaccgattccccaaatgacgttattcgcgtattcattcaggccgtagttaactgaacattctgactgagagcgggtgccttcataatcgacacctaatccaccaccaacatcaaagcattggatgttgacacccaatttatgcagttcgacataaaaacgggcagattcacgtacgccggttgccacatcacggatattggcaagttgagaacccagatggaaatgcagcagctgcaaactattcagctttcctgctgagcgcagagtttcaaccaattgcagtacttgtgctgccgcaagaccaaacttggatttttcaccaccactggactgccatttgcccgctccttgcgacgccaaacgcgcccgcacaccaagacgagggatcacactgaggcgttcagcttcttccagcaccattgcaatttcagacattttttcgataaccagatacactttgtgccccagtttttcaccgatcagtgccagacgaatgtattcgcgatctttatagccattacagacaatgaccgtacgtgtcatgccagcatgagccagaacagccatcaattcagccttggagcccgcttccagcccgatgggctcacccgcatttgccaacgattcaatcacacggcgctgttgattaaccttgatgggataaaccaggaaataatcgcccttataaccataagattcacgtgcacgtttaaacgcggcattaatagaacgtagacgatgttgcagaatctgagggaaacaaaataatgagggcaagcgcagctgttttttttcttcctgaactttcttcaccagctcagtaagttcaacttgagcttccggtaaatcagggtttggacaaacactgacattacccagatcgttgacatagtaatagccgccaccccagtatgcgatattgtaggtctgtcgcattttacgagcgatattatcattcatggcagtctccttcatggagtagaggtttgccttcacctgtaaagtcaataacccaagacactattaacagcgctaatagtacgtatcttgcgcattaaaaaatgccagggaacagcatgctcttaaattatagaaacgtttagagagaactaaacaattatttacggtgtgacaatatggtgccgactcgatattaccagtctgtttgaatgctttcggtaacatcggaatgagttcatattgaaaagaaaggaactagatgtgaatacatcaatagcatagtgtggctgttggccgttaacaatcagcagataatggtgcataaccccattcacccccacatggcttatcagaacgcaagccgtttctcaattgagaagcagaacacgcagtgaacgtaccccgcaaacgcccataacctgaagtgcaaaaaatccatcagttacgcgcgcagtttatacctgcaatcaggcaaaattgcaaaatgaaatttatcaaaatacattcactctgactgatctttttttaaaaacgccgaaaaatgtcacacggcaaaagatttttaaaactaaaaaaactggtatccttgacaagagtgccttaaaatggccgtctagatggtaaaacatctacccttaaaccaagattctatttaaggtaaccaaatataatgactacacacctttttacttctgagtccgtttcagaaggacatccagacaaaattgccgatcaaatttccgatgctgttcttgatgcaatcttagaacaagatcctaaggctcgtgttgcctgcgaaacttatgttaaaactggcatggtcatggttggtggtgaaatcactaccagcgcttgggttgatattgaagaaattacccgccgtactgtccgtgaaatcggctataccagctcagacatgggttttgatgccaattcatgtgcagtgattagtgcaattggtaaacagtctcctgatatcaatcagggtgttgaccgtgcagatcctctggagcaaggtgcgggtgatcaggggctgatgtttggttatgcgaccaacgaaaccaatgtgttgatgccagcacctatcacgtatgcgcatctcctggttgagcgtcaagctcaagtccgcaaaaacggtatcctgccgtggctgcgtccggacgcaaaaagtcaggttacctttcagtatgacaacggcaaaattgtcggcattgatgccgtagtgctttctactcaacactctgaagatatccagcagaaagaactgcaagaagccgtgatggatgagatcatcaagcctgtactgccggctgagtggcttactccaatgaccaaatatttcatcaacccaacggggcgctttgtaataggtggtccaatgggtgactgtggtctgactggccgtaaaatcatcgtggatacttacggtggtatggcgcgtcacgggggcggagcattctccggtaaagatccctccaaggttgaccgttccgcagcttatgcggcacgctacgtcgccaaaaacatcgttgcggcgggtctggctgatcgctgtgaaattcaggtgtcttacgctatcggtgttgctgaacccacttctatcatggtagaaacgttcggtactgaaaaagtgccaacttccaccctgatccaattagtccgtgaattctttgatctgcgtccatatggtctgatcaaaatgttggatcttctgcacccaatctatcgcgatactgcggcatacggtcattttggtcgtgaacatttcccgtgggaagcaacagacaaggcagaaattctgcgttctgcggcaggattgaaataataccctgttagcataagaagcccgctaatatccggcgggctttttcataactcaccattcattgagcgatgagtgaaattaccataccgtatactgccgttatgaaattcgttagagtccccctcgcactacagcaaaccgtcatgcgcactctacggcaaaaattagcacaggcgagtgattaccttgaaacaacatttcctgaaccctgcgtgacctatcgacagagaggaacaattgccggcagcgcctgcctgcaaggttgggaaattcgcctgaatcccgttctacttatcgaaaaccagcaatcattcattgatgaagtgatcccccatgaactggcacatttattgacttaccatcaatttggcaaggtagcccctcatggaaaagagtggcgctttgtcatggaaacggtgcttaaagtgcctgccaaccggacacatcagttctcagtggattctgtccgcagcaaaatatttatttattattgccgctgccagcaacatgagttgaccatacggcagcacaataaagtccttaaaggaaaaagttgctatctttgccagcaatgcaaagaaagattaaaactattagagcaaaataaatccaataccccacagtcagagagttcgacctaagaaatccggttcaatgctggcaaatatggctaacatagtatgcgctacaacttaaaatctattggacgtaagttcattggctggtaaagttcgctgctttaattttttctgcttctgcaataagttgatctgccgtttttccatgcagtgatcgaaaaaatttctgttccaatctttctatatccccagatttaatatttccattcgcactctctttaaacaaatcatcaaaatcaatgctattggtcatggcaatattcaatgaatcatcaaattttaattttttatcttccggtaacgtatctctgattttttcgatggatgtttttaccgctatttcatttgtaccatcaatactcaagtgattatcacatcctgttaatacaaagctcaataaacatactgccaacaaatttttcatgatcccccctattactgatgaaataataatagcagaaggaaaataaataagccgtttttagttatagctctatttaaatttaatattgtttacttttcatcgacgctaacttcaattaactctgttcattctatttgtaagtataaatgtagcatcaagaaaagagaaaaataactgtattagctatttttcaatagaaaatatcctgcatttatgccagccatactcctaataattttctcattaccgcaaaaaacgaaatgtatttgtgtaccatgattattaattttaaaatctgttcaaacccgacaaaattcctgagtacaatgcgaaatgagataaataccatacctgaaaaatatcaatttattttttataatattcacctgtttttatttaccatagcgaaatattcaaaataacatattgcaaataataatcaataacactctcctgaaaacctaaccagttaatcactgacggataccattcatcataaaactattccacatcaaaattaactcactgttattaaatacaaaaaaataattcaatgatatttatattgtatagaaatgtaaaaagttgattaattaaaataatttccatataaaatcattccctataaattatttcagctctatctttgtcaaacaacattacttaggcttattgatctattaacattgggggatgaaggaagatgaattatggaaaaacatggtttgtgaaacaaaaaatatttttgataatcataaaacattattttcaaaagaacacttaaaaactgaattcagtgtattactacaagtaacagttaatcataaagtctttttgaaaatgcaattaaccaataatccgaaaatatagtaacccccataaacaatccattatttacctatataaattattcatggacttaccgataactttcatattacgtctgatactaaggaaaaaagatgtctgtcattcattactccataaaatattttatattggtattatttgtgttattaccaatatgttcacaagcagaaaatattactgttacggatattgccggacgagaagtcacagtgaatgctccggctcaacgggtcatactgatagatagccggagcattattgcgttgaatatcctgcaccccaacgatccattgaaaggtattgtggcatgggataatgcactggagaaaacagcacctgaccttgccgcagcctatgaggaaaaatttcctcaattaaggaaaattcctattttcccgactccttatacccgtgattttagtgtcgaaaaagctttaacctataaacctgatctggttattttcaatatgggcctgaagcctaaactggataacagcaatgcggttaagctactggaaaaatcgggaattcctgtcattttcatcgatttttgccaatatccgctgtctaataccgtatccagtatggaacttctgggtaaggtgtttaaaaaagaagaaaatgccggtaaattcattgcgttttatgaaagccgtctgtctttgatcaataagcgtatcgccacactgtaccaagagcagatccccagtgttttcatcgagcatcatgccggtatgctgggagcaaaagattgctgcgataccattggtgccaatagcttcggcgagtttgtcacaaccgcaggaggagataacatcggcagtaaatggttctcagacatgggaggcagaattaacgaggagcaattgctggtcagcaatcccgatacttacctgatgacagtagcagattgggatcaggttcacgcagggagccaatctgttcctttgggttataccggcaatttagaaaaatccgaaaagcgtttgcaaaacttgctctcccgcccaaacctgaaagtactcagctcgtaccgtgaaaaacgcgtgatggcgatttaccaccaatattacgattcaccattcaatattattgctgtagaagccattgctaaatggctgcatcctgagttgttcaaagatattgatccccatgcagatagtatctatgttcataaaacatttacggcattggacggtagcggtgtattctgggtaacgaccaaatagtaccttcttaatctaaacctacaggtttttcctgtgggtttttctatagatccgggggattttttctgacaggcgttaggagtaatttttatattagccaacatgattctttatgcggcaaaaatcaaacatttttgctatgaaacaataaagcgataaaaaaataacaaataaaaacaattaattatattaacaacaggatactttatggacaacacttccaagaaaaaacctttataccagatcctttatattcaagtcatatttgccatcttactgggtatagcgctgggtcatttttatccagatattggtgaatcactcaaacccttaggtgatgctttcatcaaaattgtaaaaatgattattgctcctgttatctttttgacggtcgtcacagggatagcaggtatgaataatatgaaagccgttggaagtgtcgtaggaaaatcgatgttgtatttcttgacgttttcaactcttgctttaattattggtttgattgctgccaatatcattcgccccggagatggcttaaatatctcacctgaatcgttagatagtagcaaagtcatcggttatgtggagaaggcacatgaatcatccatcgtcggctttctcatgaatattataccggaaacggttgttagcccacttgtaaatgggaatattctgcaagtactctttattgctgttattttcggtatcgctttagcgtcgacaggaaaaaagggcgaacctatattggtgtttttgcaaaacttctcagagcctgttttcaagatggtaggcatattgatgaagctggcaccgattggcgcatttggggcaatggcatttaccatcggtaaatatggcatttcatccattggaaatttaatgatgttaattgtcactttttacatgacatcattactctttatttttgttgtattgggggctgttgctaaatataacggtttctccatcattaaattaattaaatacattaaagatgaactgtggttggttttgggaacatcatcctctgaagcggctttacccagcctgatgagaaaaatggaaaatgcgggctgtgagaaatcggttgtcggattagttattccaacaggttattcatttaatcttgatggtactaatatttatatgacgatggcggcattatttatcgctcaagcaacaggcattgagttgagtttcacggagcaaatatctttattattagtcgcaatgatcagctcaaaaggtgccgctggagtaacgggtgcaggctttattacgctagccgctactttatcagttgttcccagtttacccgtagccggtatggctctcattttgggcattgatagatttatgtctgaatgccgcgcattgaccaatttagttggaaatgcttgtgccagcattgttgtcgctcgttgggaaaatgctttagataaggataaaatgcatcaagctttaaatggtaatagacaaaattcagtagaagatatatcattttccctatcaagtaaaaaaaacatttctcctccagagaataaataaaactcatttaaaatgatgttaaaagccaccgatatatatcggtggcttttaattacattaatggaatattttaatttcatgatcattcgaaatttttaattaagcaataaattttagaataattttattatttagaaaccatgaaatacaaataaattttatcatcccataaaaattaaactaaaatatcagatatgtattattatacataccaatagatgaataagttaaataacaaaaaagttaactaattaataacacactaaataatttattgttaatattataacgtatgtttattatatttcaccctctcttttattatttaatttgtttattgataaaaatcttttatatttaaatgcaattctgacagaaaaataagaattaaccccataaaacattccggatatatgtcctagcataggaaaaaccaaagtactcggagaatataatgaaaaaactgcataatatcgcaaaagaaatgttacctgctaaatcgtataaaatgctgattaatggagaatgggtagatagcgtttcaagagaaacccgtaaaagttataaccccgcaactggtgagttactcacagaatatgctgctggcaatgctcaggatgttgaactggcagttaaagccgcccaaaaagccttacctgcatggagtaaagaatcagcaaccgaaaaacaatctctgctactgaaaatcgctgacttgctggaagctgaatcagaacgtttcattactcttgaagccttagacgccggtaagacactaaatctatgtcggacgtttgacattccttttgccgttgatcactttcgctacttcgctggcgtcattcgtgcccattccgatgaagccgatgtgattgatgccgataccctcagcctagtgatcagagaacccattggcgttgtagggcagattatcccgtggaactttccactgctgatggctgcatggaaactagctcctgccctcgccgccggtaataccatcgtgatcaaccctgccagcctgacttcaattagtctactcgaatttggccgtatcctgaatcaagttctgccagcgggcgttgtcaatatcgttacaggtcgcgggtctagtgttggtcaagcgatcctcgatcatgaaggcattgacaaggtagcctttacaggttcaacagaaatcggttacaacgttgccgcagcggcagccagacggatcatccctgccacattagaactcggcggtaaatctgccaacattattttccctgatgccaatatgaaaaaggctgtcaaatatgctgctgacggcattttgttaaatcaggggcaagcctgtgaatctggcgctcgcctgttcctgcataaagatattcatgacgagttcctgaaatcgctgaaagcggtatttgaatccgttcgggtgggcgatcccatgatgaccgaaaccgagatgggttgtcagatcagtcaggaacaaatggactttattctgggctatattgaccttgcgaagcaggaaggtgcaaccgtgctgaccggtggaaaccgcataacaggcgcgggatacgatgatggtttctttgttcagccaaccattattaccaatgtgaccaataaaatgcgggttgcacaagaagaaatctttgggccagtgctgtgtgtcattccatttagcagtgaagaagaagtcgtggaaatggccaatgattcggaatatggtttgggaggcgcggtctggacgcaggatatcaaccgtgctctgcgcgtggcaaaagcggttcagacaggccgcatgtgggtcaatacctatcatgccctccccgcccatgccccatttggcggttacaaaaaatccggtcttggcagagaaacccacaaaatgagtctggatgcttacactcaggtgaaaaacatctatatcagtacgaaagaatagttataggttccaagacaatcgccacccttccgagtggcgatttttatgatcaattttttattgagatgaattacaaccagaagaaccaggcaaccacagagataatggcgatacataccacgttcagcaccatgcccactctcaccatctcaatttgcttgatatagccagagccataaacaattgcgttaggaggcgttgccacaggtagcataaatgcacaggatgcaccgataccgataatcatggtcagcgccataacaggcatccccaaggcttctgcaaccgtagcgaaaatcggcaccagcagtgcggcactggcggtattactggtaaattccgtcaggaagataatgaacgcagtaacagcaaggatgatcacaaaccagtgactggcaccgaaggttgccgccatgccattcgccataacttcgctggctccggagtttttcaggacagcactcagcgtcaggccgccaccaaacagcatcaatacgccccattcggtgttattttgaatctgtgaccaagttgacacgccagtgatgccaatcaggatggctgcgctcactgcaataatcgtatccagatctttgataccgccaaaagcatcactgatgattgaactgaaaatccaactaaacaccgtcagcaggaagatagccatagtgataatgcgcttactgttccactccagatgttccaatttcagatcaaatttatgcttcaggttcggacgcagcatgatgtacatcacagccaccatgactggcaacaaaatgatgaccatcggcacgccatacttcatccatgtgaagaagtccatgcccagttgcgccgctgcaatggcattcggtgggcttcccaccagcgttcccaaaccaccgatactggcgctgtatgccacccccagcaacacaaaaacaaacgtattgcgttcagtgcgcacatccagattagccagaatgcccagtatcagtggcagcatcattgcagcagtcgcagtgttactgatccacatagaaagcacggcggtaataccaaatatcagcaatacagccaccgataaacgcccacgggcaatcatcagaagacggttggcgatcagccgatccagaccttgaatatgcagcgccgttgccagtgcaaaaccaccaaagaacagaaagatgatcgggtttgcaaaagattgcagcgcatcacccgtgttcatcaatcccataccaacagccagaattggaatacacagagccgtaattgtgacgtgtatggcttcagtcagccatagcacaccaacaaatgccatcaatgccagacccgcattggttttttcgccatacggcaaaaacttaagcagagcgacaagcaagataatatccagcgcgagaataattaagcctcttttatttgagggatttggcccaatcgctggggttaaagattcagaagcgtccataaagactccgtaaaacaatgaaacacaacgcggtaatgtaaaaagaattattgatgaatcattgccctaaatgttaaagaattacattacatgtgaaataataaggagtattaacaaggaagaaaatacaacgtgtatgattttgggatctatcacgtggggtttgttcaattaacgaatgattgtatagaaaatatactaatattatgtcgttatttcatacttttcatttcatcatcgtatttataatcacttatacggataaaattatctttcgttaagatggcgaaagagcatataccctttcgccaaaacataaataaaatttatttattattgatatcgaccggcaattatgcctgacctttcacttctttcagaccattgaaagtcgcacggttacccagtgcttcttcgatacggatcagctggttatatttagcaacacggtcagaacggctcatagaacccgtcttaatttgacctgccgcagtaccgacagctaagtcagcaatagtcgcatcttcggtttcaccagaacgatgagaaatcaccgcagtgtagcccgcatcttttgccatcttgattgcagccagagtttcagtcagagaaccaatctggttgaatttgatcaggatggagtttgcgatgcctttttcgataccttctttcaggatcttggtattggttacgaacaaatcgtcaccaaccaactggattttgtcgcccataactttagtctggtaagcaaaaccatcccaatcagattcatccaaaccatcttcgatagaaacgattggatattctttggtcaggccttccagatagtgggtaaattcctgagaagtgaacgtcctgccttcgcctttcagttcatagttgcccgtttctttgttatagaattcagaagctgcgcaatccatcgccagagtaatatctttacccagcacataacccgcttgttcaacggcttctttgatcgcggccagcgctgctgcgttagattccagatttggcgcatagcccccttcatccccaaccgccgtactcatgccttttgctttcagcacttttgccagattgtggaaaacttctgaaccaatgcgtaccgcttctttcagcgtgctggcaccaattggctggatcatgaattcctgaatatccacgttgttgtcagcgtgctcacccccgttgatgatgttcatcattggcagtggcatggagaacctgcctggcgtaccgttcaactcagcaatgtgctcgtacagaggcatgccttttgccgctgctgccgctttagcgttcgcaagggaaacagccagaatcgcattagcaccgaagttagatttgttttcagtaccatccagctcgatcatgattttgtcgatgttagcctgatctttcgcatcctgaccaaccagagcctgagcgattgagccattaaccgcagaaagcgctttcagtacacctttacccatgaagcgagatttgtcaccatcacgcagttccagtgcttcgcgagaacctgttgatgcacctgatggcgcagcagccagaccaacaaagccaccttccagatgtacttccgcttctaccgttgggttaccacgggaatcgatgatttcacggccaagtactttaacgattttggacattaggttttcctcagtacaagttaaattccgggcaatcgattgaaattaaattcattaaaattaaaaccaatcaatcgccccatatcttatttcaactggcctttctgatatttgcctgcggcttcaacgaagcccgcaaataacggatgaccatcgcgaggcgttgaagtgaattccgggtggaactggcacgccacaaaccacggatgtgccggattctcaatgatttccaccaatctgttatcgattgaacggccggcaatgcgcaggcctgcttcttcaattcgtttcagcaataaattgttcacttcataacgatggcggtgacgttcaataatgtcgtcctgaccataaagtttacgtaccagactgccttcagacagacggcataactggccgccaacgcgcatcgttccgccgagatcactctcttcgctacgtacttctaagttgccgttctcatcacgccattcagtgatcagacctacaaccggtaatttgcactctggctcaaactctgtggagttggcctctttcatgcccgccacattacgtgaaaactcaatcagggcaacctgcatacccagacagatccccaagtaagggacgttgttctcacgggcataacgtgcagtcataattttgccttcgataccacggccaccgaagccgcccggcaccagaatggcatccagatctttcaatacatcaacaccacgggtttcgacatcctgtgaatcgatcagtttgatgttgacggtcaggcgttttttcaacccaccgtgtttcagtgcttcaatcactgacttataagcatccggcagttcaacatatttgcccaccatcccaatggtgacttcacccgatgggttggcttcttcataaacgacctgttcccattcggacagatcagcttcagggtatccgaggctgaatcgtttacaaatataatcatctaagccctgagatttcaagagggctgggattttataaatagaatcaacatcttttaaagagataacggctttctctggaacgttacagaacagcgcgatttttgcacgctcattggcaggaatgatacgatctgaacgacagatcagaacatccggctgaataccaatggagagcagttctttcacggaatgctgagtaggcttggttttgacttcacctgccgctgccagatagggcaccaacgtcagatgcatgtacagggtatgttcacgaccgacttccacggccatctgacggatagcttcaaggaatggcagagattcgatatcaccgacagtaccgccaatttccaccagcaccacatcatagccttctgcgccacggatgatacgatctttgatttcattagtaatgtgggggataacctgaatggttgcacccaaataatcgccgcggcgttctttacgcagcacttcagagtagacacggcccgtcgtgaagttattgcggcgtgtcattttggtacgaataaaacgttcgtagtggcctaaatcgagatcagtttcagcgccgtcttcggtaacgaaaacttccccgtgttgggttgggctcattgtacccggatcgacgttgatgtacggatccagtttcataatggtgactttgagtccacgggcttcgaggatagcagccaaagaggcagcagcaatgcctttacccagagaggatacgaccccgccggtcacaaaaatataattagttttcatgctgaacctgaaagtttaggtttaaaaggatgatgaatataacaggacgggaaagcagtataccctaaccttaaatgcgctacaaaccatctaaacaggataaagtatcaactcatcaggaacagcccaaaaccacccgaggcctttctctttaaattcatcaagttaatagtttaaaaatttttcgcctgattcaggttattcagtcattcctcaacgcctttttcgctatttctgccctacggctgctgttttttgacttgctgccacatctgttccatttcctccagtgtcgccgtttccaatgacagaccttggtcgaagatcagcttttcgacgcttcggaaacgattttcaaatttaccgcaggctttctgcaatgccatctctggtttatgccctaaatgacgggataaattgacaacagaaaacaacaaatcccctagctcttcttccagtctggcttcatcaaccaccacctgccgggcttcatccatcacttcatcgatttcttcatataccttgcccagcaccgggccaagtgtatcccaatcaaaaccaaccgaagcacagcgtttctggattttataggctttcatcaacgctggcagactggcgggaatatcatccagcacagaatgctggtctttttccgccctctctgccgttttacgttgttcccagctcccgatcgcttcttcactgctgatgcctgcctgttgatcgaaaatatggggatgcctgcgctctaatttgtcacaaaccgcgtcgcagatatcgtcaaaatcaaacaactgctgttcttgacccatctgggcataaaacacgatatgaaacagcagatcccccagttcttctttcagggcatttgcgtcgttgcgctcaatggcatcaatgacttcataggtttcttccaacgtgtaaggcgcaatggtggcagaagtctgcactttgtcccacgggcaaccctgctggggatgacgcaactgcgtcataatccccttaagtcgttcaatcgaggtggtttttatcttatccatgtttcattaattaccgtgcaaacgtctggcttcaatcacatcagatagctggttgagcttcgccagtacccgtcccaatacttgtagattataaatctcaatattcatatcgatagtcgccagttgctgctttacgtcgcttcggctgctcacccccagtacattcaccttttcattggccagaatagtggtgatatcacgcagtaatccgctgcgatcattagcaagcacccgcaccacaagggagtagccgctggaataattttctccccaaaccgcatccacaatgcgttctggtgcgctaatttccaattcggccagctgctcacaatcggcactgtggatggaaattccgcgtccgcgcgtaatgaacccgatgatttcatcaccggggatcggctgacagcaacgagcaacatggtgcatcaaattacctaccccttccacgacgatgcgcccattgtcttgttttacactgcgcggagtgtaggttttattttctagattgcgcagcgccttacgatcagcttcttccgccgtcgttttgttgaacttgctttgcaggaaattcatcaattggtgaattcggatgtcaccaacaccaatacccgctaacacttcttccagcgaatgaacgttataacgggcaataagttctttctcggcttccttgagggtgatccccaaatgggtcagttcattgtccagcatctggcgaccggcaatgatgttcttgtcacgatcctgcttgcggaaccagttgtggatctttgctcgcccccggctagtggttacatagcccagattcggattcagccagtcacggcttggattcggatgcttctgggtgatgatttcaatttgatcacccatctgaagctgatagctgaacggcacaatacgcccactgatttttgccccgatgcagcgatgcccgacatcactgtgaatatgataagcaaaatccaacggcgtagagcctgccggcaagtcaatcacatcgccttttggcgtaaagacataaacgcgatcatcaaacacttggctgcgaacttcatccagcatttcgccagtgtccgccatttcctcctgccatgcgattagcttacgcagccatgcaatacggctttcataactgcccgatttgccgccgccaatggcggtgccttctttgtatttccaatgggcggcaaccccaagttcagcatcatcatgcatctggcgggtgcggatctgaatttccagcgttttcccattcggccccagcacgacggtatgaatggactgataaccattcggtttggcgttagcgacataatcatcaaattcatccggcagatgacgatagtgagtatgcactattcctaaagccgcatagcagtcctgtaaacgctcaacgacaatacgcactgcccgcacatcaaacagttcatcaaagccgagggattttttctgcatcttgcgccagatgctgtaaatatgcttgggacgcccataaatttcgaccggaatcccttctttgagcatgtatttgcgtatggtcgtcacaaacttttcgatgtactgttcgcgatcgatccggcgctcatgcaggagtctggcgatctttttgtattcgtcaggatgcagatagcggaaacagaaatcttccagttcccattttagctgaccgatacccagccgattggcaagaggcgcatagatgttggaacactcttttgccgccagtactcgctcatcttcgctggcatccttcacttcccgtaaatgggcgatccgttccgccagcttgatgatcacacagcggaaatcttccaccatcgacagcagcatccgacgcacattatcgacctgcactgaactggtggaatccgtgtgggtggctttcaactggcgaatggcgtccatttccatcacgccatgcaccagattggtaatagccgtaccaaatgtttctgtcactgtttcattatcgagcagtttggcatcaaggatgggaaagagcagcgcagcgcgcatactgtcattatccatactcaatgtggacaggatctccaccatttccacaccgcgccacagcaacagcgccgcatcagggtgatcctggactttttcgtgacagtaatgccatgtttcggctaatttctcactggattgtggattcgtgatatgtaaactcgcgatccacttatcgactgcaaattcacctgctggtgtgagatgtgcacttcttaccgcaaccataattcctccctactcgatagccattggctcacggctgaacaaagccatggattccagatggccggtgtgcggaaacatatccagcatccgcacactgacaagatgataaccagcctccagcagaattttgctgtcccgcgccagtgttgtggggttacaggaaacgtacaccactctttcaggggccagttttacaatatgtgacatgacacccgccgcacctgcacgggctgggtccagcagcactttattgaaccccagcaccgcccaaggctgttggtgaatatccgattccagattttcgtggaaaaaatcgacgttattaagttcattgagctgggcattatattgcccattcgcgaccagcgcggcaaccccttctacacccactacggtctgtgctttggttgccatcggcaaggtaaagttccccatgccacaaaatagatccaatacccgatccgtcggctgcaaatccagccatgccaacgcctgtaccaccattttctggttaacttcatcattaatctgaataaaatcccacggactgaatttcagtttcaagccatccacctgataccacggagcagtctgcccttctgtcaaaggctcaaggattttttcatcgccagccagatagactgccgccttatgctgcaccgaaaaagtgcgcagcttttccctgtcttcgtgcttcagtggagcaagatgacgtaacaccattaacgggccattatccgccagcactaattcaacgtgtcccagccgtttaaccgcactcagactattcagacactgggataacggttgcaataactgttccaattcagggcgcattaccggacaatgtgcaacggctaccaaatcgttggtctggctctggcgaaatcccatcaataatttttgctgcctgcccgggtttttcttaacatcgtattgcaggccaagccgtacccgacgccggtagccatattcagggctgtgaatgatgggatgagcactgatactaatgccagtttcccgctggataaggtgttccagcacgctggccttagttttggcttgcaactcaatcgcaacgtgctgctgctgacaaccgccacacacattgaaatgcgggcagcgcggtaccacacgaaacgggctgtctgacagccgtttcactattttggccttggcaaactggcgtttttcttctgtcagttggatctgagcctgctcacccggcaataatccctgaataaatatcgtttttccctgatgacgggcaatgccttgcccttgtgcatcaaggttatctgcggtaacggaaataatgcctcggtttacggagcggcggtttggggagtaaaattgcaccatgattctgactaactttgaaaaattgagttttgattttcccacaatggacgcttatgaccaaatatagcctacgcacccgtatgatgagcctgatattggttcctgttttactggtcggaacgcttgtgagtatatcatttatctcataccgttattacgagttgaagaacctgatagtccgcagtgggatcagcattattgaaccgttgtccatcgccagcgaggtgggcatcaatctggataatcgtcgacgggtcgaagtcttagtcaatagcctgcatcgccgcaattccgagattgtcaaagccattgcgatttttgataaaaatcataagcttttcgacatttctaatgataaatatgacgcgaaccagttgcggcttcctgctggtgagccaatcccaaaggttctactgagtcaatcaggacacgataataatatcattttgatgatgccgctgattgcagaaaacatccaagaaaacgaatggcgcactaccaccagcaaggccaatcccatcggctatatcgccattgatctggatttgagaacagcccaaatccagcaatataaagaaattacgacgtcaatcatcctgctgatcctctgtcttggcggcactgccctgtttgcccacattttagtgcgtaaagtgacacaaccactaggtggcatggtgagggttgtagaacagatacggcagggacaattgaacattcgtgttactggcgcgatgccgggagaactggccgcactccagaatggcatcaataccgtcgcggaatcgctgtcgaaatataaagatgagatgcagttgcatattgatcaggccacatctgacttacaaatcaccatggaacagttggaaatccaaaacgttgaactgactctagccaagaaacgcgcacaggaagcggttaagatcaaaacagaatttctggcaaatatgtctcatgaattacgcacgccgcttaatggcgttattggctttacccgtcagatgctcaaaacccccattacgtctcagcaagccgagtacctttatgtgattgaacgttctgccaataatttgctgaaaatcatcaatgacattctggatttttcacggctggaatcgaataaactggtgctggatcaagttccttttctactgcgagatacggtcaatgaagtcatcgaactactcacccccgtggccagcgagaaaaaccttcccctgcaacatcgcatagatgacaaattgcctaacctgatgatcggcgatcccatacgcttgcagcaaatactcactaacctgattggcaacgcgattaaattcacagataaaggcagcgtgatactggaggtcagattacgccagcagcagcatcatctcgtgcagattgatttcaccataaccgatactggcatcggcattaaaccagaatatcggccgattctgtttcaggcattcaatcaggctgatgccagtattacccgccactacgggggaaccgggctgggtttgagcattaccaaaaggctggtcaatgagatgaagggagagatcgatttcatcagcgaacccgcaaaaggaaccgtattttattttgatctctggctggaaaaagaagcgtttttattgggttcattacctgaacgcctgcccattcccccacgtttgcccataaccgtgatggcggtggatgataatccggccaatctgaaattaattggtactttgctggacgaacaaatcgagaataccctgctgtgcagcagtggtctggaagcactgactacggcacagcaacacgcgctggatctgatcctgatggatattcaaatggcagatatggatggtattcaaacctctgaacaaatccatcaattaccacagcataaagagacgcccattgtggccgtgacggcttttccctgtaatgaaacccaaaatgggggacgttccccatttgttggctgcctgtcaaaaccgttggatgaacgtcgcctgaaagcgtggctgaatcaatacagccaaaagaaaaaatcacagttcatcgattgggatatcgctttgaaaaaaacggatggaaaagaatctctggcgcgggaaattctggagatgctagtacaatcgctgccagaaatgaaagcgatgattgaacagatcttggcagcagatagcgacgttgatcacaaacagtttcagtatcatgtccaccaattacatggcagttgctgttacaatggcgtccccaaactgcaagcgatttgtgaattcatcgaaaaacaattgaaacaagctattcctctggcggatctggagccagaattactggaattcatcgatgagatcaatcacgtcattgccgccgctcccgatatactgagagcgcccgggtctctcacttcgataccataaatttacgatattcttcgtaagcataatggtcagtcatgccactgatatagtcctgaatcaaacgcgcccgataataaaattcgagcacatctttttcaacttcatcagtggcgacaatgttttctacagcctcttcataggccagacggtgtttggtagataatttgtgcagcagacgcgtttcaataaaatattttttgtgaaaattattccggtgcagtgacataaaatcctgccgagataactccagcaatgggctgtaaacatccagcaatccggtaataatccgatagccctgcaattccagctcttcgacttcagggtggctaaatacccatttccgcgtgacacttttcaaaatctgcaatagacgatgttcatcgccatcttcttccaacaaagcatgattgaatgtgcctgcataaatttcaggcaaattctcaataaaacgtttagcggtatagggcaccaacttaccagtgataaatacccgcagatacatgaaaaactgctcatgaatactgcgacgggcctcattactggccgttttcttatgagcctgcattaccgtgaattcgaataaatcccctttactgtgtcccccattttcctcccactcttttttcaggtattccaccaattgctcaacattgaaaatacccttttcaaccgcatcatccaaatcagcaatgcaataagagatatcatctgcggcttccataatatacgtcagcggaaaacggcagaaatcccccaattgcagcgctttttttaattcatggataaaactgtcttccgaccagtaatagccttttttcttcatcaggtaactgaattcgtcgggagatccttcaagacggtaagccgggcaggtatatttcaggatacagccgatttgggcataagtcagattcagtttaagcagattatgtgccagccggatcgcttgggcattgccctcgaattcacataaatccttacgtaactgacgccggaacagatcttttttggtttcaccattgtagctcaatgccgccactttacagccatcttgccgagcggtgctttcagaaacgcagtctgaaaaataatcaggatctaatcgacgcgagaaccaatctctgatcgccgcctcaccaaaatggccaaacggcggattaccgatatcatgcatcaggcaggccatttcaatcaggctttcaaaagcaagtaagcgatcactcagcccatatttttccagcaaattctgctttgtcagttctgcaataatcgtttttgaaatatagcgcccgatttgctgcacttccagcgagtgagtcaaccggctgcgcacggcggcgttgcgttccagcggaaaaacctgcgttttctgctgcaaacgccggatagcggctgaattgatgatccgcccacggtcactttcgaattgacgattcacctgatcttcatcgtcaggatgtatggaagagttgctgtacttacgctggtaattcaacttctgcttgaaatcaattttagtcattaatccccccataccgaatgaaacgcttatttatagccggaataaccagtaaacagtgattcaatgttacactgccgcatcgaataagagtgccttttcatagacactaatccattaattaaccatgagtatgacacaatgaaagtaggtgtaataggcgcaatggaacaagaagtaacactactgcgtgaccagattgaaggtctgcaaactgtgtcgcggggcggatgtgaaatctacaccggcaagctgaatggcgttgacatcgcattgctgaaatccggcatcggtaaagtctcttccgcccttggcaccaccctgttgattgaacattgccagccagacatcgtgattaacaccggctcagccggcggccttgaccctaaactgaatgtgggggatatcgtggtttccggagaagtccgctatcacgatgccgatctcactgcctttggttatgagccgggtcagatggcacaatgcccacctgcttttatcgccgacagccaattaattacactggccgaaaaatgcattaaatcccttaacctgaatgcggttcgtgggctgatttgtagcggtgatgcttttatcaatggtgcagaacctttggcgcgtatccgtgcgactttcccgcaagtcgccgcagttgaaatggaagcggcagctatcggccatgtctgccacctgtatcaaattccattcgtggtggttcgtgccatttctgatgtggccgatcaggaatctcatatcagctttgatgaattcttagttatcgctgcccgtgaatcgacacggatggtcaacgccatgttgagcgaactcagccaacattagttaatcaattaattgaagtggagcaccgatcatgaaaccttggatgaaaataatctcacttagatcaatctggttatcattctcattcctgctcttcagttttctgtacagtgtcagtgcgccacttcacgccgcagcctctcgtgttatcagccttgctccctcgacgaccgaactcgcgtatgcggcaggactgggcgatcggcttgttgcagtcagtgcttactccgattatcccgaagccgctaaaaaattagagcaagtcgctgattggcaaggcatcaatgttgaacgcatcattgccctgaaacccgatctgattctggcctggcggggcggtaatccccagcgtccgttagaacagctcgcggcattaggtatcccggttttttattctgatgtgaaaaaagtggaagatgttgcaaccgatctggaacggctggctgtccatagcccacgccccgatattgccaaaaaatcagccgcggatatccgccagacattcagcaaattaaaacagacctatgccacccccaatcccaagccggtgtttttacaatttggcatgaatccgatttttacttcatccgatcacaccattcaaagtgaaatcctatccgcgtgtggtggtaaaaacatctttgctgacagcaccgtaccgtggccgcaagtcaatcgtgagcaagtacttacacgcaaacctgaagtgattgtgctgggaggaactgaagatcaaaaacagcgcgtggcggatttttggcagccacagctaaatgtcaagatcatcactctgaatgacgattggttcagccgtgcagggccacgaattattctggcgacagagcagctttgccgggagctgaatctttctggcggctagaggccaacgtagaaaaaaataaaggcggcgcttaagctgcccttatttttaatagcagtatcatattttcgatcagacgctgaaagaagaaccacaaccacaagtggtttttgcattcgggttagtaacgataaaacgggaaccttccagaccttcggtataatcgacacagccccccaccagatattgcaggctcatcgggtcaaccaccagctcaaccccttgtttctgaatcgtcagatcaccttcgttcatttgatcatcgaaagtgaaaccatactggaaaccactacagccaccacctgtaatataaacccgcagacgcaggttcgggttatcttcatcagcaaccagtactttaactttattggctgcggcatcagtaaactgcaaaggcaatgcagcatcatcgctcatttttttgctccagaccggtgttccggtaaaaattctcagaaagtcgttttaaaccttctgatcagttagccgcgattatccgatacctgactgattcgttcaagttttgctacacaaaggcaacaagcttctccatgtcaggatgatttggcttccccatcaggctgctttaaaatggcctcccccctatctgtacccttatttttcaggagcttttattaatgaaccagtccgaaatgctttactctcaggcaaaacaggtgatccccggcggtgtcaactcgccggtacgcgcctttaatggcgttggtggtacgcctgtctttatccaacgcgccgatggtgcttacctttacgatgttgatggcaatgcctatatcgattatgtcggctcatgggggccaatggtactggggcacaatcaccctgccattcgcaacgccgtgattgaagccgccgagcgtggcctgagctttggtgcaccaacggctgccgaagtggaaatggcaaaacgagtgacagagttggtgccttccatggatatggttcgcatggtgaactccggtacagaagccaccatgagtgccattcgtctggcgcgtggttataccgggcgcgataagatcatcaaatttgaaggctgctatcacggccacgccgactgtctgctggtcaaagcgggttccggtgccttgactataggccagcccaattctccgggcgttcctgccgatttcgccaaacataccctgacctgcgtctataatgacctgaattccgtgcgtgaagccttcgaaaaatacccagaagagatcgcctgtatcatcgtagaacccgtcgccggtaacatgaattgtattcctccacgaccagaatttctgccgggtctgcgtaagctgtgtgatgaattcggtgcgttactgatcattgatgaagtgatgaccgggttccgtgtcgctttgggcggcgcacaagagtattacaacgttaaaccggatctgacgtccctcggcaaaatcatcggtggcggtatgccagtgggtgcatttggcggccgtcaggacatcatggaaaaactggcaccaaccggcccggtttatcaggcgggaaccctctcaggtaacccaatcgccatggctgcgggtctggcttgcctgaatgaagtcgcccaacccggcgttcacccgcgtttgagcgaactgacagacaaattagcttctggcctgaaaaacgcggcatcagcagcaggcgttcctctggtggttaaccacgttggcgggatgttcggtattttctttaccgacgcagaaagcgtgacttgctatcaggatgtcatggcgtgtgatgttgaacgcttcaagcaattcttccacttgatgctggatgagggcgtctatctggctccttctgcgtttgaagcaggctttatgtccatcgcccattcagatgaagatattcagcgtaccgttgatgccgctgcccgctgttttgccagactgaattaagtcattccgttatctgtgacgccacaatcccgtggcgtcacattgggtaaacatgcctgcggcctatttcaggatctgataggcgtcaataaatatgtttcatcaacccatctcattaaatcatctccctttttactaaattatcgagcggcaccatgcttttgtgcaacacgccgaaaaccaacaattgagtgagtcctcactattgtaccgtaaatcggcggattttaattagacccgactgggcatcagggattaaatgataagtagacatcaatcgtactgaccaacttctaactcatcaaaaaagacatcgccactagtcagttttcctgcttccatatcaactttggcctgagccgctcttgcttgcaataattgcaatttgagcatttcggtcaaaatctaaactaccccccatcggaatcgatgggggcgatactctattactgattaaacatctcctgtagccagcccggtgcttcttctttgttatcctcaaccggctgcggcgtagattgctggcataaactctgcggatcatctgtccagaccggcaacatcctgatgccattaccagtacagttgaaactgccatcttcgttgactgacatatccacaatgtcttccggtggacgattattcagtaccaatggcgtttcattttccagataacggaggtagatcttcaatgcccccgttgctcccgtcagattggttaggccattattatcacgccctgtccagatgatcgccacttccttaccatcgatgccggtaaaccaactgtcacgcagatcgttggtggttcctgtcttacctgccagattgtatttaccgtattttttcgtcagcgaactgcctgtaccacgagccaccacctgctgcataccgtacagtgtcagataagccgcctgtggaggcactgcccgctctgcctgcggataactctggtaaatcactgtaccatcttccgcaaggattgaacgcaatgccgaaagtttcgcccgattgccgccgctggcaatggtctggaactcttgagccatttccatcggcgtcaggttgattgcacccagcagcatggaaggaacctgttggatttctttagccggaattccgagtgagatcaaggtattggtaatgcgatccagcccgatactcagtcccagactcactgtcggaatattaatcgaacgagccaacgcatccaccagcatgacacgtccactaaaattacggctgaaattcctcggttgccaagattttccgcccgacagaggtatcgaaataggctcatccgccagccaagtattcatgcggtatttatccggctgactcagtgccgtcaaataagtcgcaggtttggcaagagaaccaatcagacggcgtgcattcaaggcccggttaaaacctgcatatcctggttgagaacccccgaccatcgcacgaacttcaccactgaaacggtcaacaacgaccatcgcgccttccagatcatctaccttgcgggttttccgcagatcggcaacgccctcttccacggatttttccgccgcatcctgtgataccgggtccagtgttgtaaagattttcacgcccgacaggttgttaatcttatcacccagattttcctgtaattcctgacgtaccaattgcatgaaagcaggctgtggggtaatcaccccacttttggatttcacacccagcggacgggcgctcaacagatcataaagctcctgatcaataatttgcctgttcaggaggattttcaataccacgttgcggcgttccaatgccagtttaggattgcgccacgggttatacatcgatgctcccttgaccattcccactaacagcgcctgttgatccaaactcagttcatcaatcggacgcccgaaataatacagactggccaatgggaagccgtggatctgttcatcgccgctctgccccagaaaaacttcgttcaggtacagttcaagaatgcgatccttgctatagcgggcatccatcagtaacgccatgtaagcttcattcgctttacggctgaaggtacgttcattggagaggaacaggtttttgaccaactgctgtgtcagtgtactgcctccctgaaccgtacgcccggcggtcaggttcgccagcaccgcacgggcaatggaaagcggcctgaccccatcgtgttcatagaaataacgatcttcggtttccagcagagtctgaaccagtaaatccggaaaacctgaacgtgggacaaccaaacgctgttcgccattcggcgattgcatcatcgtaatcagtttcggatcgagacggaagaaaccaaattgacgctggttctccatgttttcgatgctggcaatatggttatcactgaagaccagccgagcctgaatctgtccttctttaccgtcagggaaatcaaacggacggcgcagcatttcaatattgttgcccctgacaacgaactcaccggcacgcgtgattttggtcaccttccgatactgcatgccttccagcaaccgaatcatttcgtttttgctgtaattcatgcccggttcaaggttgaccatacgcccatacaccgcagcaggtaaatcccatactttcccatcaatgcgatggcgaattttgttatccagataaaaaccgtaaatagctatgagcactgccagcacaataaatattttcaacagcagcaaccagaatcctcgccatcgactccttggcggacggggttttttcccttttttcgtcatgacctgttcctcatcgtcgttatcaaaatcattattttcatcattttcatagtcatcctgccgatggcgtttttttgctggacgctcacgacgaagttctggttttttgcccttgcgtccgattggctgacggtcatcatcagacataccgaaatctccaaatgtttattcaatatagaagcctgactgcatcaaaccagtcatatatatttttttacacgccttgtcggcgctgtgttagcaggatcgtctggccataaatgtttgggataacgtcccttcatctctttttgcacctcacgataagccccctgccagaatgccgcgagatcttgtgtaatctgtagtggacgatgcgccggagataacagttcaacgaccacaggaacccgccccttcgccaataccggattctgctgttctccatacatttcttgcattctgactgacagcaagggcggtttatcgtggaaatattggatggtaatcctacttccggtcggcacagtgtaattagtaggcaattcattatccagtatttgccgttgctgccaatcaagcagagccaaaagagcacacgacagctcaacctgacgtaatcccttcaaatcccccactcccgccaacataggcagaaaccattgctcgagggaatccagcagattgtcatcatccaccgcaggccactcaatttcagatagccattctgttgccctttgcagccggatgcgcaactgcaatgcttccggcgaccaattcaacgccgccaatccttcctgtcgaatccagttcagcagggattcctgtaattccgcctgagaaggttttgctaaaagctgcgctttgacagtcaaacgcccgcattgcagacgtttccatgctcgcagagtgcccttactatcatcccactctacggctgtctgttctgtaaacaggctcggatattgatgaataatgtgttcgatgttcagcgggcaagcgagcaagactctggcatcggggtttttactgttttgctgcaatgtaggcgctatcagccactgctctcctgacagcggatcacccggttccagtgccacacccaaaccattggctatctgaaaacgcccaagattatcacggtttttagcaatccgatcaggaaatccctgtactaatagttcgggtacaaatgcagcattaatcttttctgtgctgatttttttagatcctatttttgcagtcttgctcgcaagattcctgataagctgattagtgcgctgctgccaatgaggttggtttgaatttatccaatgagtgagatccggcagtccactgcggggaggctcttccaagatcgctaccagttttgctgccgttaccagcgcctcatcactctgctctttgcctgcacataacatagccgccagacgcggttcactgcccgcttccgccatttgccagccacgggcagtcaattgttgattatcatccagcgtccccaatcgcagcagcagcgattgagccactgcaagcgcgggctgtggtggactgtccagccagttcaactgattactgtcacgacatccccactgtaatagtgaaagtagcaggctgctcagatctgaatgcagaatttccggctcactgtattccgtggctcgttccgcctgctcgcgactgaataaatgccagcagacaccttcttccagccttcctgcccgcccagcccgttgtaccattgacgcctggctgatacgttgggtcatcagtcgggtcaggccactcttcggctcaaagcggctggtacgttcaagaccgctatccaccaccaaccggataccttcaatcgtcaggctggtttccgcaatattggtggccagcacgaccttgcgcattcctgctggcgcgggtgctattgccttccgttgatcggataacgacaacgcgccgtacagtgggcacaataaagtatcgtcgttgattttttgttcaagttgcgccaacacacgctggatttcacccgcgccgggcagaaacagtaacaatgatcccgtttcctgctgcaataaacgcaacactgccgaagccactgattgttcaaaatgctgatgaatcggcaacggatgataagatcgtgctaccggatagcgacgaccttctgaaacaatcacgggcgcatcaggtaataaagaagaaagacgttgattgtccagtgtcgcggacatcaccagaatacgcagatcttcacgcagaccttcctgtacatccagcaacagcgccaacgcgagatcggcctgtaaactccgctcatggaattcatcaagaataaccagagaaacatcgcttaattcaggatcttgttgtagcattcgggtcaaaataccctcagtgacaacttcaaggcgtgtagaggcactgactttggtttccgccctcatccgataacctaccgtcacgccaacaggctcattcaattgttcggcaagacgctctgcgacactgcgcgctgcaaggcgccgaggttccagcataataatgcgccctgtcagttgagctttattcaggatcgccaatggcaatccggtcgattttcctgcccctgtgggtgcatgcaacaatacctgtttcgacgttttcaacttagttataacagagtccaaaacgtcataaattggtaataacaaaggatcaccctaaccattaactttcaatggacgtcattgtagcattcgctactttaatttcagttcattgatcttgccgaccattagcgatgaaggaaaatttatggaattttcgcctcccctgaagtcagcgaccctaatccgtcgctataagcgctttcttgccgatatcctcaccccagaaggcgaaacgttgaccatacactgtgctaataccggagcaatgacaggatgcgcgataccgggagataccgtgtggtattccacatcagacaatcccaaacgtaagtatccgaatagctgggagctgactcagacccaaaatgggcatttgatttgtgtcaatacactcagagccaacgaattggtctatcaatccattgaaaaaaatgcaatttcagaattatctgactatgaacaaatccgccgtgaagtggtctatggaaaagagaaaagtcggatagatttattgttacagtcaaaacagagagttaattgctatattgaagtcaaatcggtgacattgttgcaggaaaataagggttattttccggacacagtgacaattcgagggcaaaaacatttacgtgagctatcattgatagcacaacaggggcagcgtgctgttctgttctttgctgttttacattctgggattagtcaggttacggcagcaaaacatattgaccatgattatgcatgtcttttggaacaagcatgcaattcaggggtcgaagtagtctgttacggggccagtatgacaaaagacaggatggttctaaatcgcaaattaccttttttatcaataggataatttgtaaacagaacatactgatgaggcaagttttgcaacatatttaggcagtaaacacggtagccttcacaccattgcaaaactaatggcaggaacaattgccaacctcgcagtcatctgctatttatagcggcctatttttttccctccattgttgggggggtcgtttgatagtgcgtgtgtaaggagaagcattatgcaagaagggcaaaaacgtaaaacctcgtccttaagcattctcgccatcgctggggtagaagcttaccaagaaaagccaggcgaagaatacatgaacgatgcccagttaacgcatttcaagctgattctggaagcatggcgcaatcaactcagggatgaagtagaccgtactgtatctcatatgcaagatgaggcagcgaacttccctgatccagttgaccgtgcggcgcaagaagaagaattcagtcttgaactacgtaatcgggatcgtgaacgtaagttgatcaaaaagatcgaaaaaacgctgaaaaaagtcgaagatgacgatttcggctattgtgagtcctgtggggttgaaatcggcatccgccgtttagaagctcgcccgacagctgacttatgtattgactgtaaaacgttggccgaaattcgcgaaaagcaaatggctggctgaccggcagggctgagtacggcgctgaatggcgccgtatgctcccttatattgctcctgatatgactcaatctgaacattccgcattatatatcgggcgtttcgctccgtccccttccggtgatctccacttcggttccctagtaactgctctcggcagttacctacaggcgcatgcctgccatggcaaatggctggtgcgcattgatgacatagatcccccaagagaagttcccggatccgccagccggatattgcagtcccttgagcattatggtctttgctgggatggtgaggtgctgtatcaatcccagcgccatgaaacctatcgggcaatactcgctcagttgcaacaacagggaaacagctattactgcacctgtacccgccagcgcattcaacaattgggcgggttttatgacgatcattgccggcatttacatttgcttgctgacaatgctgctgttcgcttgaaacaacgccatccaatttatggctttcacgataaattgcagggttacatcactgttcctgctaaaatggcagaagaagacttcaccatttatcgcaaagacggtttattcgcttataatcttgtcgttgttgttgatgataaccatcaaggcgtgactgaaattgtcagaggagcggatttgattaaacccacggttcgccagctatcactgtatcagaacctgaattttgcgattccagattatgtgcatttacccctcgttctcaatcaagagggaaataagctctctaagcaaaatcatgcccagccgatcccattggatgatccacggccattacttattgatgcgttatcatttttgaaccaacccaccattgcaggctggcaagatctcacgacagatcaggtgctgcggcaagctatcgtcggttggaatataaaccctgttccgcagaaaaacataacctatcgccaattcaaataaagtgtttctattggctctgcaagcattctcaaagaatgtccagtaagttatgattagcggctgttttttgctttaatattacttagtcactatcgaggtgtaccatttttaaccgagtagcaactttctgccgtaatttgatgatccgcgaaaacaaaacaaaacgcgacacacaggcagccagtgaaaggccagtcaccgtatctgaccatactgctcaaatagagagcagaactctgcctaaacatcgcagagaacatcactcatcttcatcaaatgctgataacgccgcaatgaagaaaaaatccgtaaaggctaagccttctacccccccgatcacggtgctccctcgggatcagcacccaatttcacgtaaagacatcagtgacaatgccctgaaggttttgtatcgcctgaataaatcaggttttcaagcctatctggtcggtggtggtgttcgtgatttattgctgcacaaaaaacccaaagatttcgatatcgcaacgaatgccacaccagagcaggtacgcaaactcttccgtaactgtcggcttgtgggtcgccgtttccgccttgctcatattatgtttgggccagatgtgattgaagtcgccactttccgtgggtcacacgagcaagttgaatccaatgaccggaatcagtcacaaaaagcgcaaagcggaatgttgctgcgcgataatatcttcggttcggtcgaagaagatgccgttcgccgcgatttcaccatcaatagcctctattatggcattgaagatttcgccttgcgggattatgtcggcggaatggctgacctgcaagctgggatcattcgcctgattggtgatccggaaacccgttaccgtgaagatcctgtccgtatgctgcgcgcagtccgttttgccagcaaacttgacatgaccatcgagaaaaccactgccgaaccgatcccgcagcttgcctttctgttgaaggatattccctccgcacgcttgttcgaagaatccctgaaactattacagtcggggcatggctacagcacctataaactgctgcgcgagtacaatctgttccaactgctattcccgatgatgcagcgcggtttcactccaaacagtgactcaccgctggaaaaactactggaacaggtgctgaaaaataccgattatcggctccagaacgacaaacgtgtcaatccggccttcttattcgcggccatgttgtggtatccgttgattgaacatgcagagaaactgtctcaggaaggtggtttaccgtattacgatgcctttgctctcgcaatgaatgacattcttgatgagcagtgcggttctattgccattccgaagcgccataccacgaccatgcgtgacatttggttattgcagcttcgtctgccacgccgtcagggaaaacgcgcgaataagctgatggagcatccgaagttccgagctgcgtatgatttattggaattacgcgccagcgttgaaccacgacatgaactgaaagagttggtactgtggtggtcagaattccaacaggcgacagcgcctcaacagcgtggcatgatatcagaactgggcaccgaccccgttcgtcgcagaacacgtccccgccgtagcagccggcctcgtcagttcaaggacaacggttgacatggcacgggtttacatcgccattggcagtaatctggctgatcccttgcagcaagtcgataatgcacttgctgccctgcatgtgatccctgacacaagctttgttatgcgatcctctttttatcgtagcaaaccgatggggccacaagatcagcctgattacctcaaccttgccgttgcactggaaaccaagctgcaaccagaagcattgctcgatcacactcaagccattgagctggcacaagggcgtatccgcaaagatgagcgctgggggccgagaacactcgatctggatatcatgctgtttggcgattgcattattaagactgagcgcctgactgttccccattacggcttaaaacagcgcgagtttatgctttatccgcttgcagaaattgcgccggatcttgtattcccagatggagaaacactggcagcacgattaaaacatgttccagaaaatggcctgacgttttggttgtagcacggatagccggatttatcgttgtaacacgccgttttatgaaggaaaagttattcaatatctcatacagccgtggccgatttttggataatcagggcctgtcccattgaggttcaaaagtgatgctcaatgggacaggccctaactattcaggagataacaatgaaaccaacaaccctgactgatctgagtcagttaaaaaaagagaaacgcaagttcgctacaatcacagcttacgatgccagttttgcccacctttttgccgaacaaggcatcaacgtcatgcttatcggcgattcactcggcatgactttacaaggacttgactcgaccttacctgtcacggttgaagatattgcctaccacacccgctgcgtccgtgctggtgcccctcactctttcctgatctcagacatgcctttcatgagttacgccactccagagcagagttttagcagtgctgcgacattgatgcgttccggggctaatatggtaaaaattgaaggcggaagctggctgtgtgaggcggtcaatatgctgaccgagcgtgccgtgccagtgtgtggtcatttggggctgacgccgcaatcagtcaatattttcggtggctataaagtgcagggtcgtgatgaaacttccgcccaacaattgcttaacgatgcgatagctttggaaaaagcaggtatgcagctactggtgctggagtgtgtgccgacagcattaggccagcgagtgagcgaagcgctggaaattccggtcattggtattggcgcgggcaatctcactgacggtcagattctggtcatgcacgatgccttaggcatcaccgccagaccacctaaatttgccaaagatttcctcaaagaaaccggcaacatacgggatgccatccgcctgtatatcgagcaggtagaaagtggtgcctatcccggtcaagcacattcattcaaataattattccccggcatgacggccaattaaaggagtagagcaatgctgattatagaaacaatccccattttacgccgtgaaatccgccgctggcatcaggcaggcaaacgtattgcctttgtaccaactatgggtaatctgcatgatggccatatgtcattggtggacaccgccagagcacaggctgacgtagttatcgtcagtatttttgtcaatcccatgcagtttgaacatgaagatgatttggtcaattatccacgaaccctacaggaagactgcgaaaaactgagccatcgcaaggtcgaactggtctttgctcccaatgcaaatgaaatgtatccgaatggctctaacagcagccagactttcgtcgaagtaccagatctttcttatctgcttgaaggtgctaaccgtccggggcatttccgtggtgtcaccaccgttgtcagcaaactgttcaatctgattcaacccgatctcgtttatttcggagaaaaagatttccagcaagtgcagattatccgcaagatcattgctgatatggcttacgatattacgttggtttccgttcccatcgtccgtgaaaaaagtgggttggcactgagttcccgcaataatcttttatcggctgaagagaaaaaaattgctccggtattacatcagatcatgcagtgtattgcagaaaagctgacgcatggagaacgagcgaccgaacagttgctcgaactggcatcgacacatttgcgtgaagaaggctttatgccggatgagttatttatccgtgatgcagaaaacttgactcctctgacgttgcaaagtaaaaaagccgtgatcctaatggcagcctggttagggcaagtacgcttaattgacaatcagcaagtcgatttggttggctgattttagtgaagggatgtgtgtgttagtggagccgtaacatgatgcacatatccctgaggccatggcttcaatttactgataatggtgaaggtttaaataatacccacactcacaccgtgagtaaaaaaataaaattttaattttcattgttgaaattactatcatcaatccttatttttaatgaattattgaaaccacaaatagaaacattatcagataaattatttttcatccattctaaatcaggagtaaagtttaaagttgacggaactcgtcgtagttttacattatatttattggataaaaatgagaaatatattatattggctgcatattctgaatcactaacccatacttccgaattttctttaacacgtaacatcctaataatattaatccatgcatctgtagcacttgtaaacaataccacatcttctggttcacaattattataaacatcgtgatttaaaatagattcacttttcaattcagcttcataagttcccattttaaattcagaaaacaaataatctttcataatctcataagttgaggggcgaataactccagaaccagcagtattcatatgaactatcatattaagcattattcttccataaagttttacttttctttatacataccaaaaaagcagaaataaataataaaacaaatccaacaaacaaccatggagaaataaattcattttccatcatataaaaagcaatagaaggtgttatcatcactcctatatttaccccagcagaataaaagcctagatttctatcaacattttcactggaagaaataccactaacatagtgtgttatagatggaaatattatcatctctcccaaagaccataatatggtagccattataagaataatagcactattaatatcaatcattaatgaaaatcctcctcccgctaataaaagccccagaattaatgaaagcctactgtttacattattcatttttttattaataggaagctcaaataaaataactaaaaaagcattaacaaagaaaataacaccgacaaaataacttggaaatgatgtatagttaatgatatatgcagaaagaaatgtcggaggaagtgcatatgcaatatgcacaggcaaaactgaagaaagaataacaatcaatcttggataatgatattttttatcctctataacttcacattctttttttatgcaatcatttccatcaagactgccaagagagttattaatattttctttagatttcatggataaaagataaaaaataagcgagaaaaaagtaaaaatagaattaacaaaaaaaacaagtataggatgaacagaaaatataatgcctcctacaagaggcccaatagccatacctatatttatagcaagtctattacatgaaaatgcaatcttcctcgaagaagaatctgaatgtgtaacagtttcagagtatgctgctggagtaaaagattcgtaactaattccccacaggaaagaaaatgcaattattgtgtaataataatccaaaaaaggaataagaaataatataattgatgtaaataacaatgagaacacaataactttattagagccaaaatttttaatgaaatatcctataataacatcacaaagtagagctcctgcaccaaaaacaccaactaatacacctgcctgaattgcatttaatgatttttcctgtataagataagcagcaaaaaacgggaaccccatggtccccattctgaatgaaagagttacaaaaaacagagatcgaagttttacgttcaatccgcggatagttgctattgtatcaaacatttaactcatatactccatctttaatagaatcaatatttttacaatcactttctatagcagttatctcatcagaaaaaataaatattcttagggggcttgatagaagatctatggttggagttatctttctaccaatgccatattttacacttaatttaaaaaccgtgttcaactcttttatttcattcactattttttcattaatagctgatattactccatcaagtttcgttgatgtatttaaaacacatgcctcttttaatttactatattttttcccggaaaaatttttaataaatctatcaggtgagcaataagaaatataagtgattctcgcctggttattacctaatacaatatcatgaaaatcaggttccatatttccatttagacgagctcctacttctaccaacacagggccttcattagtcaatataatttccgcatgagctggaccattcattatacctagtgaaggtagtatcttatagatatagtcaataagcaattttgcctcataggaattttcatcaatcaatacatctctatcatagattttctttcctccataaacaatttttttaacatatttccatattccacaaatataaacatgaccattacaacttactgtatcaactatatactcatcaccatcaaggaaagattgaactaatatttctttatctattaataatgatggctatataactctttgtttttatttattaaataaagatcatcaaacgcttgataaatattttcaggatgctctgccaagcgatgcataaatcatacccaaagattggcaatatatttatttacacaaaaaacttatagcttatttttactaataaatacaatttcatcgtgaaaattaaactaatagttatagttcaataaataaatatcatttccaatatacataataaatactataatatgtttatagtttcattgctaaacattaaatattgattatcatattattgattgaatacaaaaataaaataacaaacaaattacacaaacacaacaaatgacacataaaaaaaataacacttttattttataatgtgcattattttaaaaatgggtacagaggaaacttttacctactcctcctttctggttggcaaaactgattatttttgccatacccacctcaatccaaattttcgactgtttttcttatagggaatggcaggcgttacaccttgtttcacacggtaaaggacagccgtccatcaccttcacgtaagatgccaccaaaaacctgcggccttgagccactatcccttacaaagggtattaccgggaggtgggttcggctcaaaaaaactgctagtcgcattttggtgtttttttgacaacctgatatagtcattccttccgtgtcctgtctttcttctgcagatacggcatcatcaatttaggagcaacaaacatgttacgcaccatgctacaggggaaactacatcgagtaaaagtgacgcaggccgatcttcattacgaaggttcctgtgccatcgatcaaaattttatggatgcagccggcattctggaatatgaagcgattgatatttataacgttgataatggagaacgattctcaacttatgcaattgccgctgaacgtggttccagaatcatctccgtaaacggtgccgcagcacgtcgggcggcggtaggcgataagctgattatttgttcatatgtccaaattgctgatgagctgactaaatttcacaaacccaaagtagcttattttgacggtgataatgtgatgagccggctggcaaaagcggttcccgttcaggttgcataaccgttcccaccaacgaccgactcactattgcgccactccgccgttgtttacggcggagcgttatatttacaaattcttgtttttaggttctcagccctcgccctgactcgatcaaataccaagccaacagataaaaaacaaagataaatataccgagcatacctaacgtcatcgtcagagaaacatcagtaataccaagaaaaccgtagcggaagccgctgatcatgtaaacgatcgggttgagtttggatactagctgccagaattcaggcagcagggtcagggaatagaatacaccgcccaaataagtcaaaggcgtcagaacaaaagtcggaatgatgctgatgtcatcgaacgtttttgcataaatggcattcaataaccctgccagagaaaacactatggatgttgtcagcaaggtgatcaccaccatactccatgagtggatctgcacaggtacgaataattgggaaaccagtgtcaccaaaataccaacgcatactccacgggcaaccccaccgccaacaaatccagcaataatgatatgggttggcacgggagcgaccagcacttcttcaatgctcccctgaaatttagcaccaaagaaggaggaggaaacgttagcatatgagttggtgatcacagacatcataatcagccctggaacaatgaactgcatgtaactgaatccacccatctcaccaatacgggaaccaaccagattgccgaatatgacgaaatagagggacatcgtgatcaccggaggcaataaggtttgtacccaaatacgaccaaagcgggttatttctttcatccagagggtttttagcgctacccagtacagttgaatcattgattcgctccttgattattattggtcaacccaacaaacagctcttccagacgattcgctttgttgcgcatactgctgatttgaataccctgcatgctcagttgggaaaacagatcattcaatccctgaccacgcttgacatccacttccagcgttaccgcatcgaccagacgataatcataaccctcaacgacaggcatcacacctctgggcgttaagtcgagcaaaaacgtttcgcgttctaattggctgagtagatctttcatactggtattttccaccagttcgccatattgaataatgccgatattacggcaaagcatttcagcctcttccagatagtgagtagtcaagatgatggtggttccctgcgcattcaaagccttcagaaactcccacatggagcgtctcagttcaatatcgacccccgccgtcggctcatcaaggatcagcaacttcggctggtgcatcagagcacggacaatcatcaggcggcgcttcattcctcctgacagccgattcgcccgttcgttacgtttttcccatagatccagttgggacagataggtttctgctctgctatacgctacattgcggggtacgccgtaatatcccgcctgattcagtacaatctgaatcacagtttcaaatgggttgaaattaaactcctgcggaacaagccccagttgccgtttagcattgacgagatccgtgtcaatatcgtaaccaaacactttgatcttaccgctgctcttattgactaaagaactaatgataccaatagtagtcgatttccctgcaccattcggtcccaacagggcgtagaaatcgccttcttcgacacgtaaatcaatcccacgcaacgccttcacaccacctgcataggttttcgtaagctgagtcaattccaatgcataagccataagtaaaaacacctttattctttgctatctttgagtgcaagatgcaaattatgccattattttttctgcctttctttgcaacgatagggatcaaataaaaaaacattgttcaattaaatattaaattctcaattaatgttgtatatgatcctatctcaaaaacgttgccaggctattagttatgatgagaaaaattgaagaattgtttgccaggaacaagcagtggtcgcaatccgtaaacgaagaaaatcctcacttcttcaaggaattgtcaaaagtacaaaaaccccattttctgtggataggttgttctgatagccgagtgcctgctgaaaaactgattgacgctgcacccggcgatctttttgttcaccgaaacgtcgctaatctggttatccatactgatttaaactgcttatctgtagttcaatacgccgttgatgtgttacaggttgagcacataatcatctgtggtcactacggctgcggaggcatagaagcggcggtagatggcactgaattaggcttaatcaataactggctgctccacattcgggacttgtggtacaaacacagctccatgctcggcgagttgccgcctaacgatcgactgaatcgtttatgtgagttgaacgtcattgagcaggtttataatctcggccactccaccattatgcaagcagcatggaaacgtgggcagaaagtcatgatccacggttgggtctatggcttgaaagatggcgaactgcatgatttagatgttaccgctgacagccgtgaaaaactggaactcaattaccgtcaggccatttccaagctggcacataagaaataacagatccacataaaaacaaatggcagccttgtgctgccatttactcacagttccctatacggtttaccgcaggaatttactcttccagcagagtaacatgcccaatgtaaggcaagtggcggtaatgctgagcataatcaatgccataaccgaccacgaatttgtcttcaatcgaatagccaatccactcaaccggcacatcgacttcacggcgggagggtttattcagtaacgtacaaatcgccagagaattcggttcacggagcgcaaaaatctcacggatcttattcagtgtattgcctgagtcgataatatcttcaacgatcaacacatctttgccacgaatatcttcatccaaatccttaaggattttcacatcgcgggtagagttcatctcattgccataactggacgcagtcataaaatccacttcgtggggaacctgaacttcacggcacaggtctgccatgaagataaatgaccccctcaacaaaccaaccagcaccagttcacggtcgctattgcgatagtgttctgtaatctgttgccccaattcagcaatacgttgtttaatctcttgttcggagatcatcacttctacaatatgttttggtttactcataactatatatttttaaataaaaattaaaataaaatcatgtgtctttttacgaaaagtgatacaccgattgatataccgtcaccacacaaagacgcacacacaaaaaacatgagaacaaaatattttgcaaagcatatcagaattcaccacctacagtaaaagaagggttgaatctatgactacctacaaacatcgttgccagtgagtagatccgtacacaaaacgttttagctttgtgataggaggttgcgacgcatttcgtcggatggtattaaagattacggtgacggataaccaattgtgctacctcaccaaaataaataacgccatgaataattaaattttgtggctattatgtaagaatagctggcaactggctgaatgaatgggagaaagtacccccgatgacattcaatatttgctggaacgcacatgggatgccggcgtgccctgtcactgggtgagcgtcgtctaagagtctggctggagtcccgataccctgacttccgctgactggaaaacacggtcagcggaaaggacaacaatcgaacaggttttacattggtcagactggcgacgacggcatcaatatcgggcacaacaatgtcactgtcgtcgccgggaagatcattggcttacagagcaattacggctgtagtactaattaggtatgataaagaatcaacggaagtttataaccatttagctacaccgccgtggcgagaacatgcacctttatgggttttgctcttactataggttccgtctttacaaagagcgctattagccccttgctttgtgcttccagcttttgatttattactgttgtttttctgtgacgctttttggttttttgatcctttggtgactttcttttctaatgaactaacgttgtctttagccgttttgacattatgttctaccgcggtggctgtttttgaagcgtgttcgagtgatactgccggcactgcaagtgctgtactcgaaaacaacaccagtaatgccgcaactgataactttaagcttttcatcatatatgtcctctgattagagtgccttaacccgaaaccaactcttgcagtttggagtatagctttgaatgatttcattacaaatatagcatagggaatgcttatattttgacttatgtctgttttatgtttttttataacaaattattgtagtttgtagacattacggatatagaaatcatgacattttttaaatgattaaggctttatgatgatgagttgcttacttggcataagataataaaaattgctgtatctgaatcaatggcacttcagacaggggcatggttgcactgagcggcacagatggcgttatttaaccactcaccctatccccaaaatcgccgcctcaggcgcttccccattaactaacttcgccgttgcaccatcataataaatccgtccatccacaataagtaaagaacgcggtgctattttggcggcatcatcaagattatgggataccatcattaaagtgagctggcgcgtatcacaaacttgtgtcagtaactccaacatctcattgcgtaaagcaggatcaagtgctgaaaatggttcatcgagcaataatataggttgctggcgtaccagacagcgtgccagtgctgcgcgttggcgctggccgccggaaagctgagctggcaggcggttaagataatcttgcagtgatacttgggcagcaatttgctgtagcgtcttttgttgctcacccgttagccgtaagccgggatgtaaccccagaccgatattttgttcaatggttaagtgggaaaacagattattttcctgaaacaacattgagactggccgtttggaaggcgaggtatgggcatgattttcatcatttaaccagatatcgccactttctgcggattggaaccccgccattaaacttaacagcgtacttttacccgctccgctggggccgaggattgcaatacgttcgcctgcctcaatattgacatggaaatgcatggcaaggtgctcgtaggtataaatgacattttcgagtttaatcatggcgtcggcccggtaagcgttcaagcacactgaacaagataaaacagagaagcagcagcaggaatgcggtgactgcaccgtcttgactgcgatatgccccgatttgctgataaagatagaaaggcaaggtgcggaaatcttcgttgccaaataacgcgacaacgccaaaatccccaatcgataaaacacaggaaaaagccagtgcttgagccaaaggaattttcagtgccttaagttcaatccagcgtagtcggtgaatcccttgaatattaagagaacggcacaggggattgtaacgttccgccaaatcacgcattgggttatccaatactttcagagcatatgggatcgccattaatccattggtcaagataactaatccgtaaggagaatgtggcaagccaacggtggtgttcagcagaataaaaaagcctgtcgcaagaacaatacccggcatggcaaggattaataaaccgctggtttccattgcctgtccccagcggggagagtggcgcaagcgtaattcacggctactccataacagcattatagtcagcatgacacacagcaaacctgctcccagagcgataaccgctgaagtcgtaaaggcttgccacaaagctggctggcgcagaacattaagtacagcaccgttcagaccgtccacaatgactgccagtaatggtgggatcaaaagtagtagtgcaataataatgaatagcccatcacagcctttttgcagccatgaatcctgcggattccgccatttttgctggtgaccgtaaccgacaacgagtgtgcctttgagtttttggctgaccaacaccagaccaagacagcaaaatagttggataagcgcaagcagggcagcatggccgagatcgtagtcatagttgagtgcctgataaatggctagctctatggtagttgctgcggggccacctcccagtgcgagcacggtggcaaaactggcaaagcacagcatgaatatcagtgcaccggtcggcagaatttggcggcgcagataaggccattctacaaaacgaaaatgttgccactcattcatgccaagctgcgctgcgagttgccgctgctctaccgcaatattttccagcgattggagcagtaaccggactgccattggcatattgaaaaaaatatgcgccagtagaatcccttgcagcccgtaaggcgtaaaacggtattcaatacccatccattgggaaatatttgccaaccagccgactcggccgtaaacggtcagtatgccaaagagggcaaccaaaacagggagtaccaacgtcatggcgcataagcgcagaaacagcatcctgccgggaaaacgacggcgataaagcgctctggcgaggaaaatcgctggcgtcaccgataacacggcagacagaaaagcctgccaaaaagtgaatcgaatgacatgccacaagtaactgtcacttaagaacccttgccagtggttttccggcgcattgaaccaaagcgctccaaatgctgacagagcaaccacaagtaacaggccggaggcaatcacccccggcaataaccaacccgcaattaacggcttacggcgctttgccatgtacggatccactgattacgatgtttggccacatcatctgcgctgaattgcagtggttttgcgggcacagaaagctgcttgaaaacctcaggcagaggaatgtcgataaccggatacatccagttagtcgtcggaattgcttgctggaaggcaggtgaaatcatgaactgcatgaatttctgcgccagtttaggttgcttacttgagactaactgagcggcgacttcaatttgcaggtaatggccttcgctgaatatggcagccgcatagttatcttttttctctgacagaatgtgataggccggtgatgtggtatagctgagtaccatatctccttcacctttcaggaacaatccataggcttcactccagcctttggtgacagtcagcgtttttttggcaactttcggccattcctgtaccgctttatcgccataaatatcctgcatccagagtaacagccccaggccaggggtgctggtgcgcggatcttgataaataatcttccagttctggttactgttgattaattcatccatacttttgggagggtgaggtaaggtgttcttgttgtaaacaaaggcaaagtaaccgtaatcgtaaggaatgaaggttttgctgttccatgtgacaggcaatttcagttttgaggtatcaatatggcttggtgtaaacaaccctgtctgctgggcagcctgaatcaagttgttatccagccctaacacaatgtctgctgatgtctttttgccttccattctcacgcggttcagcagggatactccatcttccagggcgacgagtttcagttcacagttacactctgcttcaaaggcttttttaatggcaggtcccggcccccattcagaagcaaatgaatcataagtgtaaactgtcagtgtaggcttagtctgtgccgtttgagcaaagacacatgcagaaatcaatagcgtactgattgtgataaatctggaaaataagtttttaaacactttgctctcctgttgtgattagcagatagataaaggatttgagaaagtgctaaatggaaaatatttttatatcaatgattagcgtctcaaagtcctacgtcggtactagccggatcaggttcgacgggtttttctcagcaatacggttttacaacagcagcaccccgttgagatggcggtattgtagagacttccgctacggctgcaaagtccaatgatataggtttaccgcttgggatgagtgtgaaacaattagctatcttttcaaatttgttttatcgagaggtagtctggtgattgatgatgatggctaccgcccgaatgtaggaatcgtaatttgtaatcgccaagggcaggtcctttgggctcgccgttatgggcagcattcctggcagtttcctcaggggggtatcaatccaggggaatcaccagaacaagcgatgtatcgcgagttgttcgaagaagttggtttaaatcgcaaagatgtacgggttctcacatctacccgtagctggctgcgttacaaattacccaagcgtttggtgcgttgggatacaaagcccgtttgtattgggcagaagcagcgttggtttttattacagttgctttgtaatgaagccgatattaatgtgcagcgcagcaacgcacccgagtttgatggttggcgttgggtcagttattggtatcctgtcaggcaggtggtttcttttaaacgggatgtttatcgccgcgtaatgaaagaattctcttctattgtgatgccagtgcaggaatccgctccacagctacattcaccttatttacatcgtcgcagaagaagttaggtaactgttatgctcatgcgcttacgggaaattgtcgaaaaggttgccatggcagctaatttgtctgaagcgcttgaactattggttaatgaaacctgtctggcaatgagcacggatgtctgttctatctatctggcagatcatcagcggcattgctattacttgatggctacccgaggcttaaagaagccagaggaacgagcgatcagcctggcctttgatgaaggtgtcgttggtgtagtcgggcgtttatctgaattaatcaacctcgccgatgtgcgagatcaccccagttttaaatatatcccccaagtaaaagaagaaggtctgcgggcttttttgggcgtaccgattgtttatcgtcgtcagttgcaaggtgtactggttgttcaacaaaatgaacggcggctattcgatgaaagtgaagagtcttttatggtcacgctggccatgcaattggcggttattctcgctcaggcacaaacaaaagggctatttggtcagtatcgtcagacacgcattaaggcgcttgccatttccagtggtatcgtcatggctcagggttggcaagatggttctcagccatcacttgaacaagtttttgaagcgtccacgctggaatatcaggcagaacgttctcggctgaccgaagcccttgagcaggcaaccgccgaatgtcgccgtatcagtaagcgttttacctccagctcacagaaagaaagtgccgctatttttgacctctattctcatttgctgaatgatcccaaactcaagcaggatctgtttttttccgtcgataacgggtttgtggcggagtgggcagttaaaagcgttgtcgaaaaatatgccgaacagtttgccagcttgcaagatccctatatgcgggagagagcttctgatttgcgggcgcttgggcagcgggtattgttccatctggatggttctttcacaggtgatagcgaatggccagagcgctttattctggttgccgatgaactcagtgccaatttactggctgaaatgccgcaggaacaactggctggtgtgattgtacgggatggtgcaactcactctcattccgcaatactggttcgggcgatgggaataccggctatcatgggagccgatatccagcctgaattactgcataatcggatgctaatccttgacggttatcgcggcgagttttttgttgaaccagaaccactgattattcaggaataccgacagattattgaagaagagcaggttctcagcgaattagccgagggggagctgaaacaaaaagcacaactcaaaaatggtgaaagagtgctggtgcagctcaacgcaggattaagcttaaaatacgagcaacagataggtggtagtattgatggtataggcctgtatcgtactgaaatcccttttatgctgcaccgtggttttccatcagaagatgagcagaaaaaccgttatcaagagatgttggcgcttctcccagataaaccggtggtactacgaacattggatattggtgccgataaacaactgccttatatgcccatcagtgaagaaaacccctgtcttggctggcgaggaattcgtatcacgctggatcagccggaaatattcctgattcagctcagagcgatgttgaaagccaatgtgctgattggtaacctgaaaatattgctgccgatgatcaccagtatcgaagaaattgatgaagccagaaagttgatcgatagggcgaaagctgaagttgaacagacaatcggcagtacgattaccatgccccagattggcattatggttgaagtaccctccaccattttcttgttgccgcagttgaagaaacggattaattttatctctattggcacgaatgacttaacccagtacctgcttgcagtggatcgcaataatacacacgttgccgctttgtatgacaatttgcaccctgcggtcattaaggccttgaaactggcttttgatgagagccagcgtgttggtcttcccgtgagtatatgtggagaaatggcgggtttgccgatgggagcgttaatcttaattggccttggttaccgtagcctgagcatgagtggccgaagcgttccacgcataaaatatttactgcgtcatttggataccaacgatcttgagctgcttatcaaagaaatattgaaagcagaaaccagccggcaggtgaaagccctgtctactgagtttatggaggccaatggtctcggtggtttggtgcggggggggatttagcttatcttgcgtaaatactgctcccgtctgaagcaggacggctcttaatccattttactgcctatgctattatttgcgattatttgtcttaagacatacacataatattcattcacataacattacttttagtggggaacgatgagcactagctatctggcatttcctaatattgaccctgtcatattctcaatcgggcctgtgtccctccactggtacggttttatgtatctggttggttttgtttttgccatgtggctggcaaatcgacgtgcagcaaaaccaaacagtggctggaataaaaatgaagtagagagcttgctttatacagggtttgtcggggtgttcgtcggtggacgcctcggctatgttctgttctacaatctcccaatgttccttgataatccgttgtatctgttcaaggtctgggatggaggcatgtctttccacggtggtctggtcggggttatatgtgccatgttgtggttcgcccgccgtactaaacgtcactttctacaggtttctgatttcgtcgctccattggttccctttggtttggggatgggacgtatcggtaactttatcaatggtgaattgtgggggcgtgttacgcttgatacaccgtgggcgatcttgttcccgagttctcgcagcgaagatatcgcgctcgcgacaaccgatccttctctatggccgattctggaaaagtatggtgtcctgcctcgccatccatcacaactgtatgaaatggtgctggaagggatagtgctgtttatcattcttaatttatttatccgtaaaccccgtccgatgggaagtatttcaggcctgttcctgattggttacggagccttccgcatcatcgtcgaatttttccgccaacctgatgcacagctcgggttgtttgaggggatcagtatggggcagatcctttccattccaatgattttagtaggaattttaatgataatctgggcttataaatgccagcgcaataacaagatacaagaggcaaaatgaaacagtatctggatttaatgaaaaaagtgcttgaagacggcacggcaaaagatgaccgtacaggtacgggaacactctcgatatttggtcatcagatgcgtttcaatttgcaagatggtttcccattggtgacaaccaaacgctgtcatattcgctccatcatccatgaactactgtggttcctgaatggtgataccaatacccaatatctgcgtgataataatgtgactatctgggatgaatgggcggacgaaaatggcgatctggggccagtttatggcaaacaatggcgtgcctggagctctgcggatggccgtcaaatcgatcaattggcaaaagtccttgaacagttgaaaagtgaccctgattcgcgtcggattattgtttctgcatggaacgtcggggagctggataaaatggcattagcgccctgccatgcttttttccagttctacgtagcggaggggaaactgtcctgccagctttaccagcgttcctgtgacgtctttctagggttgccattcaacattgcaagttatgctttactggttcatatgctggctcagcaatgtgatctggaagtgggcgattttgtctggacaggcggtgatacccatctttacagcaaccacttagaacagaccaaacttcagttgagtcgtgaaccacgaacgttacctaagttgatcatcaaacgcaagccagcgtcattatttgattatcggttcgaagactttgagattgtggattatgatccgcatccgggtattaaagccccagtcgcgatttaaacctatactcaactcaaaagatgaagggtatctaccaaattgttaaagagcgggttcagcctgctctttttacatttatcggcggttgttctcaatataaaaaatagcgacttactatttctgcgtaccgctccgcaaataaaatgtatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtatagaaaagcaatggatcgtgttaataaagcagtttcagtccaaaccactccaaattacgataatttcaataactgctgcttatctaatgcagctctctactcaaccaaaactaaaacccgccgtcgtctggaatcaggcgaggttactgctagagtgtgatattttctttattaaaataatcttgaattgaaaaaattaatccgcattaaataaaaggtaatcatgaaaacttttatctttgccgcaatagagcgagctaataccgatcaacagctccctattaaaattaaatgtgttgctgaaagttatcaccaagcaaaagcgatgctatctggtgaatatatcacagcgtgggctggtcaaattattaatcacggaaattaaacatgaacaataaactacaagcagccgtcgagattgcagaagaaattgaagcctcaatatttcccgtagtgactgcaattcaaaatgaagccgaaccggatacttatttaatgtgtcgtggtgtacatcgtcaaacgtgtgatttagcccaacggttaagggatattaataaggaatatattatggaaggtgtaattgatacatgttctaatttagatattgaactagagccagctaaaaatgcaatcgaaaaattaagatcactattgagcacaatgattgatgtccgtggagatgatgacgacgcaaatttacttcttattgcgatagatttagcctttgatgccggtaaagaaatagcacgagtcagaggagtggaatactcatgaatgacatccgaaaacacatttgcgttaatgaagaccgtttatctgaaatgaaagaagatgatttaaattatctaatctcatcaagtgaagatgtcatattcgcaatgacaaatggattattatccattggcaacttagcaagtgccgcagttcatagtgaagaatattcccaagatgatgccatgactgatctagaaagaatagcgcatctgttaactgtagtacctcttattatagaagcggaacacgaaaacaatattagtgcaggaattgagttaagagaaaggcaagcaattaaaaaagaaaagcaattaattcaattaataaggaattaccatgaaaatacttaaatccattgaaactgcaaccatccaagatatcaaaattgaactgcgtgaagtctatgtcgttcgtggtgctagcaagacttatctgagcgagaaaggtgcactgaataaactggcttatgttcgggcgcagaagcaattcaataaggaagacaggccaagtaacttccctgcccaagaggtcattcaggaagacggcacttctgcattacgcaagggaaagatgcgccctgagtttatggaacgacatgctcaagtactggaagaactgaaagctgatgttagacaggtaagagaaattgctcgacttaaaaaggaatgcaagaaagcaaaagagaaactcctaacagtcttggatgatttagaaaacgcagaaaataaatacaaaaattcaaaataataaaaaataaacaagttttaattacagcgccattgctggggattcgtttacgctaaattcaggaaatagaaaatgacaaaattaacgttgcttgaaagaaagcgaaaggcatttatacatgccaaattggacacattgcaaaagaagcacagttctcactctgtaatagtcaaagtggcagaaattaattaccgactggatttagacgaggagatattaaccatagcgttaattcgtttctttgaactcgacgcattggcatcaaaaaataaacaaaaggctgaacaacttcttatatcgacatacaacagcttttataccaagttcggaaatttaaccgcagaaggcaatgagtttatgaatgaaattctaaaactgattgcaaagaaaacggaacccataaatggagataacaatgaaaaatgaaacttatttagattttgctgaaacagccatccagaaagagaaagaagaaaagtacgaccttgcagctttatattggggaaaagccagaagtgtagccaccagctttaatactcaagcatggtctgaatatcgtcaggagcataacgaaaaaaggtattcattgcataacagctatagcgaagcaataagagatcaaaaagaaagtagaaaaatagcggcaataaacaaacgaacggcggaggtattggaaagtcatctcgaaaatcacgctgaaacaaataagtggaaacaaaagcttcaacaggcggcgaataatgattgaatatgaacaggcaacagaattagcgcagagtttagaactaaaaggcttattccgccgtgctgctgataaatggggtgaggcactttcattatcccgtaataaaaagcaagaacaggaatgcatcaagaataatttgcgctgtgttcgagaagcaaaaataactattagggaggggttgtaatgacaaagcgaagaaataaaacccaacaaggttatgcgggaatgaccattcctcaaggactcagcttggaacgcaacgaggttgctgattataccaatgtatgtaagcacctctctaactttaaaagaatcggcgatcaaatcctgatgccattaaaccgaaaacagagacggttagccaaaaaattaaatattgaaattaccgaggtggaacaatgatcaataagactgaattaatcactattaataaaactcaaatgcctgtcgtggaatatcaaggacaacgggttgtgacgttctccatgattgatcaggttcatgcacggccagaaggaactgcaaaagctgcctttaatagaaacaatcaccgttttgtacaaggcgtggattatcaagttttaagtcaggacgatatacgtaccgacctccctgacggcttattttctaagttcgcccccagcgggattgtgctttttgagtctggttatctgatgttaaccaagccgttcaatgatgatgttgcatggcaggttcagcgtgaactggttagcagttattttcgcaagccacaaacagtactgagcgaacttgaaatgattgccaggatcgccagccatacagcccaacaacaacgtcagattaaccacattggcgaacaagttgagcaagcccatgaagctattgagcaaatcaaacgcggaaccattccagcaggttggattgggttctccctggctgcgaccgaatccgggctaaccaatcccaaatgccgcaccttggctgaacagtataacgtacctatcgacaccgtcaccatcatgacaccagatggacagcctcgccctatgaaagttgtattcaaagaagacttcatgagcgcgttccgtctgatgatgggcgaagcagaaaaacgcggcactcgctggtcacatcccaaaatggggatctttcaggttatcggatgggaggacaagcaatgattattaattcatgcctgttacgtgcggctttggtttgtgtcgctaaaaacgaccctcgttattatctgtgtggagtgcatataacccctaagtatctggagtcatcaaatggttttgtggctttccggttagagcacggcatcaacacacgccgtaaagccattatccagttccacggaaagatccccaaaaaggctgacactacagaactgcatttcaccaaagaaccttatgctgtacacagggatattgccggggtaagggtgggatttacagccttatccatgctggatggtcgctttcctgatttagaccgggttatcccaaagaaagtggaaaatgttattcctcaatttcaggctgagttcctgacctatcctcaaaaaatgttcggggatgattcgaggttcatcgctgtttccatgcatccatccggcatgactgagggatgtgtaatgaagttcagcgacaacattaatcaacgttatggcaaccctcagcttgttgtcatgccctgccggatataggaggttcagatgataacgaaaaactttcgccttaacgcactggcaaacgcttacgcagccgccatctatcacgatgtaacagcccgtaacggtggcgatcacttcgcgatgcgagtcggcaaaacagaaatcagtgtcgcgattgtcgatggcataaaaggtattcgtgagttagtcgatagttacgcattggaagcactacagcagaattacccggcatgggaagtgatagccataaacctgatggaaaaatgcgtaatcaatgactgtctgacaggccacgggcgtaaaatatggcaaagcatgatcaatgacatggggacatgctggcagctaagggggcgtttcaatgaaaatcgaatatcaggacaagggcagcacagcgcaaatagtcattgtcagtttcattacagaacgccgaaaacacaaccgttgtgttgatgctgccctgttagctacacctgttcgggcttcttcttccggtgtatttttcagaagaacagttatcacaggcaaagccaatcacatgatgcgcgcttacaaaatcctttgcaaggaggcggacagtgacagataagcagcgccagatggcagacattgacaatgtgcttgttaaggccacgttccacatcgacgacggcagggatcatacggatcagattatccaccgcctcagacagaacttttacattcatgagggcgattgccctcctctgccacccgcgccaaaagtggcagaagtgaaattaacaccggtgaagaaagcgggtaataagcgaggtaaagaataatgaaaggcaaattacttcctgtggttgttggtgttgaaattccccttgatgaattcgggcgctacaacctgaacacattacataaggcncagtgagagggtgaagataaaagcaccgggtaacgaggtcgaattcgcataaaga

SEQ ID NO: 14979 - DNA, 165580 bp, Xenorhabdus bovienii
  unsure (1)..(165580): unsure at all n locations
  Genomic contig Name=Xb4151_4152.C438
atgtcgcaggaagcttttgccgataagtgcggattggatcgcacttatatcagcggcattgaacgtggaatcagaaatcctactttagaaattatttatgtcattgctaatggcttacagattgaactgaatgaattgtttaatcttgaaacaagattacctccgaattaaagcccattatcaattttccattccgtttttatcgatgatttgtgtaatcgggtgagcgaatgcgctttgatgaaaaataagcaggaaatgagatgatgttactgatccctgaactcgcgattggtgtgtatcttcttgttcctgatcttcttttgaccattgaagctgacaagcagcttcaatggtattccaaggatatattgaacgctgctgttaatatcagtactctgtttcgccaatatttttcagggcattaatcaccaattgccagaatttggcttgatccaattttacggcaacttgtgtatggcaatcttttggtggcgggaagcggaaatcagcgacggtcatgcccgttgttaaagttccggccagctcgatattcacgggtactttttgtgttgtcataacggtaggatcgattacataagcgactgcacagggatcatgcaccggaggatagtcaaaatactgcgattcccgatacctctccccataaaactgcaacgcatctaaaacgaattgggcaggacgggttttgatcttggagatagcgtcaatgatatcaggcgttgcctgagcttgatgcgtcagatccagccccaccatcgtcaggggccatttttcattaaaaacaatatgtgctgcttcaggatcgatcatgatgttaaattcagcgacagcactccagttgccagtatggtagccacctcccatcaacacgacttcttttacgcgttcaacaatatgtggagacttacgggcggcaagggcaatatttgtcaaacctgccgttggaaccaaggtaacgctcttggggggattttccatgatgatgtcgataatcaaatcaacagcgtgacgggcatccagccttaatgctggttcaggcaaaataacgccatccaggccggtttcaccatgaatttctggggcagtttggatatctctgaccaatggtctgtgacatcctgcggcaaaaggaacattgtgaatattagcgatgcgggcaattgaaagggcatttcgggtgactttattcaaggtttggttgccaacaactgtagtcaccgccagtagttcaatgtcaggatttccatgagcaagcagtaacgcaatggcatcatcatgcccgggatcgcaatcaaggataattttcttggggagcatcttcattccttttagtgataactaaacacaaatgtagatgttaagaataattcaccttggataaagattcccctaacactaatcacaaaacgataagataaaaatctaaacttattaataaaatgtttaataattgtgacataattaacatataaataataaatggtttgagcattgtaagtacatatgattcatatgtgtatgctataaaaaacaaacagatagttgctggtgttatcattattaatttattaataaattaaaggtgaatgtatttgttgttattccgcctgaataaacaatgttaaataaatgcgacaaagtgtccctgaagaaacagagtaacaaaattgtcggctgtacatcatcagggaataggcagatgctcacggggtataacatgaataataatcttgattcattaacatactatgctgcaaccaaaaaatatgatcttcgctttcccacactgacagaagacttggatgttgatgttgttatcattggtggcgggttttccggtgtgaatacggcactggagctggctgaaaaaggcatcaccaatattgctattttggaaggtcggacgttgggatatggcggaacggggcgcaatggcggtcaagttatggcgggtattggccatgatttggataggattaaacgtcatgtcggtgagaaaggtttagaggctatttttaaaattagcaacatgggtgcaggaattattcgtgaccggatcgctaagtacgatatcaaggcggatttttgtaagggttacggttatctgggatataactcccggcaggagaaaactttacggggctggctgaaagagtttcaggcagcgtgtcccgatgaagagattgaactttatgccggtgctgatgttaaaaaagtcattggttcagatctttatacctgtgcgctgaagcatatgggtgggggacatgttcattcactcaatctgttgctgggggaagccaaggctgcaacggagcagggtgtcagaatttttgaaaatagccaggtggtgaatgtggaatatggcccacgggtcacagttcgcacagcaatggggacggtacgggcaagtaagatactgtgggcgtgcaatgctttcctgaatggtcttgaaccgactatctacaaaaaaacgatcaatacttacgctttccagctaatgacggaagagctgtcagacgatctgattgaaaagatcagcccgattcgtggggcatacagtgatattagtccggtcatcaactactatcgagtcaccaaagagaaccgagtgctgtttggcagtgccacacaatattttgagtatatcccttctgatttaaaagcatggaaccgcaaacgtatgctggatgtcttcccctacctgaaagatgtgaaaattgaattggcatggggcgggccactatcttgtagcgtcaatttattcccacaaattggttctctgccagaacataataatgtgttttatgtacagggttattcaggatttggtgtaacgccgagtcacattgtctgcaaaatcttggcagaagggatgagtgaaggctctgaacgttactcactgatgagttcgattcctcatctcaatgttgtgggcaaagacaaattaaggaacctgctcctttctgccggtaaaacctggcaccaagcctcagggtattggaaaggccgtcgctagtttgatcacttttttgacgtcttttctttttttctttttttgaataataaattctgaaaggtaaaagtcatgataaagccattattgttagatcaagcacttcctgaattaatgccaattggcagtgttactcatcttggttctattgtgttagagggagatccccaggcaagtggtgcaatgacccacggagagcctacggataatctgacttgtggtatttttgcctgcaccaagggtaaatttaaaatgatttatccctttgatgaaatggcgacggttcatgaaggctcggtgaaactgaccaatgtcaaaacgggggctacggttgaataccataagggcgactcttggtttgcggcgaaaggcactgaaattttgtgggaaatcaccactgaacgctttgttaaacattacatggcttgtgtgaacgcttaaatatcgggctaaccagagaggaaacatgatgagtgaaataaccttactaaagcccgttacggattttctgcaacgtcctcatggtaattatatcaatgggttatctcttcctggtcagggaaacagaaccttttctgttgttaaccccgcttctgatgaaatgatcgctaaagttaatcaaggagaggaagctgagataaatttggcaatggaagcagcctcgaaggcttttcatggttcatgggcacagacatcgcctatggagcggggtaagtgcctgaaccggctggctgatttattgcaaaaacacggtgaagagttagcccaactggaaagtttgtgttcaggtaaaccaatccaacttgctcgaatgttagatgtgggcgcttcggctgattacctgcgttattttgctggttggtcgagcaaaattagtggtgagacattgaatgtttcattgccatcactcaaaggggagaaatacaccgcctttacccgccgtgagccaattggcgtggtggttggcattattccgtggaatttttccattatgattgccatctggaaattgggagcggcactggcctgtggctgtactttagtactgaagcccagtgagtatacccctttgacgatgcttcgtgtggcagaattggcgaaagaagccgggatacctgatggcgtgattaatgttgtcaatggttctggcgctagagttgggtcagccctgctcgctcatccccattgtgccaaagtcacttttactggctcagtcccgactggcacgattatcggtaagtcggcgatagagtacggcttgtctcgtgcgacgctggaactcggaggcaagaatgctgctgctttcctgtctgatatgtcagttgaaaagattgttgagggtgtgctggaagccggttatttgaatcaggggcaaatctgtgcggcagcggaacgtttctatatcccatctgttcacatggatgcggtcttaaaattactttctgaacgtttgtcagcgatgaaaatcggctctcctcttgatgaatcaaccgaaatggggcctttggcaaacaaagagcattacgaaaaaatcctgtccctgtttgataaagcgcgtcaggatggcagtgaaatcgtatatggtggtcatgcactggaaggtgcaggtttttttgtcaccccaacgattatccgggccaagagtgctgaagacacattaatgcaagaagaaaccttcgggccgataggcactttcctcagctatgatgatgaagaagagttaattgtcatgatgaacgcgacgccatttggtctgtctgccagtttatggacgaatgatctcagtaaggcgatgcgtatgatcccccggattcaagtaggtactttgtggattaatatgcatacgtttctggatccagcgttgccttttggtggcgtgaagtcgtcgggcattggacgggagtttggtagtgcatttattgagcattacaccgaactgaaatcggttatggttcgttattaatcacgtattattacagcttattttcgtgatttattttcagcttgtgattaagccgctatcatatatgatattgggaatcattatcatttgattggcggtttattatgatcagcgcaaagcggggtttaaaactggctttttggcagagtatcaccgggttatgggggagtttattatttagtctgatggcgtcaatactggtaataaccggggcagggatcgagcaatttaagataagtattctgggtgctatgctttcgactcttgtgctgctgctgcatcgcgatgcacgccatttcctcttaattcctgcgggtattgctgtgatgtgcagcttatttgctggtttgcgctatgcggagtatttttgagatagcgtgaattcttaaaaagattggctgataatgggatgaaataaagaaatgaatacagggagcagataaatattaacagtggtgcgaagggggggacttgaacccccacgtccgtacggacactaacacctgaagctagcgcgtctaccaattccgccaccctcgcaggtactgccatttatctaatttgtttaaccgacgactgtctgatttggtgcgaagggggggacttgaacccccacgtccgtaagaacactaacacctgaagctagcgcgtctaccaattccgccaccctcgcaaattcagacactatcaatcaaacagatagcatggaggcgcattctagagattttacggctaacgtcaatcattatttattgagaaagagcatgaatggtgcaaaaaacggcacactggtgttatgggtgaggcagatacacaagaattgcctgcccgttaaaactgagcaggcaagaaacggcttgcttattaccttttggttgcttggtagaccttgaatttacctgtctgcgcgataagcttatggttaccaaaggtactatccagcagagcgggataaggtaggaaagcgttcgctacgatccgcaatttaccgccagatttcagatagtttggcgccatgcggatcaggtcgtcagccgcggctaaattggtttttaaaccatcgtggaatgggggattggaaatgatccagtcgaatttttcctcaatggcggaatacacattgctggtgataacattgccttccagtttattggctttcagtgtggccttgctggatattgtggctgcggcattgacatcactcagtgtcagtgtcaattcagggtttttcttgcccagaaccgctgccaatacgcctgctccacaagcgatatccagcagactaccagaaacagggccatcaaaagtagaaagcaacaaacgactgccgacatctagatcatcttgactgaatacgccaggcagtgtgttgacgatgacatcacccactggatagctgttccaccaattattttgatcaaattgaacctgattttccagttggccataaaagaggctacaacggcgggcagtgtccactttctggaaagtcacaatgccttccattaatttatcaacactgcgtacaccactgcgattctctccgaccacaaaaacaccggttccgggcggcagaatggaaaacaggctgcgtaactggaagcgcgcttcatgtttgctttttggccagtaataaatcaatgtatcacagcctttgacaaatgtgctgtccgcgacgaggccaaaggaggcattgtcacccagttgacggatcagggattgccagtggtgatattggttagtatgtactcgcacacttccggcttcgatttccgttgccagattgtcttgaatatcaccggcaattagcaggtgacgagtgagaaactgttcatgatggcgcaggataacttcgctggccggggttaatactgacatctatgtataagctccttataaatctttatccaagtataaacatcggggggcaaaattgtgatgccatgctgattggcgcagagataagccctctgatagtatattacctgttattttttatggcagatggaataaaacacgatgacgaagcgtgacagattactcgcccaattggggatcacccagtgggttgtgcgcagcccgaaggccttgcagggtgaattgtctgtcctcatccctgactcaactcgtctgttgatcattacccatgatcatattgatttaagtcattcattgtttgctgatatttttacagccatgaggattgatgtctcatcggtttattgcatcacgacaaaagatgttgagctgctttcggaatcaatccattgtccatgctggctgttgggggttgatattaccttatcaacacaagggatttctttgagaagcccagcattaaatgacttatcccttgacgggaatgcaaaacgctctttttggcaacaaatttaccattatgaagaatatttctctattaattcccactgatcttcccgcagcatttcaaatagaacagttcagtcatgcattcccgtggagtgaaaaaaccttttactccaaccagggagagcgttatctgaattataaaatcacgctgaatgaccagattatcggcttcgcaatcatacagtgtgttgtggatgaggccacgttatttaatatcgtcatccaccctgagcatcaatcgcaggggtatggaagagcgttgctgactcacctgatcaatgtgctgccggaaaagcagattaatacgctatggcttgaagtacgaagttcaaatgcatcagcgattggtttgtatgaagatctgggtttcaacgaagtttctatccgtaagaattattacccaacggcgacgggaaaggaagatgccattattatggctttgcccctgttttctggttgatttatgaacttatctgattcattgtttgctttgtgttgtcagaaaatatacgacttttcctgtctggccgaggagtctgtcactcctgaagtcgttgaacgagttcgccacgccatgagtgaaaaatatgatagtactcagccagacaatcattgattgtttataaatccaagttcggcgaaaataagccccaatcacgattaacatgacggatttgcaggtgaagggtcgttcggggcgcttccctaatggtatcaatccgcgtatagactagaagatcctaattgatgtcaaattttccattccagcaggaagtcgcgaaacggcgaacctttgcaataatttctcaccccgatgcggggaaaactaccattactgaaaaagtgttactgttcggacaggcgatccagaaagcggggacggtaaaaggccgcggctctaaccagcacgctaaatcagactggatggagatggaaaaacagcgtggtatctccattaccacttctgtgatgcagtttccttatgatgattgtctggttaacttactggatactccgggacacgaagacttctccgaagatacttaccgtactctgacggcggttgactgctgtctgatggtcattgatgccgcaaaaggtgttgaggatcgtacccgtaagctgatggaagtcacccgtctgcgtgacactccaatcctgacattcatgaataaactcgaccgcgatatccgtgatccgatggaagtgatggatgaagtggaaaatgagttgaaaatcgcctgtagcccgattacatggccaatcggctgtggtaaatccttcaagggggtttatcatctttaccttgatgaaatttacctgtatcaatccggtcaagggcataccattcaggaagtccgtgccattaaaggattgaataaccctgagctggatgcggctgttggggaagaattggcggatcaattacgtgaagagctggaactggtcaaaggggcatcacatgagtttgatcaggaagcctttttacagggtgagctaacaccggtgtttttcggtacagcgctgggtaacttcggcgttgaccatatgctggatggccttgtcaaatgggcgccaatgccaatgtctcgtctgactgatgcgcgtgaagtgacagcagaggaagaaaaattcacgggttttgttttcaaaattcaggctaacatggatccgaaacaccgtgaccgcgtggcatttctgcgtgttgtttccggtaaatatgaaaagggtatgaaactgcgtcaagtccgcatcaagaaagacgttgtcatttcagatgcactgaccttcatggcaggagatcgctctcatatcgatcatgcttatgcgggggatattatcggcttacataatcatggcacgatccagattggtgatacctttactcagggagaagaactgaaatttaccggtattcctaactttgcgccagaattgttccgtcgtatccggctgcgtgaccccctgaaacaaaaacaattgctgaaaggtctggttcagttatcggaagagggggcagtacaggtatttcgtcctctggctaataacgatctgatcgttggggcggtgggtgtgcttcagtttgacgtcgttgttgcccgtttgaaaagcgaatataacgttgaagcattgtatgaatccgtcaatgtttccaccgctcgctgggtagagtgcaacgatgcgaagaaagtggaagagttcaagcgcaagaatgaattgaacttggcactcgatggtggtgataacttaacttatattgcaccaacaatggttaatttaaatctaaccagcgaacgttatccagaaatttctttccgtaaaacccgcgaacactaattctttttatagcatagggtcaacaaatcgttgacccttatcagtttgtaatctctttctgtattttttctatataaagaataattatctgttttagtgaaaaaattcgtgatttattgtaaatcctacttcatttatatcataggctgatatattattctgctgctgttcttacccatataacatgacggaaggtgataggatgaaacacataaagtttacacattcactactggctattgttttaggttcagtgctgataagtagtagcgcactagctgcagtaacatttccaactaacacattggaaagtgcaggccaaaaaattgacaattctttgaaacacgcagacgcttatgtgaacgatagtagtattactgcgcaagtaaaagcggatttactgaaaactaaaggattagatagcaatgatatttcagtgaagacagaaaaaggtgttgtttacctttcaggttttgtcaaaaacacatatcaggctaaacaagtagccaaaattgttcataaagtacatggtgtcaagtcagtgaaaagcacattaaaggttaaaaaataatcttaataattgaatgggtggctgccaataggccactcttttttttgttactattttatatccattaggaatttatttatattttctgctctggaattaaagctctacttatcaataaataatataaatataggtcgatttttcggtatttaattaataatatattaaatggagtttttattgtatgctattaataatttataataattatttgaaatttaatttattatacgtttaagattatatttatcaatagtaatgctaggtattttctcactgaaaatataaattcactgatgtaattctaatatttttagagttcattaagttttaaaaaatattttcggaaaattccttattttttctttttattgtcataataaaatggctttctagggaagtactactactcggttaagcacttgtatagcgggtagaatactttcaggtatgtaaagtaccgttcgtaggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgataatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgacccgttcgtacatagcttcgcttcggtattttatatttttactaggttgtcagtaatcagtatcccctaaaacgcctgtaggaaaacgattcttcagggtgatttttactttcctctttttacaataaaacttcaatatctatggtacgctctgtctttcactatttaacgaaaattttacaaacgtattgtttgaacagcaatatactgatagatagtcattattcagattacgctatgacactgacattgattttttaggaggaagtgtggggaaacatattccaataacgttgggtaacatagaacctttagcttataaatcacagatcaagccaggaaaaattgccctggtttgtgaaggtggtggtcagcgggggatttttaccgcaggtgttttggatgaattcctccggcttggctttaatccgtttgaattgttccttggaacttccgcgggtgcccagaatatctctccctacatttgtggtcagcggggttatgcccgcagagtgatcaatcgttacacaaccgcccccactttttttaatccgttgcgttttgtccgtggtgggcatttgatcgatctggattggtatattgatactatatctgaacaattaccattgaataccactgctgcaatgcatcagtttgatgctggccgtgaattctacatgtgtgcctgtcgcgcagataactttgaacctgattactttcaccctgatgaacataattggatggagatcttgaaagcctccagcgctattccggggttttatcgcaatggtgttacccttggtgacacggtttatcaggatggtggcatttgcgatgcgattccggtacaagaagcctatcgccgtggcgcagatacgattgtcgtgatccggacagtgccttcacagctttattataccccgcagtggttcaagcggatggagcgctggctggaagccagtagcctgcaaaaaatggtcaagatgatcaatctccatgctaagagttacagccggacgcagcaatttatcaaaaacccgccggatgatgtgcaggtatttgaaatttatccacctgcgccgttggctacgatggcattgggaagccgaatcagtgcattaaatcaggattaccatttggggcggcgctgtgggcgatactttttggctaccattgggcatacctttgttggtgggaaatttgggttggaaaaacgtaaaggttatggtgtctgtcgcagtggtttaaataatgatgggattaatcataatggcttcaggcgatatagcttgctggacagcataaatcgtccggtaaccgaggtgcaggaagagggtataacaccgctgacaggctctattatattggatgacgtggataaatagatgtttattgatacacattgccattttgattttcctccctttacagggaatgaacaaacgagtctgaaacaagccaggcaagcgggggtggaaaccattatcgtccccacagttagtcaaatgaatttccagcgggttgctgcgctggcatatgactttccctccatctatgccgcgtttggtttgcatccactgtatatcaatgaacatcaaggttctcatttggctgagctggcgcagaaactgaaggcaaacaatcccaaatgtgtggctgtaggagaaatagggcttgatctttatatgccggagccacagtttgagaaacaaaaaagagtgctggaagcacagttagcgttggctaaaaggcacgatttgccggtgatactccactcccgaaaaagccatgatcaactgtccgctatactacgaaaacatgacttaccacgcacaggcgttattcatggctttgctggtagcctgtctcaggcacaggcttttattcgtttgggattttatattggtgtcgggggaacgatgacttacgagagagcgcaaaaaacacgcagtacaatttcccaactgcctctgtcgtcccttgtgttggaaacggatgcacctgatatgccgctctctggataccaagggcagccgaaccgaccagaaagagtcgcacaggttttttctgcgttgtgtgaattgcgtcgagaatctcctgatgaagtgtccgatcagatttatcataacagcaaggcactatttgcgttaagctgacttataaccacagaaatgatatgtttttagggtaacaggaagtgagtatccgtattaaataaatattaataatccttaattggtcttctttactcatttatcccttttattacctttttcaccgcaaaattatctaatcccttagaaactagatggatttatgtgatctggatctcattttgtgtttttatattactttttgcggtattaatttgtgatgttagttgcttgttcttttttactactaggtataatcggcctcgcacaatgccggtaggaactcacaatataactggcatattttttcattattcattcattcagtgaacagggattcttccaatgcaactcattatgagcctgatagggatggtagtgctgatttttatcgcagtacttttctccagtaattaccgagctattaagatccgcacagtcttgggcgcctttttgattcaggttgctattggggcatttgtactttatgtgccagcgggtaaagacattctgattggaatgtcaaaaggcgtttccaacgtcattggatacggccagaaaggaactgatttcatctttggtggactggtttccgacaaaatgtttgagctgttcggtggtggtggctttatctttgctctgcgcgtcctgcctattatcgttttcttctcctcacttattgccgttctgtattacatcggcgttatgcagattgtgatcaaaatactcggtggtggcatgcaaaaactgctgggaacatcacgaaccgaatctctgtctgcgactgcaaatattttcgtcggccaaactgaagcgccgctggttgttcgtccttatatttcaaccatgactcaatcggaactgtttgctgtcatgtgtggtggtctggcttctgtggcaggttcagtattggctggctacgcatcgatgggcgttccattggaatacctgattgccgcttcattcatggcagcaccgggtggcttgctatttgcgaaactgttagtgccggaaacggaaaaaacacgcgacaccgacgatgccatgtcgctgattgcggctgaagatcgccctgccaatatcattgatgctgcggcatcaggtgcggcatcgggtatgcaactggctctgaacgtgggagcaatgctgctggcattcaccgccttgattgccttactgaatggtatgctgggtggtatcggtggctggttcaactatcctcaactgtccatggaactgattctgggctgggcgttctcaccagtcgcctacctgattggtgtaccgtggaatgaagcgactgttgcaggttctttcatcggccagaaaatagtagtcaatgagttcgtggcgttcatgaactttggtgaatatctgaaaccgaacgaggtcgttcaggccgcaggtctgcaagtgctttctgatcataccaaagcgattatttcctttgcactgtgtggcttcgccaacctgtcttctgtcgctattctgctgggaggtttaggtggtatggcgccaaatcgtcgtggagacattgcacgttttggtctgaaagccgtactggccggttcactctctaacttgatgagtgcaaccattgctgggttcttcctcgcgttataagacgcaggaattgcgtatcaaattgaatgcaggtgagataatctcacctgcttttgtttttcctgaaactgtttgatgtgatactaatcacaataaaatgtctatcattgcaatgctcattcgattagtgtgatttgtaacgcgaattattcggcatttacatgttcaaataatgatgtgccaagactttatggattaagttgatgccctccggggcagtaaaagctgaagaaagtatagtgcggagagaaggagctctactgttgctgttgtgcataattatggcaacatcttcaaggaaccaagtccgctcgccaacaaacgaactaactaatcgttcaaaacaatcgttcaaaagaatgtgtgaacgggttcagtcacgataataataccgttggagagttttatgaccgatttaaccgcaactgctcagcgtgcgctgagtttgatggatttaacgacactcaatgatgatgatacggatgagaaagtggcgatactttgtcatcaggcaaaaagcccggcgggtcatactgccgctatctgtatctatccacgttttattcctgccgcacgtaaagtattgcgtgaacagggtactccagacattcgcattgccacagtgaccaatttcccgcacggcaacgatgatatcgatcttgcactggctgaaactcgagcagccattgcttatggcgcagatgaagttgacgtggttttcccctaccgcgccttgatggcaggtaatgaacagattggcttcgatttagttaaagcctgcaaagatgcctgcgctgcatccggtgtttggctgaaagtgattattgaaacaggtgagttgaaagaagaaaacctgatccgcaaagcctctgaaatttcaatcgacgcaggtgcggattttatcaaaacctcaacaggcaaagtccctgtcaatgcgacactggaaagcgcagaaattatgctcagtgtgatccgcgacatgggcgtaggtgaaactgttggctttaaacctgccggaggtgtgcgtacagccgaagaagccgcacaatatctggcactgtctgctcgtatcatgggggatcaatgggccgactcccgtcatttccgttttggggcttccagtctgttgagcaatttattgacagcacttggacatcagagccaaaagcaaagtagtggttattaagatcaataacaacacattgaatgcacgttaagataaagtgcattactaccattcttttcagataatgatgattaggaggtcgctttgtttctggcacaggaaattatccgcaaaaaacgggacggtcaccggttgaatgaagaagagatccgtttctttattaacggggttcgtgataataccgtttctgaaggacagattgctgcactggcgatgaccatttatttccatgatatgacgatggaagagcgtgtggctctgactttggcaatgcgcgattccggtacggttctggattggaaaaaattgaatttgcatggcccgatcgtagataaacattcgacggggggtgtcggcgatgtgacttctctgatgctgggtccgatggtagccgcctgtgggggttacgtaccgatgatatcaggacggggtttggggcataccgggggaacactggataaattggaatccatccccggctttgacatctttcctgatgaacagcgcttccgtgacattatccgagatgtaggtgttgcgattatcgggcagactaacttgctggcacctgcggacaaacgtttttatgcgactcgtgatatcactgctaccgttgattccatccctttaattacggcctctattttaggcaaaaaactggctgagggattggatgcgctggttatggatgtgaaagtgggctctggagcattcatgccgacttatgaacagtcagaacaactggcagaatccatcgttggcgttgctaatagtgcaggttgcaagacaaccgcgttgttgacggatatgaatcaagttttggcatccagtgccggtaatgcgctagaagtgcgtgaagccgttcaatttctgactggagaataccgtaatcctcggttatttgaagtcactatggcattgtctgcggaaatgctggtatcgggtaatctggcggctgatcgtgccgaagcacgccgtaaattgcaggcagtgctggacaatggcaaagcggctgaaacctttgagcgtatggtagcagcacaaaaaggcccgatcgattttgtcgaaaattatgctcgttatctaccgactgccccttttagcaaaccggtgtttgccgggcaaaatggcataattactgaaatggatacgcgggcattgggaatgtctgtggttgcattgggaggcggtcgtcgcaaggccactgaccctattaattacagtgtggggctgagtgatatcgttgcacttggagcagaagtgaacgcagatactcctctggcaatgatttatgccaatagtgaaaatgactggcaggaagcggcggaggtcgtacgtaagtccatcgttttgggaattgatgtgaataccgaaacaaaagccgccacacggatggtttaccgccatattgatggctaaatcatcacgaataatgaaaatagattttaacagccgacagtttccgcattgatagcgtgaattgactgacgcaggagaaaattatgaaacgtacgttcatcatggtattggattcctttggcatcggtgcgagtgcagatgcagagaaatttggtgacaaaggatctaacactttagggcatatcgcagaacagtgcgcccgtggtgaggctgatatcggtcgtaaagggtcattgcagttgccaaacctgagccgtttggggttgggtaaagcaacagaggaatccagtggaaccttcccgataggtttggatcaagatgctgaaattattggagcctacggctatgcgagtgaactttcttctggtaaagacacgccatcaggccactgggaaattgcgggggttccggttctgttcgattggggctattttcaggatttagacaacagtttcccacaagaattgctggataagctggttgaacgcgctaatctgccgggctatctgggtaactgtcactcttccggtacagttattctggataacttgggcgaagagcacatgaaaaccggcaagccgattttctatacctctgcggattccgtgttccagattgcctgccatgaagaaacattcggcttggatcggctgtatgaactctgtgaaattgctcgtgaagagttgaacatgggtgattataacatcggccgggtcattgcccgtccatttgtgggtgacaaggctggcgattttcagcgtaccggtaatcgtcatgatttggcggttgaacccccagcgccaaccgttctgaaaaaactggttgacgaaaaacagggtgaagttgtttctattggcaagattgcagatatctacgctaacgtcggtatcaccagaaaggtcaaggcaacgggaattgatgcactgtttgacgcttcattggttgaaatggaacaggctgggaataacaccatcgtatttaccaactttgttgattttgactcctcttacggtcaccgtcgtgacgtagcaggctatgcagcggcgttggaactatttgatcgtcgcttgccagaaatgctgaaactggttaaagaagatgacattctgatcctgacggccgaccatggttgtgacccaacctggccgggtacggatcacactcgtgaacatattccagtgctggtttatgggccaaaagttaaacctggctcattaggacatcgtgaaacgtttgctgacattggccagacagtggcgaaatacttcgacctgacgccaatggattacggtaaagtgatgttctagtttttcagggcagccaacgggctgccctgattttcatctgttttgatacgtaataaaattaaggaatagatttatggctaccccacatattaatgctgagatgggcgattttgctgatgttgttttgatgccaggcgatccattgcgggcaaaatacattgcggaaacttttttagaagatgtccgccaagttaacgatgttcgcggtatgctgggcttcaccggtacttacaaaggccgcaagatctctgtcatgggtcacggtatgggtatcccatcctgctctatctatgctaaagagttgatcaccgaatttggtgttaaaaagattattcgcattggttcctgtggtgcagtcagccacgatgtcaaaattcgtgatattgtgattggtatgggggcatgcactgattccaaagtaaaccgcctgcgttttaaagatcatgatttcgcggcgattgctgactttgatctggttcgtaatgcagttgatgcagcgaaggcgaagaatatcaacgctcgtgtcggtaatattttctcagcagatcttttctatacaccagatccacaaatgttcgatgtgatggaaaaatatggcattctgggcgttgaaatggaagcggcgggtatttacggtgtagcagcagaatttggtgccaaggcattggcaatctgcaccgtttctgaccatatccgtactggcgaacaaacctcggcagaagagcgccagacaacgttcaatgatatgattgaaattgcgcttgaatcaattttattaggtgataattaaaaaataataaatagttttattatttaattaatattaaaagctctttccataattggaaagagcttttttatttattaaattttatgttgatgtattcgattttgttaaagataagctttaactattcatttaatggattgcttaatttcggactaatttgtttaaaaaatgaataaaaaaccaaatttaacaaaattagaaccatttgcatttagtgatattttaaattagtaattagcttgttaattatcttaattaggtaaatattttagttttatttcaactaaagccataaattcaataataaaaaccataacttaggcttatgtcgatataataaaatatttttttatttcagagtggtaacattgaataataaagcaacgcaaactaagatcctaaattactgatcgttgctcgatataactcaggggaatagtccaaatttaaaaaattattagtaaaatatactactcattccacgtacttttttataaaaactcatatttaatatgaagttaacgcagatccttagttttattgcctgaaatttgacttaagacttattctgtagaatgatattgccagtttggtttattttgacctgttattaattctgtcaaaaaactaaataatcatacgcctaagtgtcagaaattcatttctgtgcttcggcttccttttggctatgagtatctatatctttaaattaaagggcataaattaaattatgaaacttaataaattggcgatggttctgggttttggtgtagctttgacggctggtgcagcaagcgcagctaaccaaggtagcggcacagttaaattcagcggttctattattgatgcaccttgctcaatcaaaaacaccaatattgacgttgatctgggcgcagtttctaacagtatcctggaaaaaggtggccgttcagcatctaaagcgttcaaaattgaattacaaaactgtactactgaaacaaaaaacggtgtgaaaacaacctttactggcgcagaagctgatgagaaaggtttgttaggcattgaagggacggcttccggagctgcaattgccatcaccaatgctggcggtaaaattattcctctgggtacagaatcagataaattttctctgcacgaaggtagcaatgatctgaatttcgccgctcatctgaaacgccttactacagtacagggagcagatggtaaaaatcagaatgaaatcaaaccaggtgaattcactgccatcgcaaactttactttaaactacctgtaatattattcattagttaacgggtaatttttagtcattgaatatcaggaaactaaccgccattgttattataggtttcctgataattgatagtttattcagggtatttctcggatataacacgttagcagaagattactacaatatgatgtagcaggatctgttttattgatttaagtcaatattattgaaaattaagtcatcaacgtgtgctattaacggaattatctgtgatagatgtaaattgaaatacccttttttatttaaccaatggcattctctctaattggctgtactcggaaaaccaagctattagccattttgatgtaattttaatggcatacctgtagtgacatttttcctctacttcccgctgtacggtaaaatccgtaaagcacaaagaagagaaagcgtgagatatgacggataagcaggacatatggctacctctgtgacaccagtaccagtcgagatcttcaatttaaatcgatggaatttaataatgccatgtatcaggtgagaagccctatattctcactcgtttggcaacatcaggcagcggctaaattcaaattggattattaacgattcatcgttcagagggtgctatggctttgttttcaaattccatgaatcatcatttttcagctattaatataaaaaacaacattaataaagagaacgtcgctaataaaaaaacagtagataataaagcgaaagtagttaatagaataaaaccagtccacttaaaaaatagaattaaacctctttcggcattggttttgtttgcactggcgggtatgcagaccgcatattctaatccatcaattgaattcaatatcgacgcgctggatgtcggtgaacgtgccaatatcgatttggataaattttcccgagcaggctatatcatgcccggtaactatattatgggtgtccggatgaataaaaatgaatttccggacatgtattcgattgattttacctcgcaacccgatgatcccaaaaacagcgaagcctgcatatcccctgaactggtgaagcaaatagcattgaaacaggagtgggcaggaaagttaggttggcagaatgatgggaaatgtcttgatctcagtagcttgccaggtatgtcagccagaggagagctggcaacttatactctgtatttaattgttccacagatctatttggaatatgacctaccggattgggacccgccttcccgctgggataatggtgtgcctggggtgctgtttgactataacgtcaatgcgcagacgtctaaacctactcatggcagcagcaatcaacaggtgagtgccaacggaacggcgggtatgaatgcgggagcatggcgttttcgggctgattggcaggctaattataaccactcgaaaaccaaggataataagcagggcgcttctggagaaagagagcgtgattggaattggagccgttactacatgtaccgcgccatacctcaccttcaggctcaattgacttttggggaagattacctgaattccaatattttcgacagtttccgttatacggggttgagtctggtcactgatgacaatatgttgccgccaaacttgcgtggatacgcccccgaagtttccggagtcgcgagaaccaatgctaaggtgacagtgcgtcagcaggggcgagtgttgtatgaaactcaggtcgctcccggcccgttccgcattcaggatctcagtgatgcagtaacgggtaatctggatgtcagagtagaagaacaggatggtggcatacaggaatttcaggttaatacggctacggttccttatctgactcgccccggacgcgtgcagtataaattggtcggtgggcaatcgaccaatgacaaacatcgtcgggaaggacccgcatttggattgggtgaattttcctggggaattaataacggttggtcattgtatggtggattgctgggagcaggggattacaacgccttgtctctggggatcggccgtgacttgatgatgtttggtgcgctgtcttttgacatcacggaatcaagggcaagaataccgaaagagaataaaacctttacgggtggttcatatcgcctcagttattcgaaacgtttcgagcaatacaatagtcaggtgacattcgcgggctatcgtttctccgagcgtaattttatgagtatggcgcaatacatcgaccgccgttaccgcgatgttaactctgacaatggaaaagaactttataccctgattttcagtaagcaatttaaggatcttggtcttaatgcccatattaactatagccatcaaacctactggaacaggccaacaaatgatcgctataacatatcactgtccaaatatttggatattgggcgttataaaaatatcaatgtgaacttatccgcctatcgcaacaattttgacaataaaaaagatgatggcgtgtatctgaatctgtctattccgtggggagatagcggaacacttagctataacggtttggccaatcgtcagggtaattcgcatatggctagttatttcaaccgcattgatgaacgaaataactatcgtatctctgcgggtagcagcatcggtggtaaggctgccgcagatggttattacacccattatggtgacaaaacgttgctgtctgccagtgccagttatcaggatggcgggcatacctccgcagcacttggtcttcgaggtggagtgaccgtgacagcaaatggcgcagcattgcatcgtatcaatcttcctggtgcaactcgcctgatggtggatacggaaggggttagtgatgtaccggtcagggggtttggctctgtcgttcatacaaactactttggtaaggcagtgctagtggatgtcaatcactattaccgcaattctgcaaatatcgatttagaccatttgccggataacgtagaagccctgcgttctgtacaacaggcaaccctgacggaaggcgcgattggttatcggaagttccaggtaatgtcaggaatgaaggcgatgactgttatccgtttgcctgatggttcatttccaccttttggcgcttctgtcatgaacacagctcaacgcgaaattgggattgtcagtgatgatgggtatgcctatctgagtggaatgaatgcaggtgagaaattgcaggtgcattggaatggcggggctcagtgtgaaatcaccgtaccgcaggaaatatccgaagcctctttgacttcattcttgctaccttgtcagtttttaaaaggtgaacatcagtaaattgcaataagacaagtcagaaaattgaattgaagtgacgtattatgttgctgatttaacatggaaagtactgttgttagcagagcaatctaaaaacgaatctctttgagaatgggcaagcaataatgaaaatgaaaaaaattctaatggtaaccgctctaacgttgacaagcctgatgcccgcttatcaggcaatggctgcgatggcgctggatcgtacccgggtaatttttaatggggatgtcaagtctgttagcttgaatatcgaaaaccagcatgtcgatttaccttatctggcacaggcatggattgaagatgataaggggaataagattaacggtccgctcgtggttgttcctcctgtacagcgtgttgaagccggagcgaagagccaagtcaaaattcagacattaccgacaatagccgaattgcctcaagacagagaaagcctgttctatttcaatttgcgtgaaattccaccacgcagcaataaacctaatgtgctgcaaattgcgttacaaacccgggttaaattgttctatcgcccggaagccgtcgtcgctcgccgtatcgaccttgataacccatggcaggagaagctcactttaacccgtcagggaaatcaatatctggtaaataacccgacatcttattacgtcaccatttcggaagcctctaataaggttaatggtaagaatatcgatggttttcaacctttgatgctggcacccagaagtagtgaaaaactcggggcagacctcagtgcgctgggcaataagccagtactgacctatgtcaatgattatggcggacgtccacagctgacattcagctgtaatggtgatacctgcacggttgcgaaaaccacagttgaagaaaactgatcgaaccttgtggataacgtcccatcagttgtcatgctgatgggaaatctaaagtctcattaaccggatagcaatggctttctttgggtaaatgttggggtaaagagtaatgagtccgttaaatatgaagctatccaaatatgtactgtcagccctgtttattttcggcattggtggccagaaaagtgcctatgcacaagatagtctgcgccaggatgtcaaaattacgctgactgtactcgctgctccctgtgtgattaagacagaagataaagcgatggaggtatatttgggtcgcattcttaaccgtgacctttatcagaactatcgcactccaggccagaatttcgaactgcatctggaggagtgtgatcctcgggtcgcacaaagcctcaagatcaagtttatggggccagagagtcgtacactgcccggattgctggcattcggtgctggcagcggtgcttccggtgctgctattggtatggagagcatagatggtaaaccacttccttttaacaaagtcagtaaatttccgctttctcgtaccagtagcagcaatgtgattccgttccgagcgtatgtacaagctgaacccggcgccctccagcacaataggattggtgctggtgcattcaatgcaattgcgacctttgaagtcagttatgagtaattatgctgacttatttttcgctcacaatttttagccagagtctgatgctatttaggggaataaattatgcgccatattaagaaatcactgatgaagtttgtagcattgttgtttttcttaagtacctcatatgcctatggtggtgcttatgttatggcggttgatactcaaccattcggtaatcaggccatcacaaccatggaaattattgcctggacagaggaggaaggggcgccaaacccttgttatggtagtaataaatgttatgtcgggcctgatgttttgtatatgaatggcaataagccaggtatgtatggttcctgcatggatgccggtgcgtgtttggatgatgccaatcgctatcgtaccgctgcagaagtcatgcgggcgtataaaaggaaactgggtattccttttagagcaacatttaccatcacgaatcggaatgctgattgtgtaggattgttctactcctatggaacacacccttttcatggtacagcggaaaaattccctaactccacttgcggtaaattacccccgcaaaatcagagttgctctatttctgtgccttctgaaattgcttatggcgcattaaaagcatcagacgttaataatgcgacacgttcgatcacggggcaggtgaaatgtgctcttaaaggagatttccgattagaaggtttctcaatcggtagagaagcaaaaatttatttggattctaacagacagatgtattccacattgcagattaatgggcgggaagcaatggatggtgtgtcttttaaagcgaaaggaagagatcaaccggaaaatttcacgctgacatccatattgcgcacgctcacaccaccaaaagccggtaaatatgaaggcatcgcagtcgttttattaagttataactaattgagagtaaagatatcatgcgggtcagtatgctggtaggaaaacgaatccaaataaaaaggaaagaaattgggatgacagtagcagagctggcggacagaattagcgttagccaacagcaattgtcgcgttatgaacgaggaaccaataaaatcagtctggaacatttggttgatgtttccattgctttgaaaacgcccgctgattggtttttggaagattgcttcaataaaacccaagtctctgttaagaatcaatatgcttttgtggcggaaacaattttggacttatattgatatcagatagaaaaaaaatgaataaatcgataagtcaaagccattcctgttaggaatggctttttttttgccagaaatacccatcagataataagtgacttaaataaggtatttggttaacaattagtaccaaactgttaacccgtcaattatcctactttttgcaatccgtttattctcatttcatccgaaagaatcaatgtaatagattgattacaatgtagaaaataaccccttctttttatgtgtcatatcccccttactccatcatcagagttctcctgtttttctacgtcggtgaatactcatttaaattgtctcatatcgaaagtcatataaattaaaacaattaattatgttggaataattaacttaaaaaatataaaaactaggattaatcatcttcagttaacagtttggtactaattgtagacaattttcgtttccctctttcctgccagatagccccgaaacgacccgcattacttgcggtataacgtacagtatggcgaatattccgatgtcctaaatagtcctgaatcaagcgggtgtccacgccattgtccgccagcgcgtagccgcaggaatgtcgtagcatgtgcggattcgcgcaaaccgctaaattggcctgtaaactcgtttgtcggatgattttataaaattgctgacgggacatcggtacccctgtacgtgacaaaaataaccagtcattctgctcactgtttttgtacttctgacgttgggcaagccactggcgtatcagttgaacctcccgcatcaccatcggatgaattgtggaaaaaccatttttcaggcgctgtacacgtagctttttcccctccaaatccgcatcagaaagctttaacccaagcaattcagaaactcggaatccatgaataaagcccataaatatcatgcatatatttcgttcagcatgagggtgttttcccaactctttgaggagtatttcaatctccgagtgggttaaataattacgtttttgcatgatgtttgacacagtatttgattccttatgattatcaaagatacctaatatgattcttgctgattattcacagactgcaacatcagggtttagtaataaatgatgtgatgataaaaatacacagtcatttatctgtaaaaatagggggttatgcaggaaaaatagaaaataagaccatctgaattcagtgtttatgccgaattcagatgaaatgatgaatgggggaagaaggtcagcgttgagaaacgtcgcttttattgtcccgatcctcatcaggggatttagtattggcggtcaagagataaggtgactgctgccagcggctgggggtgagtcgtagtaagttatgtgccagaacaaacccaatcgccaatgccaacaggatcatgatcctgagtacattcgtcgtattatccacctgcttggcttctgtttccagcctgtggctatccagtgtcaggcggagaaaaccttttggttcatttttgcctggtatggggacaacgagttgctgattgaaatagctgccggattttttgccatctaacgataaccggtcacgaacagaaataggttcaccgctccgcgcgatctgggtgccattttccagataaacactggcatccaaaatgcgacttttgctggtcagatagtccagactggctacaatcttcttattattaagatctttgctgtcattctccatataatcagacaagctgtatgctacctgttttgccagagttttcgccagatcttcaaactgatttacctgagcctgttgctgagaacgactaaaataggagacgccctgcagcagtaataccagcagtgctatacatattaagataatcgccgtcttgtgcagtcgaaatttcagttttgctttgatcatcgttattccatccatgctttggaacacatcatgttgccagatgctgtattgataggatagtttgaaaagcattttttgcctgccaaaattacacggaattacaggagtcgatgtttatgtctaataatctggcctaccgttatctacctgatgagatccataaatggccgggattaccgttatccctcagtggcgacgaagtgatgccgctggactatcgcgcaggggatagtggctggttactgtacggccgcggtttggataaacagcgtattagcgattttcagcaccgtctgggagttgccattgtcgtggtttcttcatggcgtattgatgattatcaagttgtccgcattgccggcagcccttccccacgtattaaacggttggcagatgagtgcagccttgatgtcgttcctctgggacagatcccacgcctgcgttcaccgggtttgttagtgatggatatggattcgactgccattcagattgagtgtattgatgaaattgcccgtttggcgggcgtcggcgataaggtggctgctatcacggagcgcgcgatgcagggagagctggacttctccgaaagcctgcgtgaacgggttgctcaactggcaggtgcagatgcatcaatattgcagcaggtgatggaaacccttccccttatgccaggactgacgagtcttgtccgcaagttacagtcgctggattggcatgtggcgattgcatcgggaggttttaccttctttgcggataaccttcgtcagcagctacgcctgtttgctgcggttgccaatcagcttgaggtcaaaaatggcaaattgacgggcaaggtcaaagggccggttgtcgatgcaaaatacaaggcaaccacgttggtacggctggcaaaagagctgggtatcccactgagtcaaactgtggccattggggatggtgctaacgacttgaaaatgatccgcaaggcggggctggggattgcctatcatgcaaaacctaaagtgtatacacaggccaaagtaggtattcgccatgctgatttgatgggtgttctgtgtgttttgagcggtggtttaaaacacgaagagcgttaatgtgagttttctggccgccaaaagcagccatataagggagtacatagtggcaaaagcagtaaaaagggcatttgtctgtaatgaatgtggcgcggattatccccgctggcaggggcaatgtaccgcatgtcacgcatggaataccattacggaagtgcgtttggccgccgcttcatcttcccgcagtgagcgtttcagtggctacgcgggagaagtcagtatcagcaaagtgcagaaactcgctgaaatcagtctggaagaattgccgcgattttcgactgggtttaaagaatttgaccgtgtgctgggtggtggcgttgtccccggcagcgcaattttgattggcggtaatcctggtgcggggaaaagtactctgctattacagatcatgtgtcagttatctgaacagatgaaaactctgtatgtgacaggggaagaatcattgcagcaggtggcaatgagggcacataggttgggattgccgacggataaattgaatatgctgtcagaaacgagcattgagcagatttgtctgattgccgagcaggaacagcctaaactgatggtgatcgactctattcaagtcatgcacatggcggatattcaatcttcaccgggcagtgtcgcgcaggtcagagaaactgcggcttatttgacgaggttcgcgaaaacacgtggtgtggccattatcatggttgggcatgtgacaaaagatggctccctggcggggccaaaagtgttggagcactgcatagattgctcggtaatgctggatggtgaggcggattcccgttttcgcactctgcgcagtcataaaaaccgttttggtgcagtaaatgagctgggcgtgtttgccatgactgaacagggattgcgggaagtgagtaacccttcggcgattttcttgagccgaggagatgaggttacgtcgggaagttccgtgatgatcgtatgggaaggcacccgtcctttgctagtggaggttcaggcgctggttgatcactccatgatgcctaatccgcgtcgcgtcgctgtagggcttgaacaaaatcgtctggcgattctactggctgttttacatcggcatggtggtttgcaaatggctgaccaagacgtctttgttaacgtcgttggcggggtgaaagtgacagagaccagtgctgatcttgcattattgctttctttggtttccagtttccgtgatcgtcctttacctcgtgatcttgtggtatttggtgaagtcggtctggcaggggaaattcgccccgtccccagcggtcaggaacgcatttcagaagcagctaaacatggttttaaacgcgctattgtgcctcacgccaacatgccgaaaaaaacattgccagaaatgaaagtctttggcgtcaaaaaattggctgatgcactatctgtgctggatgagttggattgactgattaagcacctgtctgattgcctgctatcatcacgttgactgtggcaggtagtcagacaccttttcaataactgccccattttttcctaatagtttggtttttaggaaattcaattttcacctccgactcaaataaatatgcgaattttcgagtgatatttttattcatttatttcaaataaaaaatcagctagtggtacgttatactactcaaattttcctattcttaccgaattaaattatttatctataataaataccctatgaaattacagtgagatttaattaaaaagataacagcataaatttcattgtggttcggcaagattttacatattgcattcaataattaattttttaattaaccttttgcttaaactaataacttaatgtttttttgttttattttatgaatattttaaattatttaattttaaatacttttaatggttaaaataacaagattttatcccaaaataccaataaacaaccagttttgtttttacctttcacaacaagcgtgttattttgtttagtatactaaacgcagggggttttatgggacaatttgactacttaaaagaagcgattaaacaggcgaattacacattgcagcaagtggctgatgcctgtggaatgacaaaaggctatttgagtcagctcattaacggcaaaataaagagcccgagtgcgcagaaactggcatctattcatcaatatttagaattagcgtatcccatggaaaagaaaacagtcggtgtagtgtttggtaaattttacccgttgcatactgggcatatttatttgatccagcgggcatccagtcaggtcgatgaattgcacgtcgttctctgttatgacgaattgcgggatcgtgaattgttcattaatagttctatgtctcagcaacccacagtcagtgaccgcctgagatggcttttacaaacgttcaaatatcaaaaaaatatccacattcacgcttttgatgaacatggcatggagccttatccgaatggttggggagtatggagccagggagttaaagggtttatggcagaaaagagcatcaatcctgaatatatctattccagtgaagcgcaggatgtggcacgttataaagaatatttcggtattgaaactatccttattgatccacaacgttcattcatgaatatcagcggcagccagatacgacaggcacctttccgctattgggaatatattccaacagaagtgaaaccattttttgtgcgcaccgtcgcaattctgggtggtgagtcgagtggtaaatccacactggtgaacaagttagccaatatgtttaacacaaccagcgtatgggaatatgggcgagaatacgtgttctcacacttgggaggggatgaaatggctctgcaatactcagattacgataaaatcgccttgggtcatgcacaatatattgatttttcagtaaaatatgctaataaagttgcttttattgacactgatttcgtgacgactcaggcattttgcaagcgttatgaaggaaaagagcacccctttgtacaggcgatgattgatgagtatcgatttgatctggtcattctgttagaaaataacaccccgtgggtggctgatgggctgagaagtttaggtagtgaacgggaacgtaaagagtttcagcagttacttgagagtttgctgaagaaaaataacatcgattatgtttgtatcgactcagcggactatgatcagcgttttctgcgttgtgttgagttagttcaacaaatgttaatggcgtaactaacttttatatataaaaatagatttaacttatattattatcatgattaacttatggctatttatttcccacagtgattcttagtgtcttgttttttattcttaactaactttaattgaatgtttcttgtggttatttttacaatagcaataaaataaattgtgataataatattttttgatacttgaattctatcgttttgacttgaattgtagagaaataagtcatttaatgaacaggcctattgatttatttatataaaatttattagttattaataaacccacaaatgtattaggtgttttaccaaagatggaggtgatgcaaagaaaatattgaactactaaagcaatcatgatgattttattccttattatctaaatggaataaaaatagaaaacttatgctatttttatttaacttgtatttgccttagtcgtaattaattaatattgttagatttttattctaagattaagaaatatcttatttattatatgctcattgtaaataataattgacataatatgagtctatccttatcaggatgtttcacatataaactatttttatttgtacaatgtctaatagacattagtagtattacaaattaatttaggcagcatatgttaaggaaaaagctttaatcttttaacctaattgtgttgagaatatgaacttaaatcaatttaaatcgattgatgttatcaatatttcatatggtttgactagcaattcagttaatcatgaaatgatttcagatatcacattttctattataccaggtgaaattactttgataacaggcccgaaagcatcgaccaatagcacattgctatcgattgcatcgggtatgttacaaccagatcaaggagatgtattaatcaataataacaaattgaaactaatgaatgatatcgaattaggaaagtttcattctgaaaatagcgggtttatttttcatgactttaatttatccaataaactaacgctcttagataacttgttattatcaacttcttatggattaacactttctagtgagcaagcgacaaaaatcgcgcagaaatcattggatatcgtcaaattgggtcataagagccgttattaccctggagagttatctgaaaatgaaaaacagctggctgcgatggcaagagcaatagtcagaagacctgaatatctatttgccgatgatccgacacgtaacttgggtcatcaggagcttcagatgttcgttgatatctttaaatttattgcacacgaacaaaaaggcacggttgtgattgcttctcaagataaccgcctggttcaatacgctgatagtatgattacgttagaaagggggaaggtcgttaagacttatgaatcctttcaagaaaaaagagtgatggtgtagttgttatatcccaataaatttcaagttgcagccaacaagacagcaatttgaaagagaaagggaataagtcaactcggaaaaacggcctgatatcaggccgtttccgcgatcaggtttatttactgattttcttatatttaatgcggtgtggctccagtgcttcagcccccattgtccgctttttataatcttcgtattcgctgaagttcccttcaaagaaagcaactttaccttcatcttgataatcaatgatgtgtgtcgcgatacggtcaaggaaccaacggtcatgggaaatgaccatcgtacagccagggaattccagcagggcgttttccagtgcccgcagagtttcgatatccagatcattggtgggttcgtcaagcagcagcatattgccgccaacttgcagcagtttagccaaatgcagacggccacgttcaccaccagacaattcgccgacacgtttgccttgatctacgcctttgaagttaaagcgtccaacataggcacggcttggtatttcaaagttgccgatgcgcatgatgtcctgaccaccggaaacttcttcccagacggtttttttatcatccatactatcgcggaactgctcaacggaagccagcgtaacagtttcgcccagtgtgattgaacccgaatcaggttgctcttgaccggacaacatacggaacaaagttgatttacccgcaccgttcgggccgataattccaacaatcgccccttttggcagagcgaaactcaggttgtcgatcaaaacccgatcgccataagatttagtcaggttggtcacttccagcactttatcacccagacgcggacctggcgggataaacaattcactggtttcattacgtttttggtaatcaacgttattgagctcttcaaagcgagccagacgcgctttaccttttgcctgacgtcctttcggattttggcgtatccattcaagttctttttcaatggatttgcgtcgagcagcttctgaggaggcttcttgtgccagacgtgcgtctttttgttccagccatgaagaatagttgccttcccatggaatgccttcaccacggtcaagttccaaaatccagccagcaacgttatcgaggaagtaacggtcgtgggtaatcgcaacgacagtgccttcataatcgtgcagaaagcgctccagccatgcgacagattcggcatcaaggtggttggtaggttcgtcgagcagcagcatgtctggtttttccagcagcaagcggcaaatcgcaactcggcgacgttcaccccctgaaaggtgctcaatcttggcatcccatgctggcagacgcagggcattggccgctcgctctagttggttatccagattatgcccatcatgggattggataatcgcttccagttgaccttgctcttttgccagcttgtcaaaatctgcatcaggatcggcgtaagcggcatagacttcatcaagacgcgtcagcgcatttttgacttcgccgaccgcttcttctacagcttcgcgaacggtatgttcaaggttgagctttggctcctgcggcagataaccaattttaatgccgggctgtggacgagcttccccttcaatatcgttatcgatacctgccatgatgcgcagtaaggtcgatttacccgcaccattgaggccgagaacaccaatttttgctccagggaaaaaactcagagaaatatttttcagaatatgccttttggggggaacaattttaccaacccgatgcatactataaacatattgagccaatgtaatttaccttttgattattaagggaatttttaaattcgtttgcgtttatggggcatggatggggcattttaccctaaattttacatatcgtgttgctacctgattagcacgagttcaagcatccaattaccgcaaacggtaaaaactatctgtgcggaacgtgtgtttataagtgggatccccgttcctgtctgacgattgtattcactgtgggacggaatacaaatgagattaggtgtgttcttctaaacgattctttcataaaaatcttatccttatgaattcactgttgtaatcaatcatgtcaataatatggttataattgaatagcatttttgtattggtggttatccgtttagtcctttggaggagcatgtagtaatgaataaatggcggcattttacgatagctgtgggtctggtttttgttgcaggggcagcacatgcggattctttggacgcccaacgtgagcgatatcaagcggtaaagctggcgtgggagacgaaaaatatggcggaagttgaacgattaatgccaacgctgaaagattatcccctatatccttatctcgaatatcgccagttaactcaagatttggatattgccacgcctcagcaaatccgccactttattgatacttatccgactttaccaccagcgcgttctctgacatccaaatatatcgattctctggcaagcaatggagactggtctggtattttggcattcactccaaatgcaccaagggctgttatgacgcgctgcaattattactttgctaaatgggccaccggaaatcagcaggtagcatggaaaggtgcccaagaactgtggttgagtggcaacacattgcccggcagttgcgataaattgtttgatgtctgggaacaggctgggtatttatctgcaaatttaattttgcagcgtgtggaattggcgattaaatcaaataacactcagttggttaattatctgattaaacgcttgcctttgagctatcggagcttgggtgagaatctactgaaattgcaaagtgatcctgctttcattgagcattttgcccaaacatccacatcaacggattttacccgttccgttatcatgaccacgttttctcgttttgcccgtaaagacgcagaagttgccagacacagtattcctgctattgttcggacgcagaaaatgaatgactccgagcatcaattgttaaaagatgcagtggcgtggaatttaatgagcaatgtcacaccagagcaggcgaagtggcgggatgaggtcatacgagattcgcaatctaccaatctgcttgagcgacgcgtccgtttgacactgcaagatggcgatgaaaaagggctggtacagtggttgtcattgcttcccaaaagtactctgcaaaaaaaagaggagtggcaatactggagtgccattgtcttgcttaatgaaggtaagcaagcagagggtgaagcaatattgcataaccttagggaaaagcgaggtttttattccatggtggctgcgcagaaattaaatctcacttatccattgatgattgataaagcagaaaaaccagatgattcgattgcaaaaatgcgggaaataaagcgtatccatgagttgatatactggaatatggataatctggcgaactcagaatggaataactttgtttcttcacaaagcccgtttaaacagcaacagttggcccgttacgctcttgagcagcattggccggcactcagtgtacaggccactattacgggtaaaatgtgggatcatcttgaggagcgtttccctctggcatggcagaaggaatttgcgaattttactgttgataaaaatatttcacaaagttatgcgatggcgattgcccgacgggaaagtgcatggaatcctcaggctcgttctgggaagggagctagcggattgatgcaaatcatgccaaaaaccgcagagcataccgtgaaggagcagaagattcaggggtattccagcagtagtcaattaatggatccagcgatgaacatcaaagtgggtacagcttatctggacttggtttaccagcgttttggcaataaccgtgttcttgccagtgcggcctataatgctggccccaaaaatgttgaacgctggctggcgaatagtgctgatcgtattgacgcgatagcttttattgagagcattcctttcggggaaacacgcgattatgtcaaaaacgtactggcttatgatatgtattaccataattttatgggaatacattcaaatgcgttgactaacgcagaatggcaaaggcgttattaattttagatataactatggtatgctgctgtactagttaaatagtatggccgcttattatgataccaaatcacttgattgatccggcactcaccccggaaaatagcgatgactggctcacttttgtgggattgttacagtcagcatttgaacaaaatttgcaacatccgattttgcagctattattgactcccgatgagcgcacggctctgtcaactcggattcggattgttcaggaattaatgcgtgggcagatgagccagcgtgagttgaaaaatgaacttagtgtaggtatagcgacaattacgcgtggctccaacagcttaaaagcagcaccagctcctgtcagggcgtggttggaagcgcaattattaaaaagctaaaataaccaaagcggggtcattttgttatgacccctgacggccacgccgttaaggttggttattcaactctttgtaaatttcatgatgaataggaacaagagccaatatcagcgcctgatgataaacgctggtgcgggtaagaataccgttagtaaaaaagccgattgcgccacctttctgcttgatattatcgacgccggtcaaataagccatttcatggccaagctcgcgtccttcacgaatgccttccaatactttttcaggcagcatcagactggcagagcgcgactcaccccgaatttgcttgtattcgataaccatccaggcgaacgtcatgtcatcttcaattccagcttcaactccaacccaaaaatcggcttctggccgaacctgacgggctgccatcacgcggtgacgggcaccggtacgggtctcagtattgccaatgggttgttgagggacgctgctgtctacgttgacatcttctatgcggtaagtgccggggccaaaaacatcatcgaatgcaaggttaatcgcttttatttttgcagggttagttgttgcagcaataacgtggtacataataaataaattatcctttgaactatttcagatgcagtataacggaaaatgaatatgttacaggtctatcttgttcgccatggcgaaaccgaatggaacgtggctcgccgtattcaggggcaaactgacagtcccttgactgaaattggcctgcgtcaggcacgcttggtagcacagagagtaaaatcacaaaacatcacacatgttatcaccagtgaccttggtcgaacacgtcaaaccgcagaaatcatcgcgaaagcctgtgggtgtaaagtgctgctggaaccccgtttgcgggagttaaacatgggtgttctggaaaatcgtgaactgaattccctgactcctgaagaagaatcctggcgtaaaagtcttgtcgatggtacaccaaatgggaagatcccagaaggtgaatcaatgaatgaattgtcagctcgtatgcgggcagcgctggaaagttgccttggcctgccagcaggcagccgcccgttgttagtgagtcatggtatagcattagtctgtttggtcagttctatcttggggcttcctgccaactcggagcgccgcctgcggctaagaaactgctctatctcaagagtggattatcaagatagcccgtggctggcttcgggctggattgttgaaactgcgggtgatatcacacatctggatatgcccgcattggatgaattacagggttaacgctcaattgggatgaggtactcaaattccacaacgtgggtttgagactcatcctcaaagtttttccattcaagattagtaaggtagtatcgctcaacatcgtatcctttcctgcgagtgatgtttaatttaggcaagcagataccataaactgtaaagaggaactcttttaattgttctttgcccccaaaataactgaatgaaatatagtcaccgccaggtagaacaacaggcctattgtcttgcgtattaaatgtggcatattctggttctattgctgtggtatagaaaacagtctgctcatcttcatgctctgcgctgagatcggaatggtgcaatccgtacagcctggggggaagtgtttcagcatgttgcagatagtttacccaaaaaccgtgacgcatctctgtgcaggcacttgaccactgctctagagtataagaacaagtatgctcagtaccgataagaagctgatcttccaacgtgacatacttgtgtgctggcaacggtttgttatccaacataatgggtggacaaatacccgtagcacaccactcttcatttcggcggtaggaagcaggcgttcggttgaactgttttttgaaggcccgagtaaacgtttgttgagaatcaaaacgatattgcaatgcaatgtccagaatagggcgactggttaaacgcaatgcaactgcggctttggataaccgtcttgctcggatataagaaccaatagcctgacctgtgacgtccttgaacatgcgctgtaagtgccacttggagtaacctgcttttgctgcaacgttatcgagggatagtggacgatctaggttattatccatccaatgcagcaaatctcgaatgatgttggtttgatccatacatctccctaagtcattaagacaaaaagaaaatcatacaaatgtacaacaacttactattttgaaaaaccaaaacgtttttctgaatgcaactgttatgcagtttggtcgagaattaacacctaccatttccaaaaggtaaaaaacatagcttatgatgcctcttgatggtcggagagcagaaattattcctattctcactggtaaaagttgttaattctagatgccatgaatgattaattttgttttgtgtaaacctgagcatgtaatacccacttttacggaaaaaccttctcattaaattaaacaagaattttcttggaataaattaatagcttaaccgataatctgtcaagagttatattgttaaattcattaacaataggcatcattatgttcattttcacaaccatttccacccgccaacatacataggttggtggatgttgaacataaaacaggctgataaaaactttctcaaaataggcgtatttttaagtgtcattcaaaaagtgagttaaccagtagaaatggacttaaaggccattttttactcgtttagaatggctgttcagctataatgtcacgatttttcgtcataaatacattagtggtgaaaatgatttaatgaaaggtattgattagcattatatgttaatagtgaatattttcactgcatttatttaatttaagtggactaaatatggtaacaatcaagaaaatagtaatagcggctgccttgatcttttctcctgtgatcctgcatgctgaggagatcggttctgtcgataccgtgttcaaactattcggtcctgataacaaaatagtaatagaagcttttgatgatcctgatgtcaaaaatgtcacctgttatctgagcagggctaagacaggcgggatcaaaggcggattggggttggcagaagatacttctgatgccgctatatcctgccagcaggtcgggccgattgaattgagcgacaaaatcaagacatctcccaaaaaagggcaggttgttttccaaaaacgtacatctctggtgtttaaaaaacttcaggtggttcgtttctacgatcctaaacgtagttctctgatttatttaacttattctgataaagtcatcgacgggtcgcctaaaaatgcgatcagtgcggtgccgatgatgccgtggaaagagtgagttacccattaaacaaaagccctgaatgtcgaaggtcattcagggcttttttgcaaatgcggtagtttagctggtatcgattagtcttctaaatctccacagaaacgatagccttcaccatgaatggtggcgatgatttctggagtatctggtgtggtttcaaagtgtttacgaatccgacggatagtgacatcaacggtgcgatcatgagctttaagttcgcgccctgtcatttttttcagcagttctgcacgagtctggattttccccggattctcacagaagtggagcatcgcgcggaattcgctgcgtggcagtttatactgatctcccattgggcttaccagagagcggctgttgatatctaattcccattcattgaatttatagctttcaacttgacggcgctcttcacctgaatgactcaggttcatagtccgggaaagcaaattccgtgcacggatggttaattctcgtgggttaaatggcttggtgatgtaatcatcagcgccaatttcaagcccaaggattttatccacctcattgtcacgccctgttaaaaacatcagggcgacatttgcctgctcacgtaattcacgggcaagaagtaacccatttttacctggcagattgatatccataatcactaagttgatatcgttatctgacagaatgttgtgcatttctgagccatcagtggcttcataaacgacatacccttcagcttcaaaaatgcttttcagggtattgcgtgtgacaatttcgtcttcaacaatcaaaatgtgcggggtttgcatggttgctacctaaaatcgctaaaaaaacagaatctgtatgacgcaagctgttattattaaaagaaaatatgctgatattgttctgaatcacagaaaacgcagctcatgtccaaaataaacgttgttgatatattttacgctagaagccagcatcgcttttttgagggtacatacccgaaaaagcgggtttaaacaggggcatatattagtctattaacagcaacataacagctagtaatgcattcgccctctaaaaaagctaacttttgttgatacatatcaaaatcaattgtagcacgttaacattcgttgtaattgttaattttaaactcggtcatatgttattaaattgaaagaatgttgttaactctgtgatgttgccagaacgtgtagagaggttaacagtaacacgctcatgtcaagatgagcgtgtttttatcataaagacaaaataattacaaaatatgttttttatgacattaaattctataaaccgacattgtcggccagataattgcgtaatcgtttcgctatatcctgaatgattacaacgcgaaaaatggcatttttttatgctttcatgacaaaaatatttgacttcggccacagtttgctttaaccaatagggggtcaaccgaattaaaagacagacaggaaatcatgcgccatatcagcccgaaaaataaggttactacagaaaccattacgacgattaccaccggaaccatgagttacggggcgggctgacgcgtaaacataaaataaaaaaagcccgtatcctacaagatacgggcttttttttggacagaaatcaggagaaaaatactaatgcgagtactgaaatttgggggcacctcagttgcaaattaccagcgtatactgagtgttgctgatatcgccgaaagtgaactatcccttgggcaagtggccctggttctttctgcacctgcaaaaatcacgaaccacttggtggcgatgatagacaaaacggttgcagggcaggatattgtttctaacatgagcgatgtgtcccaaatctttgctgatttgctgtcgggcttaaaagaacatcagccgaatttcggttatgaatacctgaaaggcgttgtggaacgtgaatttgcctacctgaaacagaccttgcatggcatttcgctattgaagcagtgtccagacagcattaatgctgctctgatttgttgcggtgaaaaactgtccattgccattatgggggcggttttacaggcgcggggtcataaagtgacagttattgatccggtcaaaaacctgcttgcccacgggcattatcttgaatcgaccgttgatattcacgaatcgtccaaacgcattgctgcgttgaacatcccggctgggcatatcattctgatggcgggttttactgcgggtaacgataacggtgaattggtggtactggggcgcaatggttccgactactcagcggcagtgctggctgcgtgtttacgcgcagactgctgcgaaatctggactgacgtagatggcgtttatacttgcgatccaagggctgtacccgatgcacgtctgctaaaaagcttgtcatatcaggaagcgatggagctttcttatttcggtgccaaagtccttcatccgcggacaatcgcgcctattgcccaatttcagatcccttgcctgattaaaaacacggcgaaccccgatgtgccgggcacctttatcggagaaggacagaaagacgaaaatctgcccgtcaaaggcatcaccaacctgaacaatatggcgatgatcaacgtctcaggtcctggcatgaaaggtatggtcgggatggcggcgcgggtgttttccgtcatgtctcgcaaaggtatttctgtcgtgttgatcacacagtcttcatcggagtacagcattagcttctgtgtgccgcaaaaggagctgacaaaagcacagaaagcgctgaccgaagaattttatctggagctgaaagatggtgtactcgatcccattgatgtgatcgataaccttgccatcatctctgttgttggggacggaatgcgcactcagcgaggtatctctgcccggtttttctctgcgctgacccgcgccaatattaacattatcgccattgcacagggatcatctgaacgttccatttcggcagtgattgacaatgataccgctaccacagcggttaggttctgccaccaaatgttgttcaacaccgctcaagtggttgaagtcttcgtggtgggtgtgggaggggtgggtagtgcattgattgaacagatccgtcgccagcagtcatggctcaaacaaaaacacattgatctgcgagtgtgtggcattgccaattcacgggcgatgttgacggatatgcagggcatcggtctggataattggcaacagtcactgtcggaagcgatcgagcctttcagcttgagccgccttatccgtcttgaaaaagaatatcatcttctgaatccggtcattgtggactgcacttcgaatcagtcgattgcggagcagtatgccagctttttaggcgatggttttaatatcgtgacaccgaataaaaaggctaatacgttgtcgatggcctactatcgtcaaattcgtcaggcagccgaaaaatcgaaacgaaaattcctgtatgacaccaacgtaggagcaggattgccggttatcgaaaacttgcagaatctgctcaatgcgggggatgaactggtgcagttcaacggcattctgtccggctcgttgtcttatattttcggtatgttggatgaaggcatgacgctttcacaagcgactctgctggcaaaagaaaagggctttaccgaaccggatccacgggatgatctctccggtatggatgttgcccgcaagctattgatccttgcacgtgaatctggctatgaactggaattggaagatattcacgtcgagccagtcttgccggctgcgtttgatgccagcggtgatgttggtcgcttcctgcaacgtttgccacagctggatcaagaattcactcatcgtgttgcggatgccgcaaaacaggggaaagttctgcgttacgttggcatcattgaacaaggccgttgtagggtgaaaattgccgcagttgatggcaacgatccgctttataaggtcaaaaatggcgaaaacgcactggctttctatacccgttattatcaacccattccgctggtgctacgtggctacggtgctgggaatgatgtcacagccgccggggtttttgccgatatattacgaactctgtcatggaaattgggggtttaatggtggtcagaatttatgcacccgcctctatcgggaacgttggcgttgggtttgatgtgctcggcgcagcggtttctcctgttgatggctcgttgcttggagattgcgtctctgtctgtgaagctgaacatttcagtttaagtaatgaagggcggtttgccgacaaattgcctgctgatcccaaacacaacattgtttatcaatgctggcagcttttttgccagcatctgggaaaagagctgcctgttgccatgacactggaaaaaaacatgccgattggttcagggctgggttccagtgcctgttcggtggttgctgctctggtggcattgaataagtatgctgactgtccatttgacagcaaccaattgttggacatgatgggcgagttggagggacgtatttccggcggtgtacactatgataatgtcgctccatgctacttaggggggttgcaactgctccttgcgcagaaaaatgccgtttgtcagtttgttcctacttttgatgattggttgtgggtgatggcttaccccggcatcaaagtttcgacatcagaagcccgtggcattctgccggcaaattacccccgtgaggatatgattgagcacggtcgttattttgcgggatttattcacgcctgtcatacccagcaatccgaactggcggctaaattgatgaaagatgtcgttgctgaaccttatcgcacacaacttttacccggatttgccaatgcgcgtgatggagtaaagaaacgaggagctctggcgtgcagtatttcgggttctgggccgacattatttgcgatctgcaatgacatggctgtagcgaaagaagtcgcacagtggctgcaacaacattacgtacaaaatgatgaaggttttgtgcatatttgccgtctggatctcgcaggcgcacgacaggtagagtaacgatgaaactatataatttaaaagacagcagcgagcaggtcagcttttcacaggcggttaaacagggattgggcagacagcaggggctgttttttccgcaggacttacctgaattcagtcgtgacgaaatcgacgaattattgaaactggattttgtcagccgtagccagcgaattctctccgcttttattggtgatgaaattcccgcagaacaattggcggctcgtgtcaaaaatgcttttgcctttcctgccccggtgacgggcgtcgaagacgatatcgtttcgctggagttgtatcatggaccgacactggctttcaaagattttggtggtcgttttatggcgcaaattctcacacaaatcgcgggagaacagccggttactattttgactgcaacttccggtgataccggagcggcggttgctcatgccttctatggcctggacaacgtacaggtggtgatcctctatccagaagggaaaatcagcccattgcaggaaaaattgttctgcacactgggagggaatatccacaccgtcgctatcaagggcgatttcgatgcttgtcaggcgttggtaaagcaggcttttgatgatgaagaactgaaacgtgcattgtatctcaattctgccaactcaattaatatcagccgcttattggcacaaatctgctactactttgaagctgttgcccagatcccagcagaaaaacgtgaacagttggtgatttccgtgccaagtggcaacttcggtaacttgacagcggggttgctggcgaaatcgttggggctgccagtaaaacgttttattgctgcgacgaatgtcaatgataccgttccccgttatctgtctgaaggagcatggcagccacatcagaccgttgcgactctttcgaacgcgatggatgtcagccagccaaataactggccgcgcattgaagagttgttccagcgcaaaggctggtcactcagtgaattagccaatggtgtggtggatgacagcaccactcaggccacaatgcaagaactggccgccaaaggctatatttccgaaccccatgccgctgttgcctatcgtgtactgcgtgatcaattacaggcaggagagtatggtctgttcttgggaacggctcacccggccaagttcaaagaaagcgttgaagcgatcctcagccagccgctgccattgccacaggaattggcagagcgtgcggatttagctctgttatctcactttctgcctgctgactttgcgagtttgcgcgaattcttaatggaaagagcgccgacataacgtcgtatctgtcactccacctgaatagcgggtggagtgacatcaatcaatgctgttcagggcgtttaaatacccgctcactgcctttggagagcgattcatcgaaggcgtatccttccagattgaattccaccagccgggcaggatcagtcagttgattctgaatgataaagcggctcatcagcccacgcgctttcttggcatagaagctgatcactttatacttgccattcttttcatccagaaaaattggtttgataatttgagccgctagctttttagtattcactgacttgaaatactcatctgatgccagattgaccaacacatcatcaccttgctgttccagtgcagcattcagattttcagtgatgagatccccccagaacttatacaaatccttgccacgcgggttgtccagcctgatccccatttccagccgatacggctgcatgagatcaagagggcgtaagacgccatacaggccggataacatccgcaagtgcgtttgggcaaagtcaaaatcggcgtctgagaaagtttctgcctgcataccggtatagacgtcacctttaaaggcgaggatcgcctgacgggcattttccggggtgaaattcggctgccattcaccaaaacgagccgcattcaggccggccagtttatcactgatgcccatcagactaccgatttgcgctggcgttaaggttcggcagacatcgatcaattgcttggattcccccagcaatgcaggctggctatatttctttgttgcgggtggactttcataatcgagtgtttttgcaggtgaaatagtaataagcatgattttgttccgatatgattttgtttcgaatcgttttccccataatgcaggctttctcaactttagcaaaaacaaactgaaaagggcgaataacagcgataagattttcctaccttacagcagcgcttgaccatgttattatcaccggatggcgaggcaacagtgccaatattttacgtataacgatgagatattaaacatgaccgataaactgacttccctgcgtaaactgacaacagtcgtagcagatactggggatatcgcggcaatgaagctgtatcagccgcaagatgcaaccaccaacccttccttgattttgaacgcagctcaaatccctgaataccgccaactgattaatgaagccattgaatgggcgcgtggtcagagcgattctcgtgagcagcagattattgatgccggcgacaaattggcagtcaatattggtctggaaattctgaaactgatccctggccgcatttccaccgaagttgatgcgcgcctttcttatgacactgaagccagcgtagcgaaagcaaaacgtttgatcaaactgtacaacgaagcgggtattagcaatgaccgcattctgatcaaactggcttctacatggcagggtatccgtgcggcggagcaactggaaaaagaaggcatcaattgtaacctgaccctgctgttctcttttgctcaggcgcgcgcttgtgcggaagcgggtgtttatctgatttctccgtttgttggccggatccttgactggtacaaagcgaatggcgataagaaagaattcgcaccacatgaagatccgggcgtgatctctgttgctgaaatttaccagtactacaaagaacatggttataacacggtggttatgggcgcaagtttccgtaattccggtgaaattctggaactggctggctgtgaccgtctgactatctctcctgcgctgctgaaagaattatctgaaacagcaggtgaagttgagtgcaaactgggttatgaaggcgagatcaaagcgcgtccagctcgattgacagaagctgagttctactgggaacaccatcaggatgcgatggcgaccgaaaaactggcggaaggtattcgtaaatttgccgtagatcagggcaagcttgagagcatgatcgctgatctgctgtaatcttaagcgacacgctattttttcttccacaaaggcgacataatgaggtcgccttttattttttcgcttcaccataagcgatattttctctctattttttctgttaattgaggttcgtatgaatctactgcgcattggcctcgtgtctgtttctgatcgtgcttcaaacggtgtctatcaggacaagggcctccctgcattggaaacatggttggaaaaagcgattaccacgccttttagcgtcgaaactcggctgatccctgatgagcaaatcctgattgaacaaaccctgtgtgaattagtcgatgaacggggctgccatttggtactgacaacgggaggaaccgggccagctagccgtgatgtgacgccagatgcaacactggcgattgctgatcgtgaaatgcccggatttggtgaacaaatgcgccagatcagccttcaatttgtgccaacagcgattttatcccgtcaagtgggcgttattcgtcatcaagcgttgatcctcaacctgcctggtcaaccgaaagccattgcggaaacgttgggaggtctgaaagatggcagtggcaaggtgttggtgtcagggatttttgctagtgtcccttattgcatccaactgctggatggcccttatgtggaaactgatgaaacggtagtcgccgcttttcggccgccgctaaaaaatggataatgttaatctaaaattagcgtcttgcgcttgagtcgttttagcctgttacgcaggttcttcacgtttcaagcgaggctcccacgcgtaccacagccagcattgccgttttctgttgccgctgaatacacatcatggcacgagttttttagagtgcgtacaacagcgttaatactgacatgaagtgcccgtgccgtatcacgaataccggcgttattcatggcaagcccggtaagtgtattcgagctggaaggttctacgacaggactggcaataatatcgttgatgcccagcttttcctttgtcgtgctttggtcataaaatcgacacttcacttcaactaatgccataacgatccctcgctccctcatgtatttactttcattatacgtgagggagggacaacgagatgaatacgtgatccactaacacttaaccaatcaaatacgtcagcacctgttgttgcggcatcaggacaaaactcccatgaaattgcgagccagcctgatattcatcagataatgttttcagcaatttgatgctcacggtgtgattacggcaatcaatggctgtaatttcagcagcatgaaaatcaaaaaagcgttttacatgggggtgaagtgccttgaaaaggctctctttgatggaaaaggtaagagtaaatgcttgagcgaaagagagtgtacattctttcagcaattctgcttcggtttcattaatgacagtgcgtgaaacactatcgatagtatcctgcttaatttcttgttcgatatccaccccaattatctgatatttctcgcgggaagcggcaaaaacaatggcgcagttggcggagtgggacagggagccgcaaatcttatcaggccagacaggagagcggtctggcgcatttatgacctgaaattcaggatagtccatgctatttaagatctgttgagtgcagtagcgagccgccagatattcagctttccgtttgtttaccgcgttctgtagccttgccggataggtaataccgtacttatcaaataaaatatcctgatagcaagcctgattataataagtctgcattacctgaatatcagggtatttgggtaagttgcctctttggatgacggtgaagaagggatcatcgatggcagtggttttaactggggtaaaagtaatttctttcatgatcaatagaatattatgggtgagttattatctattaattttgccacactttagcgcttgttcactaacttactgactctttttatactctttcttgttatcatttttattgtgtgaaacagtgacactaacaaaaactggcacgcggaagaatgtgatatcgtgtttatcgaatctttgcatgagtcaatcaaattgagaaagaggttaatgtggaaatattagtgacaggtggaatgggatatatcggcagtcatacttgtgttcagatgatggaagcgggaatgacgccgatcattatcgataacctgtgcaatgccaatcgcgaagtattggcgcgcattgcggcattgacgggtgtgatgcccctgttttatgaaggggatattcgtgatgaatcattcctcgatactattttttcccgccatcaaattcagtcggtgattcattttgcaggtttgaaggcggttggggaatctgtcgctaaacctattgaatactatgataacaatgtcaatggtacgctggtgctgatgcgcagcatgcataaagcgggcgtaaaaagcattattttcagttcatctgcaacggtgtatggcgatccggagatcgttccaattacagagcaatccgccgtgggcaataccactaatccttatggcaccagcaagtatatggttgagcgctgtctgtctgatcttcatcacgccgaaagtgattggtcggtagtgttattacgttactttaatccggttggtgcacatccttctggtactatgggcgaagatccgcagggcattcccaataatttgctgccatacatcgctcaagtggccgtaggccgcagagaaaagctgtccgtttatggcagtgattactcaacgcatgacggtacaggcgttcgcgattatatccatgttatggatttggctgatggacatattgcggcactgaatgccgttggcaagaaatcaggtctgcacatctacaatctaggaaccggaaaagggactagcgtattggaaatggttacggcatttagccacgcttgtggcaaacccgttccttatgaaatctgtccgcgtcgtccgggtgatatcgccgaatgttggtcaagtccagaaaaagcagaacgtgagctgggctggaaagccagccgcactctggttgaaatgacggctgatgcatggcgctggcaatctcaaaaccctaatggttatacccaatagggttaaaaagggaatccctcccctgagtcacgtcagcgtgaaggtaggggagggggttaaacagatactgtgaatttatgcattattacccatttctttaccaactattgtcattcatcacaataagtatgcttaactgtcttgaaatcacagtaacggctttacagacagtcggtgaaaaaggttgggatggttttgcgttattacggataaacacggaaaatcattaagctattatatcctcgtttttttggatatttatttgtgtataaatattgaagatgagtattaaggtttacaaaaaggatggcttatttaaatcataaaccatcctttaaaataataactgagcatggagtctttaataagactgataattaatcgatagtttctaaagagcaactcattaaataaaacgtaatattattgttttttgaccgcagttttttcagatttacgggctaactgacaggctttacgttcattggactctcggtctttaatcacttttgctgtttcatccacagtagggagggtaaaacccatatcatcataagcaccaaaaccaatcaggcgatagccacttagttgggtatttacggggatacggaattcttttttctctcccggcgccagtgattcaaatgattgtactgccggagcctgaggttcacatttggtattcagaggtaaaaccgccagatagccgcctgctacaggtttattgcctttattttctagcgtgccccctacaaagaatttgccattggctcccaaccccatgtggaataacaggtgcgcttcgcctttcgcccataaggcagagctaaacaggctacccgccagtaacatcgctccgtatgtgtaactacgccatttcatttttattctcctattgagtgaattcctaacatgaaataggtattgcagtggttagagaaaaaatcaagttaacctcaatgatatcaatttgtttatctggttatttattcgtatgtacgcaatgactattgacttctccctgtactgcatcattatctgttgtaactctggtgaattcatccggatccaatatagcaatatagctggttaaatagtggttgcaacctatgctgtcggctatgttcagcgcttccggagggttaaggagggtgatattaggtagtgatttgtattcgtagtcccattgctgagaaatattaagtaccggcaaatcaggcggtaaattgggaacgatatcttttgcatagttgaatacttcatagtggctaaaattattatcaacatattcaacaaattcattatttccgggtctcggacaagcaaacaaacaggcagaatgattgggggctaaaaaagcgatatcacacatcaaataagaagcgatggcggctccaagactatgagcaagtattgtgaattggccgtttatacctatgatttgagtaatcgcattggccagtttgagttggctataatcacattcagaattaaacgcaatgagtttcagtgagtcgtaaacgctataaaaaccgcggcttactttccgttctggagcactagaccaaggcgatgtaaaaatggcaatgatattatggagatcctccagaaggtttgtgtcatccgttcctcggaatataatgacgtactctcccggggcattcttcttctctgcaatatatccgtaacagatactctgcggcaatgtgaacaacatttttttttctactgagaaagaagtgtcatctccagaaatataagcgataagattccatccatcctctttgatacgtggatcagcagggggagtgggattattgtaatatttttcattcatatcatatgcatacatgattaatgatgccagttttgctgcttcagtatgcgtatacataacatatctcctctatattatagaaaaagtagaaatatgatatttcatcttgaagaaattgtggagaatttgggcgtgtagtgtggagtttcagagcgctattgatgatctattgatgttaaagagataccctttttatcgggttggccgagtatttagtaaaaataacgatctatctattaatatagaattaatcacattttgttatatatagtttttatttgttcttttaaatccattgtcatgcggcgttattctttaccaatctgaaagttttaatttgcaaatatcaatgattatcaagaggctaatatggctgtaccacgttcggttcttgaactgattggcaatactccgctactggagctgacccatctggatactggcccatgccagttgtttatcaagttggagaaccaaaatccggggggctctattaaagaccgagtggctctttcaatgattgaaaaggctgaaaaacagggattgttgcagccaggtggaaccatcattgaagcgacggccggtaataccggtatcgggctggcgctggtcgctgccatgaaaggctataaactgattctggttgtgcctgataagatgagccgggaaaaaatttatcacttgcgggcattgggaacggatgtacgtctgacccgttctgatgttggcaaagggcatcctgagtattatcaggactacgcgctgcgtttgtcgaaggaaatcagtggtgcctattatatcgatcagttcaacaattcctctaattcactggctcatgccacgacgacaggccccgaaatctggcaacagatggagcataacgtggatgctgtggtggttggtgtaggttctggcggtacgcttggcggtttgagtcaatacttcagagaagtctctcccgatacagaatttgttctcgctgatccgaaagggtcaattctggcagattatgttgagtacggccgttacgatgaagccggaagttggtttgtggaaggtattggtgaagactttatcccgccgctcggggatttttctcaagttcagaatgcctatcggattactgatgcagaagccttttccagcgccagagatttgctcctgcaagagggcattctggcgggttcatcttcgggaactttactggccgccgctctacgttattgccgcgcccagaagacgccaaaacgggtggtgacgttagcctgtgacagtggtaacaaatatctgtctaagatgtttaatgattactggttattggagcaagggttacgttcacagccacaagagaatgatttgagtgattacattacctatcgttatcgggagggtgcaacagtttcagtttcgccgcaggatactttgcaaatcgctcatggccgaatgcgcctgtatgacatttcacagttgcctgtgctcgaaaatgaacaggttgtgggcatcattgatgaatgggatttaatgcatgccattcactcagattctaataatttttctttgccagtcagcaaggcaatgacgggtcaagttaataccctcaataaaaaggctccactggagcagttgactgcaacttttgatgcgggtcatgtggctttgattgtggatgataacaatcgttttctgggtctcgttacccgtactgacgtgctgaatgcatggcgccaacaactcaattgatttctcaggaataatttaatgactacaactaagtttgatacaaaaagcgttcatgcaggctatgtccccgatcataccggcgctgtcatgcccgcaatttatgccacttccacttatgcacaacctgctcccggccagcatacaggctatgagtactctcgcagtggtaacccaacccgcgatgccctggagagtgctattgctgaattggaaaacggtacgcgtggctatgcttttggttcagggctggccgccagctctactattttagagctactggataaagacagtcacattattgccgtagatgatctgtatggcgggacttaccggttattggaaaaagtccgtcgccggacggctggcctgcgtgttacgtatgttgaagcggggaatactgctgcactggaagccgccattgagcctgatacaaaaatgatttgggtggagacaccaaccaatccactgctgaaactggctgatctggctgccattgctcagatcgcccagcgtcataagattatcagcgtagcggacaatacttttgcatctccctatatccagcgccctcttgatttaggttttgacattgttgttcactcagcaaccaaatatctgaatggtcattctgatgttgtcgcgggtcttgccgtggtgggaagcaatgctgaactggcggaacaggttgctttcctgcaaaactccattggtggcattctcgatcctttcagcagttttcttgtcctgcgtggtatacggacgttggcactgcgtatggagcgccatatcgataatgcagagaagattgcacattggctggagcagcaacctcaaatagagaaagtattttatccgggtctggcttcccatcctcagcatgaattagcaaaacgtcagatgcagggttttggtggcatgatttccgtggtattgaaaggcgatgatgactatatacgccgagtgattaaggaactgaaattatttacgctggcagaaagtcttggcggagtagaaagtttgattggccagccatttacgatgacccatgcttcgattccactggaaaaacgtctggcatcaggtattacaccccaattgatccgtatttcagtcggtattgaaaattcagaagatttgattgccgattttgctcaggcgctagaaaaagccagtctgtaacaaaaataagataatgaaaaacagaatgccagccgttatccttcggttggcattctgtgctgctcttttttagcgattgtcttattgccttctgctgtaaattatccctaaatatccacttgaggataaggtattattcctgctgaataaggcaaaaaaactgacgtcagatacccagtgaaaagaggatgatgtgttatggcaattttaaatatactcacgatccctgatgaaagattgagacaaaaatgtattgatgtcacgcatgttgatgaaatacaaacactgattgatgacatgttggatacaatgtatgacacagataatggcattggcttggctgcaccgcaggttggccgaaaagaagccgttctgatcattgatatctcacctaatcgggatcagccaatggtgttagtcaatcccaagattgttgaaaaagagcgtcgggtcgtgaatcaagaaggatgtctgtctatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtataaacgtcatttcatcgctatatttccctcgaagcgcttcgcataaatcaattaaccgcctttttatctccccatgaatcaaagatattcagttgcaggaacacacaccaatacggcaataagacaatgacaacaaagaatggaggaagtattaatggacagtctggatttacactactggaattactgatagctatggccttaatttcaattagcctatcatgggggttatatcattgggggcaatatcaaaaccgcctgcgtttacagtcagcagtacagaatgtattgtcttttatggaaaggcaacaagggttggcaaattatatgaatcaggagcgtacattgtggctggtaatagggcaaacgtggtgtctgatttcttcggtatccaggatatctgattgccgcgagggggagggagagcgagtcaactcaccttatgacgatgtatttttggcatcagcaaccagtgatcgcgttgatttttatggtgtcagaaacaccgctatgccagccagttttgtgctggcaaattcagcaggagagattagcgtcgtgatttcaggacgtggaagaatcagaacatgcagcaataatattagccaacttcctaattgtgagggaataaaaggttcatgacattggttataccccttttaaagagaaaacagaccggattctccttacttgaagtcatggttgccatgttgatcagtagtgtgatttttatcgccatgacaaaaacttatccggttttatcaggtcagatcctcgaactataccggaaatatcgcctccattatctggtaaatagaactatttatatgatggaaaaagatctcaggcgtgcgggttattgtcgggacagaaaacaatgtgaaggtgagccattactgattaacaataaaaatacagaagctgctgattcctgttttattgttgcttttgaccttaatttaaataaccaatgggaaaaacccgatcatattgaatcggagttttttggttatcgattaaataatcatgccctcgaatggaaaagaggcgtggagaattgtcagggaaatggttgggaaagattgtttgatccaacggaggttatggttgatatttttcaccttgaaaaattacaggcaaaaaatgggctgacttttattacgttgtccattaatacccgctggcttaaatctccgtccattatatatcgtcaccaaatgacagttcgcctacgtaatataaggaaataatcgggtggatgggcagcggggcaatattttgctggtatcgatactcatgttaatggcactgagcttaatgatgttgaaagcactccattatcaacaagagagtgccatgctcatgatgatggatgagaaaaagtacctgaacgcttttcagcgggcagaatcatcgctggaatggggaaaggtgcagtcatggcaatttaatatgcaggaaaaggaaaactggttttgccagcaacagccggaatttcatttgcaaagctgccttaaacactatgcggataatctttttctattaaagggggtggctcagttcgcgtcaggggaaactcttgaactttatcaatggatgaaacagatgaaaaaagcaaatagagatacacttattcctattgaaagtggttggctggatttctgccctgttccgcaggctgaattttgtttatgaaacgattccatctccatcgacacaagcggcaaaatggtatgagtttgccggaagttatgttggcatctgtcgtgtttgcgatctctttgttgggcttaatgcgttaccatcaggcactgtcatcaaattttcagcagtactggttgcagcttaaggcggtaagattggcgcatgaccaattggaacaatacgagcggttggaagggcagatggtgttggaggaaactgaatcacagcaagggtggaaaatcgaacttcaacgggaatttcgttctttgggatgctatcaagtcactgttcatgtgacaaaaagttataatcaatctaataaattagatcgctggttttgtgcaagtgggagtattgatgtttagagtttatcattcaaatcaactcgatattcttaaggagttgatggcaatatttatcggggaaaatccccttaccaacccatttggcaaagaagtggttctagtgcaaagccccggcatgtcacagtggctgcaaatccaactggcagaaaaactgggagttgccgcgaacatggaatttccactgccggctacttttatctggcagatgtttacgcaggtattacctgatgttcctaaagatggctcattcagtaaggatgccatgaaatggaaattgatgacgctgttacccggcttgttgacagagcctgatttttcatctctcaggcactatctcgaccaagatatcgataaacgtaagatccaccagctggcaggccgagttgccgatttgtttgaccaatatctggtttatcgcccccaatggctggaaagctgggaaagcgatcagtcaattgatggattaagtgatacccaagcttggcaaaaaagattatggcttgaactgacagaatatactcgtcagctagaacaaccactgtggcaccgcgctaacttatatcatagatttatttcaactttgcaagaaggtcgttttccactggaaaagctgcctgcacgggtatttatctgtgggatatctacgttacctcctgcttatctgcaaatatttaaggcattggggcaacatatcgatattcacctgatgttcactaatccctgcctgtactattggggggatatccagagttatgcctttctggccaagttaaatagccgtaaaccaaaacattatcaaagccagcagtcattggaacgatttagagatccggaaaatgcgtcatctcttttcaatgatgagggagagcagagcctgaacaatcccttgttggcgtcatgggggaaattaggcagggataacctctacctgctatcgcagttggaacctgactctgatgttcatgcttttgttgaactggagccgagttgtatcctgcatcaaatccagcgggatatgctgaatcttgaagatcacgctcaaattggctccacggaacactctttcaaaaatagcctaaaaaaacgtcagattgatggtaaagaccgctcgctatcttttcattcatgtcatagcccccagagagaggtggaagttttgcaggatcagatcctgcgtcttttggatgatgatccctcactgacaccacgagacattatcgtgatgatggcggatatcgacagttatactccctatattcaggcggttttcggcaatgcaccggaggagcgctatatcccctttgcgatttctgatcgtaaagcccgtcaggctcaccccgttttgcaggcttttattaccttactagagctgccgcagagtcgttttacggcggagcaggtactggcattactggaagtgcctgcattggccagcaaatttgccattcaggaagacggattgcgtctgttacgacgctgggtgaaagaatcagggatttgctgggggttggatgacgacaacatagaagcactgtcgttgcctgctaccggacagaacacgtggcgttttggtttaacacgtatgctattggggtatgctatggacagccatgcaggcccatggaatgacgttttgccttatgatgaatccagtggtcttgccgcagaactggcgggacaactggcggaatttttaatggagctgaaccgctggcgtaaaattctgagtgaagatcagaggctgtcgggttggctggcagtatgtccgcagctgttggaaactttctttgatgcggatgaggaaacagaactggtattggcattgatcactcagcagtggcagaaagtcattgataatggtctgaatgctcattacagcgagagtgtccctttggtgctgttgcgtgatgaattggtgctgcgttttgatgatgagaagatcagtcagcgttttctcgctggttcgttgaacttctgtactcttatgcccatgcgttccattccttttaaagttgtctgcctgctgggaatgaatgatggcgtttatccacgaactattccgccactcgggttcgatctgatggcagaaaaaagccagcggggagataggaagcgtcgcgatgatgaccgttatctttttctggaagccctgatttcggcagaaacgtgcctttatattagttatatcggtaaatcaattcgtgatgatacagagtgtaatccttctgtactggtcagtgagttactggattatgtctgccagagctgttgcttgccgggagatgagatgctgaatgttgatgacagcgcaagaaaagttagaaatcacctgctgttacagcatactcgtgttccttttgcgatggaaaacttcgtgcctgatcattatcagcaaagttatgccgcagaatggttgccggcagccagtcagcaaggtgcttcccccatcgatttttgccagccggttgagtttgagaccagtgagataaaggaagtggcactcgatgaactgatccgtttttaccgttaccccgtcagggcattttttcagcgtcggctgaaagtgcatttcatcattgaagagacggaactgcctgaagaagaacctttcgtactcgatcatctgcaacgttatcaatttaaccaattgttgttgagtatcttgctagaagaaggatcacctgaatctctgttttatcatctccgcgcatcgggaggtttgccacatggggcgtttggtgaggtttactggctgaatcaattagaagctatgcagccactggcaaataagattcgggaagagagaacggagtcttctttcatagagttacaccatgagttagatactgtggtattgactggaaaaatccatcaggtgcagcccgatggaattttacgttggcgtccagcgaacttaatggctaatgatggtatccaactatggattgaacatcttgcctattgtttttcaggcaacaatggtgagagccgaatgtatggaagggaaaacagcgagtggcgtttttcaccattgacatcggatgaggcaaaaaaatacctgaatcagatggttgctggttattttcagggcatgtctgaaccactccctttgttttgccgaagcggttgggcatggctggatgattgctttgacagagagagccagaaaatcaatttcagtgaggaagctcagcaaaaagctgaaaacaaactgatgcagcaatggctgggaacacagggaaaaagtggagaaagcagtgatgcttacgtccaacgagcatttaggcaagttgatcaattattttgggtgcgtatgaaacgcgaagtacagagttatttgttgcctatggcttgtcatttaagtcgttcttcatctaaataaatagggaaaatattgggttatgcctaaatatattattcgcatcatgacgatgctttttctgctcttttggggaaccacagcgtatgcaaagttgccttggcagcctttgcctgaaactattaataaaagtgaacgagatcttcgtcaatataaagccatccaattacccaatggcatgacggttttactggtttctgatgagaaggccattaaatcattggctgccatttcagttccggttggccatatggaaaatcctgataaccagcttggtctggctcattatttggagcatatggtgctcatgggctccaagcgataccctcaatctggggggttcaccgagtttttgcagaagcacggtggaagtcacaatgccagcacttcaagcaatcgtaccgcattttatctggaagttgagaatggttcactgacagaagcgacagaacgccttagcgatgctcttgctgaaccgcttcttgatccggttaacgccgatcgtgagcgtcatgccattgataacgaaatgaccattgcccgtgctggtgagggtcatcgcatatggcaggtccgctctgaaacgctcaatcctgcgcatcccaatgcccgttttggtggtggaaaccttgaaacgctgaaagataagcccgacagtaaattacaggccgcactcattgatttttaccagcgctattactctgccaatctgatgaaaggggtgttgtatggtcagcaaccgatcgacaaactggctcatattgcggtagaaacctttggccggattccgaacagacaggcttcagtccccgctattacggttccggcgataacggataaagaaaaaggcatcattatccattatgtgccttcgaagccttacaaatcgttacaactggaattcagcattgctgacaacagcgcggattttcgcagtaaaacagatgcctatctgggatatctgattggtaatcgtagtgcgaacacgctgtctgactggctgcaaaaacagggattggctgagggcatcagtgccagcgccagcccgacgacagatggtaactcaggaacgtttggcatttatgtctcattaacggacaaagggcttgagcagcgtgatcgggttattgcggccatcttctcttacattaatctgttaaagcaaaagggcattgaaaagagctattttgatgaaatggctaaagtgctcaatttatcattcgagtatgcgtcaatcgtgcggaatatgggctacattcagtggttgtctgatgttatgcaggatatccctgtttcccatgtactggacgccggctatcttgcggacgaatacaacccacaagctatcttcagccgtctggctgaactgacacctgaaaatgcgcgtatttggtttactggcccgaaagagccacataacaaggaagcttactttgttcatgcgccctatcaggtcaataaaatcacaccacaacagcggacggaatggcggaaactcgaaaaagaggtttcgctctccttgccagaactgaatccgtatattcctgatgatttatctttgattaaggcatcaggcagtcaaaaacaccctaaaatgattttagagcagccaaatgttcgtttgctctatatgcagagccaatattttatggatgaacccaagtccatcatcacattgaatatgcgtaatgcggatggaatgagtcatgccaaagatcaggttacttattcgttattggcctatttgagtgatatgggattggatcagctgggctatcaggcatctgtaggtggcatgggattaacattagggtattcagaaggcctgcaaattggggtgagtggttatactcagcacttgtctgaactgttaacttcggccatcagccagtacattgcgttcacacccactcaggaagagctgaatcaggcaaaatcgcgctatcgtgaccaagtggaagccgtcaataatggcaaggcttatgaaatggcgacacaccccgtctcccgtctttctcgtgtgccttattttgagcagactgaccgtttgaaagctttggataccatcacgattgacgatattgttaaataccgtcagagaatgattcagcattcggctttacaggcgggaattttcggtaatttaacagaaaagcagagtatcgatatcgttaagtcggcacataagcaactcgcgaatcaggggactacgtggtggagtggcgaccatatcgtggttgatcgtgattatgcggtgaattttaaaggaactgccagcagtaccgataatgcactgtctgaagtctatattccaacgggatatgaccgaatcaatggttatatttattccaacctgttagggcgtattttgtcaccctggttctttgaacaactcagaacatcggaacaattgggctatgttgcttctgctttcaacaccagcgtgggtgaacaatcgggattgggcttcctgttgcagagtaacagcaagcaacccgattacctgcatcaacgctatcagagcttttatcaacaggccgcaaaaaaattacaggcaatgcctgatgctgattttgaacagtataaaaaagcgttactgacagaaatgcggcagccaccagaaactttttatgcagaagcatcccattataattatgattttgggagtaataacttcaaatttgatacacacgaaaaaaccattgccgctacggagaaagtgactaaggcacaactaattgctttttatgataaagcggtgataaagcgtcaaggattggcactgatttcccaaattaccggtaaaaaaggggcagctcatcaatatgctgagctgaaaggctggaaaacttactctaacgtgtcagatttccagaaacagttgccggttaaggtgaatgctcagtgagcacagaaatactaaaccataaacttaacccattaacactgccgctgcatggtcagcggctgattgaggcttcagcgggaacaggtaaaacctacacgataggtttgctctatcttcgtctgttactcggattaggcggtgatgccgcctttttccgcccgctgaatgtcgaagaaatccttgttgtcacctttactgaagcggcaacggatgaattgcgtggacgtatccgcgaaaatatccatcagcttcgtttggcgtgtattcgcgaagggacggaggaaagtgatcctgtttatcagcaattgctggatcaaattcctgacagagcaagtgctgccagttggcttctggctgctgaacgtcaaatggacgaagcggcaatttatactattcatggtttttgccagcgaatgctggtgcacaatgcctttgaatccggtgttctgtttgaccaaacgttgattcaggatgaatacccgctacgcaaacaaggctgtgccgatttttggcggcgtcactgttatccgctctcgttgtcaatggcgacagtgatcaatcaagaatggagtgggccagaggcactgcttaaggatgtttcctctcatctgcaaggagatatgccttatatcgtcaatccgcctgacagtgatgaaaccctgattggccgtcatgaaaagatcattagtctgattgatacagtcaagcatcggtggagagatgtagcaccggatttacacgatctcattgccaattctgatgtcgataagcgtagttacagtaaaaaacacttacccaactggctgaacagtgtttctgaatgggctgaatcgcagaccagagattatcagcttcccaaagaattggacaaattcagtcagtcacgattggcggaaaagaccaaaaagggagagactcctcagcatccggtgtttactgccatcgacgatttatatcaacaaccgctaacactacgggatatcatcatctctaaggcgattgttgaaatacgtcagtccgtcaatcaggaaaagttgatgcgcggacatatgggatttgatgacttattgacgcggctggacagcgccttacaacgagaagggggaaagcagcttgcgacgactatccggcagcgttatcccgttgccatgatcgatgagtttcaggatactgacccgcagcaataccgcatttttcaagccatatattgtgatcaaccggaaaatgagcagcgggaaaatggcttgatgtttatcggcgatcccaagcaagcgatttatgcgttccgtggtgcggatatttttacctatattcgggcgcgttcccaagtcagtgctcattacacactggaaaccaactggcgctcttctgtgccaatggtgcaagccgtcaataaactgttttcccacacagagcgccccttcctgttcagccaaattccgtttattaatgtgaaagcagcggaaaaaaaccataatctgagattcttgttccaccatcaggagcaggctgctttacagttttggttacagcccggagagggggttgccaaagggggatatgaacagagcatggcgcggcactgtgctgcccaaattcgggattggttgctggctgggcaacaagggcaggcacttttgcagcaggcagaaaaaagccagcccgtcacggcggcagatattaccgtgctggtgcggaaccgccgcgaagcagcaatgatccgcgatgaattgaatgcgctcaagataccgtcggtgtttctttccaaccgtgatagtgtatttgatacgccggaagcaaaggatttgctttggctgttacaagcggtgctatcaccggagaaggaacgtgaactccggagcgcattggccagtagtttgtttggcctgagtgcacagcaaattgatcagctgaatcacgatgaaactgcatgggatcatctggtggatgaattttccggttatgcccggttatggcgctcccgtggggtgttgccgatgttgcgggcggtcatggtgaaataccaggttgcagaaaatctactggccgggtatgacggtgagcgccggctgactgatgtcatgcacattggcgagttgttgcaggaaacatcgctgcaattggatagcgaacatgcagtagttcgctggctggcacaacagatttcccgtcctgacccacaatcagaaacccagcagatgcggctggaaagtgataaacatctggtgcagatatgtaccatccataaatcaaaaggattggaatacccactggtttgtctgccattcatatgtagtttcaggaaacaggaacaggcgatttaccatgatcgtcagagttttgagactcacttcagtatcttccaggatgatgaaaagaaggcactggcagatgaagaacgattggcagaagatttgcgtctgctctatgttgccttaacacggtcgatttatcactgtagtgtcggggttgcaccactgattcaaggcaataagaaaaaagcaggcaatacggatttacacttatctgcccttggttatttgttgcagaaagggcagcaaggtgatgcgcaattgctggcagatagcctcaatgaactcagtaatgatgatattcaggtcacactgatggaggaaactgatgatgtgcagtggtgttcgcaaaataacaatgactcattgctggcggccagaaaattccggcgttccattcaggatgattggcgggtaaccagttattctggcttgcagtattcctcttcgcactctatttcccatgcttataccagcgcgtttggagaatcggtggatgtcattgtgcagtcgattgccccgaaactggatattgatgctcgtggcgaaaagcaggaggaaccttcatcgcagatgacaccacatacttttcctcgcggggcatctgctggtaccttcttacatagcatcttggaagatctcgacttcagcgagctacctgagcaggtgtggctggcagaaaaattaacggcagccgggtttgatgagaactgggcgccagtattgcagcagtggatagcggattttgttaccgcagagctggatgagcagggaatacaacttgccaatgttcctcgtcatcagcaacaaagtgaaatgcaattttatttacctgtcgataagctgctgcattcacatgcattgagtgcattgacccgccgttatgatccgttgtctgcacaatgtgcacctttatcctttcatcaggttaagggcatgttgaaagggtttattgatttagttttctgctggcagggtaagttttatgtggtggactacaagtcaaactggctgggggagagcagtcagtcatacactcaggaagccatggccaaagccatgatagaacatcggtacgatttgcagtatcagctttatacgttggcgttacatcgttatttgcgtcaccgattggtgaattacgattatcagcagcattttgggggagttatctacctgtttctgcgcgggattgataaggctaatccaggacatggtgtttatcgttatttgccctccattgaatttgttgatgaactggataggcttttcagtgcggctggcgaggagcagggcgtatgagtgacatgaaattattgttgcagcaagccgttgcccaaaaattactgcgcccgctggatgtgcagtttgcttatgcaatgattgaaaacggagatcctctgttattgctgattacggcattggtgagtgcggaatcaggagcagggcatgtctgcctgccattagagcggatctcgcctgaatatttatttgaggggcggcagcctgaattagcagcatcgctctggttttcggcggggaaaccaaatcagcagcaagttatttcagcgttacaagcatgttctgcagtgagcactggcgaatctcccgcaccgatcattctttcccgccacgctcttgctgattatcgcctttacatgcaacgcatgtggcaaagtgagcgtcgggtcgcggagttttttgcgtcggtagaattatctgacgatattgatgaagtgcaattacatcgcattttggatgaactttttggtgtcaccgctgaaggggaaatagactggcagaaagtggcggcggcagttgctgtaaccagccgtatttccgttatctctggcgggccagggacaggaaaaacgacgacggtagctaagttgctggccgccttgatcaaactgaatgaaggcagaacactgagtattcaattggccgcacccactggtaaagcggccgccagattgactgaatcgctgagtgaggcagtcaataaactggctttaacatcacaacaatcgaatagcattcctgagcaggcacaaacaattcatcgcctgttgggagcgcagccagatagccagaaactgcgttatcaccgcgataatccgctatctcttgatattttgatcatcgatgaagcctcaatggtggacttaccgatgatggcacgtttgatagaagccctgccaccacgggcaaaagtgatttttctgggggataaagatcagttggcctcggttgaagcgggagccgtattgggggacatctgccgcttcgctgaacaaggttatagtgccaagcgtgccgaacaattgagtcagttgacaggctgtcagctaacatcgtattcaatgcctgattctggagaacatacactggcagtccgggattgcttatgtctgttacgtaaaagctatcgtttcaactcggcttcgggtatcgggcaattagcatcggcggttaatcaaggcaatagtgccggggtatctgccgtcttgggtcagtctttgcctgatgttcacttcaatcctcttgcaggagatgaagattatcagcgtttattgatgcaaactgcagaaggttattaccgttatttagcgatggtgaacgaacaagcatctgacaaagacattttggcagagtttaaccgtttcaggttgttgtgtgctttgagggaagggccgtttggtgtaagcggcttgaaccagcgggtagagcaattgttacatcgtaaaggcgttatttctctgcccagaagtgcggagagcgggggttatgccggacgtcccattatgatcttacgcaacgatagtacactggggctatttaatggtgacattggtattatgctcaggaataaggataatgagctgaaagcccattttcagctatctgatgggacgataaagccatttcagccgagccgattgcctcagcatgaaacggcctatgtgatgactgtccataaatcccaaggttctgagtttgaacacaccgcgttagtcttgccgactcaattctcgccagttgtcagccgggaactggtgtacacagccttaacccgtgcccgtgaaaaattgacgctttacgcacataaaccggttctggataaggcggtgagtacatcaacacagcggcgtagtggcttggcagaatggctcaagccaaagggagagtgtcaatcaggtcagtaaacctctaaatttaacatcaagattttcgaacagcgctggtagttatacagcgcttgtttttccacaggaagcatattgatttcagcaggttcaaagcctttttcctgaaaccagtggatactgcgggttgtgagtacgaatagtttctccagccctgcctgtctggcctgaccagcgatggaattcagtaatacttcgcctcgggaagagttccggtagtttggatgaaccgcaacacaagccatttcaccaattttttcgtcagggtaagaatagagcgcagcgcaggcgatcgttacattatcgtgctctatcagagtgaacttatcaatttccatttccagttgttcccgtgagcggcgaactaagatacctgtctgttccaatggacgaataagctcaagaatgcccccaatatcattgatattggctcgccggatctgttcggagcgctccatgactatctgggttccactgccttcacgggagaataattcctgaaccagtgagccattttcctgatagctgatcaaatggctacgacgaaccccacgacggcaggctttgatagctcctcttaagaagcgggcggtacctgaagaataatctccctcacttcccagctcatttagccgtgcttctccctcattgggaacaatttccgacaggatattcccctctgcatcaagtacgccctgtgatgagcaaaacccgatcaatttttcggcttttaatttaatcgccaattgtgaggctatatcttcggacgtcaggttgaaactctcacctgtgacggaaacggctacgggcccaattaatacaatggcatggttatccaactgctggttaatggcctcctcgtcaatacggcggatcctgccactatgacagtaatcaatgccatcatcgacacctagtggctgggcgataataaagttaccgctgataacgttaatattggcaccttgcaatggtgtattgctgaggctcatggaaagacgagccgtaatatcaagctgtagcagacctgcggactgtttgaccagctccagtgtcttggcatccgtaactctgatgtgcttgtgataaattggctggctatggtattcggcaagcttttggtcgatttggggacgagcgccatacacgacgatcaaacggatgcccagattatgcagtaggccgatgtcattaacgatatttggaaaattctcgtgggcgatagcctcaccgtccaacataatgacaaaggttttgccttgatgtgcatttatatacggaactgaatgccggaaaacttcaaccaattcggtacagcgttctttcatgaaactctccagatgaattcttattcatgatttttgtatttttattcttttttgtcaaaaatggcaagagggaatatggataaaaataacaatattatttatatttatattgatattaataaattgagagaacgtaaaatgttttttttgatgacagccactcgctaattaattagagtttgccgcctgacagtcttttttggcaagattaccgcgtttggttgtttttaaatggaataaacaatgagtcattcagaccataatccttcacgtcgcaatttgttgaaaggcgcagcagccatgtggttgttgagcattagctcaataggacacgcagcaacgtcaaaaattattgctgttcgtatttggcctgcatcaagttataccagagtgacactggaggctaatattctacttaaatatcgtcaattctctctttcaaaccctaaccggattgtcatcgatttgcagggtgttcagcttaatagtgccctgagcggtatggggtcgcagattcatcagcgagacccctacttaaaattggtacgagtcgggcaatttaatcccaaaaccgtgcgcctggtgtttgaaattaagcagccagttgccccacatatttttacactaccacctattgcgaaattcaaacatcgtctggtgttagatctttatccgagcaaggcggcaaatgtggaggatgatcccttgcaagcgttgttggaagaatacaacagcggggatttggagaaaaatctgcctgctgaaaagcgaaaaccggggcggccgggcaagaacagaccgattgttattatgcttgatccggggcatggcggtgaagattcaggtgccatcgggaaatacaagacccgtgagaaagatgtagtgttacagattgcccgtcgcctgcaagcacttatcaaacgtgaacccggcatgaaagtatacatgacgcgtaatgaggatgttttcattccattgcaggtcagggtagcgaaagcacgtaagatgcaggcggatttatttgtttctattcatgcggatgcgtttaccaatcgagccgcacggggatcttccgtgttcgcgttatcaaccaaaggagcaaccagtaataccgctcgttttctggcacagacccagaatgagtctgacttgattggtggagtcagcaaaagtggtgatgaatatctggatcatactatgttggatttggttcaaaccgcgacgattaatgatagcctcaaatttggcagtgaagtgctcaaacggattggcaaggttaataaactgcataaaaatagtatcgatcaggcgggatttgcagtattgaaagcaccggatattccgtccattctggttgaaacggcatttatcagtaatctggaagaagaacgcaaattgaaaacggcgaaattccagcaacaagtggcggaatccatttttgcaggtattaaggcttattttaaaagtggtgtagagctggcacggcggtgaaatacccgcttttaatcaatgcgaataaaacaaacagaattaaaaaataaagggaaaattgggaaatacagggaagtgagatcgtgaaaaatacgaaagaaaagttggttgcgggggccggatttgaaccgacgaccttcgggttatgagcccgacgagctaccaggctgctccaccccgcgtccgtctactacttataaatactgaatgataacattctttggtgttaaaccctgccgatgtgacatcgataggattggttgcgggggccggatttgaaccgacgaccttcgggttatgagcccgacgagctaccaggctgctccaccccgcgtccgtctactacttacaaatactgaatgataacattctttggtactaaaccctgccgatgtgacatcgtataggattggttgcgggggccggatttgaaccgacgaccttcgggttatgagcccgacgagctaccaggctgctccaccccgcgtctgatgtcggcacactatacgcaggttcggcgctgttgcaagttttttgttgatatttaccgaacttatttcttgtatgattaaaaatagcactatttgtcgtgtttttgttcattcatggggttatggaacagtaatctattttttcttaacgacattttattatttaccggggtttgatattgttcgtcgtcgaatcataatgacaggagataaggtataatatgaaactttggggcaaatatcttttatggggatttgtcatttcgttattatcgggttgccagatgcgtcctacagatcaagggcagcagtataaagatgggcgcattagcgaagatctccagcttgttaatattccaaatgcacaaggctctcctaccaacgccggagattttcaggcacaagtcaaatttatcagcaaatcttctcctcggctctatgggaataatcgtgcaacgcttgatgctatccagaattggatgctgtctggtggagatccccgcgaattaaaccagtatgggttgctggcctatcagatggacggtgacgataattacggtaatgttaagtttaccggctattacacaccagttttgcaggcacgccatgttaagcagggcgaatttaaatatcctttgtaccgaatgccaggtaagtcacgtctccgtctgccaaaccgtgcagctatatataatggagctttgagtgaaaaattgatcatagggtacactaattccctgattgataattttttgatggaagtgcaggggagtggttatatcgattttggtgatggcagtccattgacctttttcggttatagcgggaagaatggccatgcttatcagagtatcggcaagatacttgttaaccgaggagaagtacctcttgaggaaatgtcactgaaagctattcgccagtgggtatctcaacataatgaatcagaggtacgagagctgctggaacagaatccctcttttgttttctttaagcccgaaccctttacgcccgtgcggggagccagtgctgtgccccttgtcgcggaagcatcggtagcatcggataaagcattaattccacccggaacggcgttattagcggaagtgccggtgttggataaaacaggaaaatttaccggccagtatcggatgcgtctgatggtggcattggatgttggaggcgcaataaaaggcaaccatttcgatatctatcatggtgtgggtcatgatgctggagaaacagctggtttttataatcactatggtcgtgtctgggtattgaagaaatcgtcgtctggctttttgacggcaaaccagtaagatccagcccagttaaaacaattgataaattatttctatgggataggtcttagagccgatcccattaattacgcctactgagataggctctgattcaggatttatttagtgatgcaagtttctctctctgatgcttatcttcagcgttttgctggtactgcgcggttatatggccagaaagcactgtcattatttgcccgttcacatgtctgtgtcgttggcattggcggtgttggctcatgggcggcggaagctctggctcgcacaggtattggggcaatcacgctgattgatatggatgatgtctgtatcaccaatactaaccgccagttgcatgcactggtacagaatgtaggattgtcaaaaaccgaggtgattgctgaacggatacgggcaatcaacccggagtgccaagtcacctgcattgatgattttgtgacccccgataatgtggctgagttggtgtcggctgagttcagttatgtaattgatgccattgacagtgtgcgtccaaaagcggcgttgctggcttattgccgccgctataaaattccgattgttacgacgggcggggctggggggcagcttgaccctgctcagattcaggtggtggatctggcgaaaacggtgcaagatccgctggcggctaaattgaaagaacgcctgaaatctgactatcgcgtggtgaaaaacggcaagggtaaattgggaattgactgtgtattctcaacggaacaattggtttacccgcaatctgacggtacggtctgtgctgccaaaaacacggcggatggttcgaagcggatggattgtgcgtccggttttggtgccgcaacgatggtcacggcaacgtttgggtttattgccgtgtctcacgcactgaaaaagatggtggcaaaagccgagcgggaaaacagactttaaaacttaggttaaggtaagaatttaagacaaatgtgaacgggcaatcacttgaacggtgttgatcagggatttgatcccattaagtcgtgaaccactcagttgttgttcaagacctatatgctgaaataactcagataagggtgcctgtaaaacttgttccgctgtttttccttctacagcagtcaaaagtaccgctaataagcctttgacgatacggccttcgctatcgccataaaaatgcaaacagccgtcagagcgtaactggtgccctaaccagacacggttttcacagccggacatttcaatgttctgctgtttcagttcatccgctaatggaggcagttttttggccagtccgataagctgccgatagcgatcttcccataactggcattgctgaaaattttcaataagttgttgctccgatatctccgttccaaacggatgcggggcaaggattgaatctgaaattgatgtcatcggttatttatcttgcaatggtatttagtggatattttatttgcctagcttattcttccagtagcgacagggcaaatttcacagcactgaccagcttatccacatcctgctgattattataaggcataaaagaagcacgtaggcagccgctgacccctagggcatctaaaaggggctgtgcgcagtgctggcctgaacgcagagaaatattctgttcagcaatcagcgtcgccaaatcattgtgatgtatcccttggatattgaaggccagcaaactggcatcgccatcgcggtagctgataaaccctgtcagagtactgagctgctgttcggcatagtcagtcagggtaacggcatgggattcagcgagcggaatatcaacggtttttaaccattccagcgtagcggcaaagccaaccacgcccgcgacattcggtgttcccgcttcaaagcgataaggaacggcttctggtgtgaaaccgttgaaagatacctgagtcagcatttttccaccgccctgccacggtgacattacatccagcaattcccctttgccatacaatactcccagaccattagggccatacagtttatgggcagagaaggtataaaaatcgatacccagccgctgtacatcaacgggagtgtgaacaatgccttgagcgccatcgaccaaaaccaggcaatcatactggtgggcgagtgtcgagacctgtgccagatcgactgtggtgccagtgacattcgacatttggctgatggcaactagccggcttttttcatttagcagtgtcgcgagagtattgatgtccggccgattctgattgcctattggccacttaacgattctggctcctgtttgttccgccaaaatcagccacggcagcaggttggagtggtgttcctgttcgctgattataatttcatcaccaacattcaggcgagggcgaaaatagccttgagcggtcaggttaatggattcgctggtgccttttgtccagatgatattttcaggccgcggggcgttgatcaattccgccaccagcgaacgagcttgctcataacgagccgtcatggcctgtgcgcttgcgtgttggctccgatgaaccgttgcactgtggttttgataatagtgctgggttgcctcaatcatgcatataggctttagggctgtagccgcgctatccaaaaacacagtctgctgttgcagggcaggaaattgctggcgaaatttttctgagtcaaaggatttcataagcggtgttcatttcaacgttgtgtcgtaaagaataagtttttctttatatactctaagagaaacaataagttgtatatttgtcaataaattatatgacgatgagtgatggtgcgtcgaatgctatatatggccacgttaacggcaattagatttaaccccgttctttgcgctttctacaagagattgaccgaagcaggtaagccaaacaaagtcgccattgttgctcattacagaccctaatgtagcacctgttagttttatcttataatacagttccaacccaccttgcattgatgttctatagaaatgaaaactacaagtcaatctttcattattggttaaattttgagctaacagaggtgaggatttatcaatcggttttctaatatcaactggctgatagttgatattctgatctcttgtcatatcagatgaaacttcataaaccaaaatttcatctgcatggcctttttgatacttattataaatggaatctatagtagaaccccccctgaaagatcaagccctacttttcacttttaatttccaagtaaataatattttccatctttatcattccaccatttaaaattaattaaactaataaattccgttacaaaaaattttactttatagaaataccattagcttaatataagcaatagacgattaaacataaatagaagctccttttctaaatattagacttaaataacaataatgatctatgcagcaaaaactgcgtatttacgccgctaactctataaaaacattaaatcaacaacacgattaaccggataaaatcctaataatcattacactaatttactgaataaaatgaaaaatataggttattgtcagtaatgtgctagcattcgttatagaaacgaattttatgaatggtgaataatggtagccagatattgattgttctgctaatattcgtatgttttttatccagagcaataaaacgaggagaagcaaatgccctctttaatcatgaggacaactgccgtcttcgctttctttctctcattaatttttaccggtctgagttatgcttcgaccagtacctcaaaaatgaaagagtattctcacaatggcatacaggagagtttgccagatttgcgacaatatccttcaggtacaccccggaagaaagcgtttttaaacattgttgtccctgtcattgatgagcataatcaaaagattatgcaagaccgaaaatggctgctgtcacaccaggaaactcgtcactggtctgtacaggataccagtcgattgcagaagatctgcgcaagttacaaaatggcctgcacatcacctaaacaggtcaattggaataaactgctaagccgagttgacattataccgacccattttgttgctactcaggcagccgcagaatcgggctggggaacatcagaacttgccaagaaaaacaataacctgtttggtatgcgttgcaactcatgcggcaaaaccaaaggaaaaatcaaaggttattcagtttatcgcaatgttgatgattccgtcatcgcctacatgaaaaatatgaatacacaccgtgcctacgaatcacttcgtacttcacgggcaaaacagaggacagcacaaacgcctctgaataccagtaaattgatcgataacctgaacggttattccgagctgggagctcactataatcgctatttgcatcaggtatttaatggcaataaaaagctgatttcacaggcacaggaacaggaactgacagacctatagagacgggtacatttataccctgcatctcatcaagttgctgcttttgttagctgcgattatttatcgccgggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgacctatcgccgcgctgtaacttgaaatctattgggtatagattaacgtgccagaaatatcacctacgtattcgtaatgcctttcgtactgtttaatgttcaatcatgattaaataaaaaggcagtgaatctgcctatacgacaggctcctaataatccgctatgtattaattacacagtggattatttttttataatttccctgcctgctacctattgtaaacacaagtaaattccatactataatgaacctcagaatcactccctttctctcaatgataaatggttagccagagcctaatatgaatttcttttcttttgagtttcttggttcgtttgttattctgcttcttgcctattggcttttacaaaaagcccctaagctacagaatggcctattaattttagttagttatttatttatcttctcttttgcagcaaaatttgcctatatcttattcgcctataccctgttcatttactttttggcgaatattcttagtcgttatttgtccaacaaggccatattcacgcttctgattttcggtattgtgggttgttttaccgccttcaaatattattctttctttcaagaggcgatccagcaatcgttagccaatttaggcatttctgtcgagctacccatacttgagctgctgatgccattaggcttatcattttatgcctttcattccgtcagttacgtgatgtcggtttgcaagaaagaactgcctcctgctccgctgattgatgttattttgtatctctgcttttttccaagcattgtggccgggccaatcaatagagccaaagatttcctgccgcagatccagacttcatccagagtgatgctggagccattcaaagcgctgttattgattgcactggccatcgcgaagctgtttctgttcagttcgacgctctctgaaaattttgttaatccagtctttgatgaccccactggctatcatgcggggcaagtccttgtcgcgatttatgcttatgcatggaatatctatttcaacttttcaggttataccgacctcgtgacgggtattgccctgctgttaggttttaaagtgccacagaactttaatgccccttatcttgctgagaatttacaagaattttggcggcgctggcacatcagcttatcgacgtttatccgcgattacgtttacattccactgggcggtaataagaaaggtactatccgcaagaatatgaatctattctctgcaatggtcatttccggtctatggcatggcgccggattgagctttattatttggggcgccattcatgggctaggattaattttccacaatattaaaaactcactgtttccctctactgggaatcgcaataaggcacaaagaaaaaatccgatttcattatttttatcacgagtgatgacattccattttgtctgttttgcatgggtattctttcgcagcccaacatttaatgaggctctgactgtattaaaccaactattctcaggggatgtgttgacggcactgctatccagtagcactttattaatcgctttttggggattctttattatctacccttggctggtggatatcagaaacactattgaaaagaactatagactgatgtcatgggtttattacccaatccccttagctctgctactcactttggtatttatgctgtcaccttctggaatgccgggatttatctatgccaatttctgaatttacctttaatctaaaaaaagtcgggcaggtcgtttttatcgtcaccttaaccagcctgctgctgatctggctgaatcaacgttctctggagagtttctggcaacagaagtatcaccgtaatagtccgtggacaacccttaagggagagccaatgtgggatttgggcagcaatatgcagcaaggtgcaattgctgccagcgaaacatttatggcatatgcaagagggattcatcaggataataatctacaggccataaatattgatgctactccaagcatgattcttcctgattttcaggttggtttgaattttctggggggatatacgtactctatcgagagtcgctatctgacgttccctgatttgctgcaaaaagatgtccggcacactcaatcatccttattacgaaatcattcaccatcaaatgcggttaccgaaattaccccaaaaacgaatgtcagtctggggaaaaaagatcaggtactgtttgcaggggattcgatgatgcaaggggttgctccgcatttaaaacgccgtctttaccaggaacatggcatcgccagtattaatttgagcaagcagagtacaggattggcctatcccggtttctttgattggcccaaaacaatcggtgatacactaaggaaaaatccggatattaaattggttgtggtgtttttaggccccaatgatccgtgggatatgccgacaaaacgcggaggagcctatttgaaattcgcgagtgaggattgggaaaacctttatcgtcagcgaatcgaaacgattttaaatgatgctcaccagcataaggtggatgtgatttgggttggcccacccaacatgcggcagaaaaaactttccggcggcatggcttatctcaataaattgtatcaggcagaggtggcaaaaatgggtgagatctatgtttcagttaatgatatgttcaaatatcggtcggagaattattcagactatattggtgatggcagtagtacaatcaagctccgaagtggtgatggtattcatttcagtttgaatgggcagcagactatcgcgaacgctattttttcattgatgacatttattcaggagccagttaaagaagatgcaaccatttagacagttccgttggttttatcggataatgggtgcaggtttggttattgcgctttctgtgagccttttatcatgccacggcaaaaaatccaaaccctcatctgaattgcagatgacacaaatacatcggcaaaaacaactgacgaattttggcgatcccaatttaccattactggcggataaactgcgtcatagcaattcgcgccaactccatttcgtacaactgggcgattcacacactgccgccgatttttttactggtaagctgcgtagtttattgcagaatcgctatggtgatgctgggcctggttttatcagcccgatcagcattcccggccagcgcaccgctaccgttaagttcacggatgataaaaaaaactggtggctgtcgagcagccggaaagataaccgtgctgattatccgctaggcggttttattgccacacccgaaaatgtcagcagcacaatacggatgaatttatcaccctctacttttgagaagtacgggataagcgcgctttatcaatcccatgaggcaacccaaatcaggatgcagttcagccagtggaatctgccggccacacaaagcgaatggcaattttcgcaacaacacagtgtttctttcccactcagggtcgatgcacaggatacgcatttgaaaatcggcggctggctgatcaaacgccaaagctccggcattatgttatccgcgttggggattaatggcgccaccatcagtatgttggataaatggcagccacagtggatcaatacactggttcaactgaaaccggatatggtaatccttgcttatggcactaatgaagccttcaacgattcactggatcttgttgcctatcagaaggaactgacatcaaaagtgcaggaaattcgcaaggtcatgccagaagtggttatcttgctggttgggccgagtgattcgctgaaaaacaaaactgctgcaagctgtgctgaacagcaacccgctctgctcaatggcataattcaggctcagcaggccgtcgccaaacagcagcacaccctgttctggaattggcaggagtttatgggtgggtcatgttcagtcagaagctggcagcagcagaaccttgctcgtcccgactatgttcatctctccgccgcagggtatgaacgcagtgccgaagcgctttatagccagattattggtttgattgagcagtgaatgacaaagtgtggaaagcaaagacattcagtggaataaatgcagaaccgtagtttcagcagatttatccccgtaccctacggggaacacttgacaatctaatggcagatcacatgggatggcggtttatccccgtacctacggggaacactgagggaaaatcagtttccagttgtcatagttcggtttatccccgtacctacggggaacactttgtatcgatagtgaaaactcagtagggcctcggtttatccccgtacctacggggaacacatgacgttcaacatttggcggaagatctagagcggtttatccccgtacctacggggaacacgccaatgcgaccgaccaactgaaaaaagcgaaaggtttatccccgtacctacggggaacacacaacatgaactcaggcacaaatgtcgcataacggtttatccccgtacctacggggaacacttgatttcgacccgcaacccctctgaaaatgccggtttatccccgtacctacggggaacacaatggccggaacaaccgaagtaaacacaggggcggtttatccccgtacctacggggaacactatattctgccctttaacttcttcttccctgtcggtttatccccgtacctacggggaacacaaacccacgtttgatattttcctcattagtttcggtttatccccgtacctacggggaacacttccagatgagatatcccctcactacatttctcggtttatccccgtacctacggggaacacttgaacccaatcatcagacggtcattcgcctctggtttatccccgtacctacggggaacacacgttgggcgcgttcaaagtgccgtgttaggacggtttatccccgtacctacggggaacaccgtaatggcgaaacaggctgtctgggtacagacggtttatccccgtacctacggggaacaccaaaatcaaatgcattagccattatttttagccggtttatccccgtacctacggggaacactttacgcacagaaattttttctctggatgatccggtttatccccgtacctacggggaacactctaaatataaccgtctgttttaaatatattttattagacgtaaaaattctaccacgttaaatcacaaaattaaccgagggaaattctatgatttttactcaaatcacctcgccatccccacagcaaacacccatcaggttttttattgaaaaacccgaaaataaatataaaaaaaacggcattttaatcaatcagtaaaatgccgttagcgatgtttcagagaaagtttaactcagcatagcaaaatagatcatgccgataatggcacccgtagtacccaaaatagtttccataatggtccatgttttcagtgtctgtatttctgtcgcacccgtaaacttaccgaacagccagaagccagaatcgtttacatggctgagtatcaacgaaccaccagcaatacacactgacaacgccgccatttgtgcaccggaataacccagttcaccaatcactggcagtaccagacccacagtagtcagacacgctacagtagccgagccctgaatcacgcgcactgcccctgacagaataaaacatgccagcgcaattggcagaccggctcccaccaaagcattaccgagcgctggcccgacaccggaatccaccagcacttgtttgaacacgccacctgcccccgtgaccagcaggatgatccccgcaggctgaatcgccgcagagcatacttccataactctgtctttactcataccgcgacgaatcgccaagccataaatcgccaccagacaggcaattaaaatcgcggtgaaaggatggccgataaactccagccattgatacaacgttgatcgctgatcgacgaaacgtgcagcaatcgtcttcaaacccacgagtaccagcgggaataataccagtgccagactgaaaccaaaggaaggcatctgatttttaccaatgctcggtgtattcagatcctcgggtaattccagtgtcacatgtttactgatgaaattgccgtacatcgggccggccagcaacatgccggggatagcagcactcaggccaatcaggagcatccagccgaaatcggctcccatctgggaagccagcaacatcggcgtcggccccggcaccagaaacgccgcagcggctgcaacaccggcaaacagtggaattgccagtttcaccacattaccaccagtacgacgtgcaacggcaaataccacgccaatcaacagtacaaccgccacatcaaaaaacagtggcaaggcacagataagccccgcgatgcccagtgcatagttcgcgcgtttttcaccaaaacttcccagcaatttcacagcaatctggtcgagcgcccctgtttcatgcaggatcttgccaaacatagcacccagcgccaccacaacggcaaggaagcccaaagtgcctgacatgccgttttgcatggtctgggtgattttttctaatggcataccggaaaagatccccgcccccattgaaaccagtatcagcgcgataaaagcatgcattctggctttcatcaccaaaaacaatagcaggaggacagaaccgacagccgtcagcaccaaagttaatgtagtcatgaattcccctcggtaatgcagtcaattgttgtcattgtgtttttgattacttcatcaaggtctggtctgatatcaatgtgatggacatctttttcatcgtcagtcggttcttccaatacctcaaactgcgagatcagcatttggggtttgaagaagtgttccttgcgagctttcagacggctttcaattaaataaaaatccccctgcatatacagaaatgacaggtttttgttgccattacgcagcatatcccgatagttttttttcagagcagagcacacgagcaaagagatattatttgtacgctgcatggcaaaaatggcatcgttgagtgcttttaaccacggctgacgatcatcgtcattcaaagcgtggccttgtgccatcttaataatattggcgcggggatgaagaaagtcaccatccagaaacgccgcgcccagcttacgggcaaccccactggcaaccgcagatttaccgctgccggatacccccatcaatacaaaaacatgatttggctgttgggtattgctcatatcaaactcctttgtgcagattttgttacctggctatctctgtgatgtacctgcaaaatcttctctatgaaatattatctataaaatgttaccggtaacttattgtcggtaacattaccagcaacacaagatcgcgagcaattaatcaggatcggcaaaaaaggaaaatgtgaggcttatcgcaattgaagataggaaagcatcattttgatctacaaaaattaaacactttctcccaatgaaagcgtaaatccaacatcaataagggtttgttccagtttttgtccctgcaaacgggcaaatagggcttccgccgccctgcgtccgatcagatcacgcggagtcagtacactggccagttttggcatcatcacctggccaacatcatggccgtggaatccagcgacagcgatctgttccgggacattgatcccctgtcgctgacattcaaaaatcgcaccaatcgcgatatcatcattggtgcaaaacagaccatcaacatcagggtatttctgccaggtttcccgcaaaagctgcgcgccaagtgaataggacgaactggcaggcgtcatcacatttctcggctgcaaccctgcgctgcgcatcgccatttcgtacccatccaagcggatcagcgttcgttcatcctgccgcgctccgaggtagatcacgttttggcagccatgctcgatcatagccaccgtcatctgccgcgccgcctcaaaattatcgatcccgactgcaatatcaaggcagggagagacgctatccatcagttccacaaccggaatgcctgccgtctccagtaccttcaaggtcttgggcgtatgcgtccgctctgccaagatcaggccatcaatattgtaagaaagcagggaaagcaggcgctcttcttctttctgagcggaataaccgtagtgggtgagcatcgtctgataaccattacaatcagttacctgctcgatcccacgaatgacttcggcaaatacctgattagtcagtgaaggaagtaaaaccccgatcgttcggctggtagaattggaaaggatgtccggcacacggttgggaatataacccagttgatccaacgtttcagcgatccgttttcccaatgcttccgagacctgatccggattacgcaagaaacggctgaccgtcatttttgtgaccccaacgaggtctgcgacatcttgtaaaactggacgttttttcttcattttcaatataatgcaatcagctttctatattcagactaataaaaagcggttttaacacatttatacaccataacaatacgatttttagccaaaaatgctggctcactctcacctcacatagctatcgttatgagaactgtgatcgcttacccttgtctgagagaattccgataaataatttggggcgtaaattctgggggaggtgtatcaggttcgatcaataaacgagctgcgaaacacgccatgtcagtaatgggaaaatggacgctagtcagtgcaggatagacaaatgccgcccgctctccgctatcataacagatgatggaaatatcctctggcacactcagccccaactctttaatcgccagcaatgcgccgagcgccatctcttcactacagaagaacagggcatccggccgtgattttgccagaatggttcgagtttgccggtagccactttgcagatcatactccccttccagacaagcaacaggattcaatcccgcattctgcatggcatccaagaacccttgacggcgctgccggcttggattgcgtgacaaagggccactcacgcaggcaatgcgaatatgtccattctcgaccaaggtttgcgtggcgagatagctggccttgtggtgatcaaacacaacacagcggggctccagccctgccaccagacgatccagcaacacaaacgaacggccactttgagcgagttgcctcagcttatcatcactgatggcacgcacatgtaaaatcatcccgccgcagcgcagactatgcaaatgcgtaatagcctgccattcgttttcagcacgatttctcccctgcatgaccaaaagctgtttgccatgtgattcagcttccgtctggatgctatccatcaaagcaccaaagaagccgccacgataggaggtagtcactaatcccagcgtattgctctgatttgaagccagttcacgcgctgccagattggggctgtaacccaattctacgatggcattctcaactttggcacgggttgctgccttcactttgttgtcaccattaacaacacgtgacaccgtagcacgcgagacgccagaataacttgccacatcttccagtgttatcatgctttttccttgttaactccgtgctcctattcctgccagacacaacttatcgtttaaactggggcaaatacatgcggttaatctctaagatttcgttcaataatgtcgaatccaacgccacatcgccaatcaacggatgagtgaccagcgccaacagtgcgaccttgcgatcgccatggacggcggcttcgatggtcaggcgctcaaatgctttcacttgctgggtcagggctgacatactgtccggcaggtgaccaaacgccagtgggtgcgccccttgagcatcaacaatacagttggcttcgatcaccgcatcatctggcaggtcgatgatagctccccgattctccgtattgacgaccaattgcgtaccgagattattatgaatagccgagatcaattccaacgctacttcagaatagaaagatccgccacgaaaactgagctgagcgggtttgtgatccagtttaggatcggcatacaactcgaacagctcccgctccacttgcatcacctgctctgcccgtgtccctttgctcgccgcgatttctttctcttcctgtaacatcttaccggtttgatagaagtagcgatgatacgggcagggaattgcgcctaatgcctgtaaaaactccggaggccacggttcttctttgatattgttcatcgtcagctctgcgccattacacagcaattctaatacctgctcagtttcatccctgccattcactagtacctgatgtacccagaccatatgattaaggccagcaaaacgtaattgtacgtcctgatatggacgttgcagcatattggctatcatatggtgcattgagattggcacattgcataacccgatgattttggctttgctatagcgggaaaccgcttccgtgacaacgccggcaggattgctgaaattgatgatccacgcctccggcgcaaggcgttcaactttatgagcgatatccagtaacacaggaatggtacgcaatgctttggcaaacccgcctacgcctgttgtttcctgcccgagcaacccatatttcagccccagacgctcatcagcagcacgggcaggaagctgaccaacgcgcagttgagtgagtacgaaactggctcctttaatcgcttcatccggtgaataatgcgccgtgacagtaacgtgctccagatcatgacgatccagcatacggcgagtcagcgcagcgatggtttccagcttgtgccgcccggcttctacatccaccagcgccagctcagaaagcggaataatttggctacgctgaataatcccttccaccaattccggtgtataactgctcccgccgccaataacggcaattttgatcggtttcatgtcaccccctgttattctggctggcgatcttgtggcggcaagcgctgataaagatcgatcatattgctggcaagatcttgaatcaccatcgcattcatcaggtgatcctgagcatgaacagtaatcagattaatcggtaattttccgcatccttcatccaatccgatcagcttagtctgaatagcatgagcggcacgcgtttcctgtcgcgcttcttccatcaatattcctgcttgctgaaaatctcccaccttcgcctgctgtaaagccattaacgcactgctgcgcgcactgccggcatgtaccagcaattcgacgatctgttgttcaaaatcctgctgttcagaacccatattcacactgcatcctccaaggttattgctacgcctgagcgtcggcgagttttttggcctgctgctgctcttctgccaaaagctgtttttcatatactttgaagaagggataccaaatcagcagatcaatcaccatcaacagcccaaccaatacgaccgcacggtaatcccacgcggcggaaatcagcgcccccaccggcgcgggcgctgtccacggcgcaatcgcgatcatcttctgcaccagatccaaatgcagtgcaccataggccaagactgcattaatcagcggcacaaccaacaacgggatcaataacgtcggattcatcaccaccggagagccgaacagcaacggttcattgatattgaacatggcgggtacaacactcagtttgccaatggttttcaggtgaattgagcggctgcgcagatagaggaatgccaataccagcgtagaacccgagccgccgatacagacgtaaaaagaccaataaggtgcggtcaggatttgagtcgttgccattccctgtgtcatcaaggcggcattagcggcgatattcgccataaaaatgggattcagcagcccagtgacgatattgtcgccatgaataccggcgaaccacaataaattggcaatcaacaccaccagcataacagcgggcaacgtatccccgatcgcaatcaggggttcgaatatctgcatgacagccgcaggcagcagtaaattaaattcgttttgcagcagcaggctgacgggataaaccgtcagcaaaataccaaccacggggtacagtagttcaaaagagcgggcaatggcaggtggaacctgtgatggcatcttgatagaaatgttgtactttttcagcaaccggattaattccaccgaccaaatcgcacagatcagcgccgtaaatactccggttcctcccagaaaatcgagcggcattttgttatcaacctgcggagctgctgccaacagaaacgccatcaatgacagtaaggctgatgtcagtccatccagtccataagatttcgccagactataagccgtaccaatggagacaaacacactcatcaatcccatcgtcataaagaaaggcatagtgatggtttgccaatgcgctttggcgaattccagccaagcctgacccaagaaagaggtggtttgggcatcaaatggcggatttgccacaatcagcataatactgccaataatcagaaagggcatggccgagataaaaccatcacgtatcgcaataatatgccgttggctaccgatccgtccggcaatgggcgcaatatgattttctacaatacgcgttaaggaagtataaaaactcataatccactccatctgatgatgaacaggttattccagcagacttaaggcgtgatccagtaccttatcaccacgtaaggcgccgtaatccatcatctcaatcaagctgataggtttacccagtggctcagcaagagcggtaaatcgaggcagttcatacttgatttgcggccccagtaaaatcacatcggcttcattgatatacatttccaactccaatgcgggcactgctttaatggctacctccagttcccttctttccgcttccgcctgcatacgctgcaccaacatgctggtagacatccccgccgcacaacacaatagaatggttttcatgattttgttctctttgctgttgtctattatgatttcgtctaattcgaagatgagagcgctctcattttggttaaggctaacaggttatttttccgttgctgcgataaggttcgcataatagataagcaatagtttagaaaatgggcaaaatgcgagcaatgttacaaatgatcggtatggtaaaaaatacggcaggaatttggctgatttaggtggttaaaaaatggtagaattttgaaggtcaaaaaacattttataaaacagatagatgaaattagagtgttccccgtaggtacggggataaaccgacacaaatgagtatcgatttagtgcatgcacagtgttccccgtaggtacggggataaaccgtcccagttttctctgatccaatagtccttggtgtgttccccgtaggtacggggataaaccggcagaactgtcaaagaaatgtagcgccattccgtgttccccgtaggtacggggataaaccgccttgagcgacaaacatcccatcttttatggtgtgttccccgtaggtacggggataaaccgtgcagttccagactctggatggcagatttcatgtgttccccgtaggtacggggataaaccggattcatatacaggtcttaagcaccaatggcttattttagatacaaaaaaacttcatttatgatttgataatcgtcgccaaacaaatcaccaaaatcacggatgaagctgatgattgctgtaaagcaccaattaatacaactcattgatgaggattctttgcaaaagattaagttaaaaaaacaattaataacctattataaatatcttatggaatttaaacatcacctcgaacttctatattttttgacttttaattctttcttttttattaatatattcttaattaaatttattacaattaataaatttaacaacatattaataatctattttaactaaaaataatttcttgttaatattatataatacacaaagtgtttgatgtataagtataaaatacactttaacacctcaaatacaaatggcacaaaaaagaaacttatataaaaaataataaaaaattgcatgtataatgcaaggcatttaatttattaatgtcaatgatttatgttatagtcactatgaaaatattttttatttaatttcaaataaataaggagaaaatatgacacgaaaaagagggagacctctcaattttgacaaagagttggctcttaaaaaagccatggatattttctggactaaaggattcgaaggaacccaacttgtagatttaacggcagttatgggaattaatcctccgagcttctatgccgcttttggaagcaaattcaatctattttgtgaagctgtacagctttatattgaaacagtaggtaataaaacagtaaatgcactaaatgatgcaaagacaacgaaagaagggcttaaggccatgttggaaaactccataattaacgcatcttcaaatgaagcaggtggttgcttaatgataatgggagtagttaataatcgtgctgaaaattaccctgcctgggagtatttgagagaagaacgtgccaaaacccttacactgatacagttacgtattgaacgcggtattatggaaggtgatttgcccaaaaatactgactcaaaaacattggcagaatattttttgggaattacacaagctatttcatttcaggctagagatggtgtgtctaaaaatactttacagcgcctgattgaacccgctttagccgcattgccctcccccaaaacactggagtagaaaacatatataacaggtaactttctcctaaagataattcattgagggctgtctctgttctagtaactttataatccaatttggtattgacaatagtggctacctaggtagccactattgtcatcataaatcccatcgctttacagaacaattaccattgcaatattaacaataagtaatattttctgataaataaattcaatattagttatagtatatatacggatgatttatagaacttattacaacaagaaaaatatcgccaaatttcgtttgaaaaacaattttattgcctatttaaacgcaatattttagctaaatccacaagccagcctctcttggttttttatctctttttgtaattatgtaatctaaattacataaatatcttgactctattttgtaagaaagatatttatgtagtgcttattacataattaaatcaagatagaactttatctcgatgtttactgcttaataaaggaaaaatatttatgcaaaatacatctgccacagacaataaaagtgaaacattgccattggctgtgtacatactggcattcggtatttttgctttggtgacaagcgaatttcaagtagcaggtatgatacctgttatggcaagtgatcttggtgtttctatttcacaaattggttatctggtatctttgtatgcactagcaatggcggttggaggtccattgctaaccataggactattaaaaataccacctaaattcgcacttataattctttacgtgatatttaccattggtgaggttttaggagctatagcgagttcgtatcactttcttgtagtagcgaggcttattactggtgctgcatctggggctttttatggagtagcgatagcaatctgtgttgaaattgtatcagaacataaaagaggttgggcaatttctattgtactagctgggattatggcagggacaatactaggtttgccaatggccaatttgattggaacacattttggttggagagagagcttctgggttgtaagcgttttagttgtgcttggtttaattgtcagcatattatggatcccaagccttccaaagcagcaggaaattagcctaaaaagtgaattaatcgctctaaagagccctagattatgggctgtattctctacaagtttattaataatcggcgctacattttctgcattcacttatttcatacctatactgaaaaacattactggctatagtgatggtgctgtcgctgtactcctgactgtttatgggatagcaactatgttaggtaatatcgttgttggaaaattagcagatcgccatacgataactattctggctgttggacttgccttactgacaattttccttgccttatttgctatttttgctgagaacaaattaatctctgttctgtccttaataggtattggtttagttggtgtaacaatgaatccggctatggttacacgagtcatcagaactgctaatggtcgtcctctggtaaacactattcacagttctgtaattacactaggcattgtcattggagcatttcttggtggtttaggtattagctttgatcttggtttaacatctccaatgtgggttggctttttcatggctatagtcggtttcacaacgctaattccagatttgcagttataccaccgtgaacgagtaaaactgaacagctaaaatacatttaaaggaaaattcatgtctaatctttctggaaaaagtccctttagatgtagttaatcaaactatcatggtgattattcggggttcttatctctttgctcaagaggtagcttcctatatttctgacaatgggagaataatgaatataggaagctgtttaggtgagcgaatgcccgcggctgggcttactttatacgcaatgagtaaatcagcaatagttggccttacccaaaggattagcgtgtgatttagcgtataaaaaagtaactgttaatcagatatttccagggtctgtgggcactgacttaaatccagcagatgaacctaatgcagatttttttcgtgaattaacagctttaataacagtatggtacaaccaataacataggctgtgtcccttaattatataatcgccggcaaaagagtcgaatacagcctaatttcaccatggacaagtagtttcgtgcggttttttcgtagcgtgtcgcaatacgccgatttcctttgagaaaaccgaaacagcgttcgacaacattgcggttacgataagtcagcttatcaaattgtgtgcgaccatctccgcttcctttttcattgattttataaggaataacgcgctttatcctcaatttacgcagataactgcgaagttttccgcccgaatagcctttatcggccagcacagctttgccgcgccgtttcatgaaaccatttttgcgctgtattccaatgccgtcgagcaaaggggtggccgattgactttcgtgggcttgccccgccgtcaacatcaggttgaggggaaacccctttccatcggtggccaggtggattttggtgccataaccaccgcatgagcgacccagcgcatgagcgtcagcgatatcgggatgttttttttcgcgcctgcagcatctttactcgcgcgaatattgctgccatccagacaaatttcagcccagtcaatcaaacctttttcatccagaatggacagtaaccgattaaatatcttattgataatgcccgattttgaccaacggttaagtcggttatagaccgttttccaaggcccataacgttccggtaagtcgcgccacggtgcccctgaacatagcacccagaacatcccattcatgacacggcggtgttcagcatgtggacgtcctgctcgctttgaatgaatagggggcaggcaaggttctatcagtatccatgcctcatcaggaatgtcgtaacgtgccctcatctttttcccgtattgaaaacagttcagatgataatactatcaatttgcattaagggacacgccctagtgcctgtgtgctgtatttatcgtggccggatgtggtatatcccacgatggtattgctgcctgcggcacttttgctgggtatggtagtagtgataacaacgtcaatgtttaaaaaatatttatagcgcatgacgctgtacgatggcatgcaaaacggtttttgttttgtatgacatcgtcagcagacaagctgcatggcggcgagtcagcctggcaatcaaagacttctttcaaccatcgcaatgatgattgcagaaagctcgatttctgcctgaattgcagtgatatcgccgttagctgctgcataggataacgtttctgcggctcccagcattgcccaaaggcttgcagcggtcatttttccgctttgggtgtagggcaccagtattaccctgcatttctctacaaaaattttggcatattcgcgtttgattttttcgagttcaggtgagccggctaaggcggcaataatactgggtatttcacttccttgaaaaagcacgcaattgatgtaagaggatgcaattacagcggcttttttttccaaagtgtgttcactttgttgaatggcagtgtccatgattatcgtttggcggttatcaaattcaatatacagtgctgccaatagaccagaacgtgtaccaaaatggtcatacacgaccggttttgtcacgctggctttctcagccaatctgcccagagtcagagcctctgttccctcgtttcgaatgatctgccaggcaatggcagttagttgctgatagcgttcttctcttgtaaggcgaatacgtgtttgtgaattagccagttttgaatgggctttgttgcttgacatgtttatataccaaaggtaacttactaatggtaacctacttttagtatatagattacgcttgtcttttatcataatcaagaaggaaacatttggtgcacgcacttatcgttatctcacaccctatttctgactctctcagtggtcatgtggctcaatatattgctgatggcatcacgcaatcaaatcccgaaaatagtgtcgaacttgctgatcttgctaaagaaggatttgatccaagatttactgaatcggatattgtggctttttacaaagaaagtttacctccggttgatgtgattgctgagcagtcacgaattgccttggctgatgcgcttgtcttggtttatccggtctattggtggacaatgccggccttactcaaaggatggatcgatagggtgttttgtcatggttgggcttataacgagcatcctgatggcagactggaaaaaaaacttcagcaccttccagtacatctggttgctattggtgctgctggccgagaaacttatttaaaacatggtttttgggacgccatgaaaacccagattgaccatggcatttttgattattgtggagcccctgtcatcacttcagaattactgcttcatcctgagttaaaagatacaaatgcctatgaggaggctgcatacgatattggtcgccacattttcagtatggctgaagtttcagaggcatgatgtccaattaaagcagaatcaaagtcaactttctgtcatatattaaagaaatcaataaaagtatgatgcctgtgctcgcagacaggccgcctgagcggctagttaactgacaacaggtatcttttatcatatttatcctcagaaaattccttgtgctcaggaattctcttgctcgtaattcccggaattaatgacgagatgttgattgattgttgataatcagtgtcatggatgcaaaccaatcacacgcattacagagatggtaatcctgcttcggatcaaaacggtcgtgatggtgcgaaatatcttcacaataccccacgaatggctgatcaatccggtgtagctgaatagtcgccgcttgctctctggacgcaggaaaaaacgcgccgccgacttctgcaaacagttcggtatcatcctgctgagcgccacaatgttcacagtggtttatccagtgctgtcggtgcagccgctggctgacggacggctttgcgcagagtgtggtgaaaaccgggcagcacgctacgcacgagagtgggaatatcggcgatataaaacaaaaacgccgggctgtcctactctgtgtagtcaacttccgtgctgggctcatcgccgttatccgcttccagtagctggtgtccgacaggaagcataaacgcggtgacggtggtggtttcatgacagtgcggacagactgtccgggtttgcgcgagataccagtattccgcatgcacattgtagaacggcagccattgcataaatggctccggatcaaaactgctgtcgatataccaggtttggtcggccgcatcccagtgtgctcccagcttgcctattcccgaataatagtctcctcaatgtgctgtaaattgaggggcaccatgatgtttagacgggtgcggcttgcggtggttccgattatctttgtttgcccagcccgtatccagctgtagctcaagtttaattttgtgacctgagtgggatggtaatcctcccattttcaggggtgagattttcttggttaagataatctttcatatgacgatttactgtggtttcatgaatccgtaaagcctgggcaattatttcagtccagctttccgaagccaaaaggacggacttgatgcgattacgtactcgtttatcacgggtcgtatcatgcatcaattcaagggattttttgcagggttagagtataaaaggctaatgtctaatcaattcattcaagtaaaacactccttgatattttaacaaaaccaaattgaatgataattggataatgttaggttttattacatactacttaagcttaaaaaacgttcatgcatctcgccctgattgtttttgtactttagtcagatgaattttcatatccgttagcattatgggattttaagtataaatcaagcatctttaataacgatatgtatagataggaatgttacttattatttttacttcaatataattatattagggcgtgtcccttaatgcaaattgatagtattatcatctgaactgttttcaatacgggaaaaagatgagggcacgttacgacattcctgatgaggcatggatactgatagaaccttgcctgccccctattcattcaaagcgagcaggacgtccacatgctgaacaccgccgtgtcatgaatgggatgttctgggtgctatgttcaggggcaccgtggcgcgacttaccggaacgttatgggccttggaaaacggtctataaccgacttaaccgttggtcaaaatcgggcattatcaataagatatttaatcggttactgtccattctggatgaaaaaggtttgattgactgggctgaaatttgtctggatggcagcaatattcgcgcgagtaaagatgctgcaggcgcgaaaaaaaacatcccgatatcgctgacgctcatgcgctgggtcgctcatgcggtggttatggcaccaaaatccacctggccaccgatggaaaggggtttcccctcaacctgatgttgacggcggggcaagcccacgaaagtcaatcggccacccctttgctcgacggcattggaatacagcgcaaaaatggtttcatgaaacggcgcggcaaagctgtgctggccgataaaggctattcgggcggaaaacttcgcagttatctgcgtaaattgaggataaagcgcgttattccttataaaatcaatgaaaaaggaagcggagatggtcgcacacaatttgataagctgacttatcgtaaccgcaatgttgtcgaacgctgtttcggttttctcaaaggaaatcggcgtattgcgacacgctacgaaaaaaccgcacgaaactacttgtccatggtgaaattaggctgtattcgactcttttgccggcgattatataattaagggacacagcctagtctctatagtgaattttctggtaagtcgagaggcggcttttataacgggagccaacattgctgtggatggaggtgtgaatttataatgtgaccattatcccatacatcaaattaaatgaatgatatatgtgcagaggaaatgctaaattttgtcctaatatgagtagtaaacagtatgtaatcactgataaaaacgcttctttgcttaatatcacaatcaggaaaatcagttgactatcaatacaacaacagaaacaacctactggaatcccatggtgccggaactcacagtgacaaattttcctgtgtccttagatttctatgtacaaatattaggattcaacatcatgatacggcgaaaagatcctgattttgcctatcttcatttagggaaagctcaactgatgctggaagcgtttcacgaaactggctggaatacggcagagcttaataaaccactgggacgtggcattaatttgcaaatagaagtggatgatatcaactctattcttaatcgcctgcaaatcaacaagataaaactttaccatccattgaaggataataactacgccacaggcgatacccacatctgtcagagagagtttctcgttcaagaccctgatggttatttgctaaggttcagccaatacatagggtaaaaataaagtcttcctcaattaatgaataaaactcagttaaaactttatttcatcgcggaaacttatgcctatgttaataaataattttgattacctcatccgatattggggcaaagcccagaaaaatatctattctgataccgattatcaccttctggcctatcactgtctggatgttgcggcagttggcaaatatctactggctccccacaaaaaaattaccgccgatattgcggattttctggaattatcaaaagaagaattacaaaacctatttgtattttttttgctcctacatgatatcggtaaatttgcttccgcattccagcaattatattctccaaaacaacacactgaactactgaaacctcagcattgcaaaccctacgatagcaaacattttcgtcatgatcgtttagggctgtttttctggaagcagatccagaacgatgtgctatttgctttggtgggagataataacctgcaacgcagagataaagatcgggcgcaagatacgttgatggtcttaatgcagtgtatgctcggccaccacggtaaaccgattgatgatggtgatgactggcgcgcgattggcgattttaccgaagccccaaatataactgatgcaaaagccttcacaaatgatctcattactctgttccagcctcgcctgtcactggaaaaattactttccaaagaatggaaagataacctgaagcaagtcagttggcagttggctggcatcgttgtcatggccgactggataggctctgacaatgcacactttcgctatcaaaccaaccccgtgccattggcagaatactggcaaaccgccgaacaacaggcgcaaattgccctgaatgccattgatatgcaatacacaccagccatatcgccgtataaatctatccagcattattatggtttttcaccaacgccattacagcaatgggcagaagaagtgccgattgatgattctccccagcttttcattctggaagatgtgacaggtgccggaaaaaccgaagccgctttcactttaacccatcgcttgatgcaggccggagtcgcagaaggtttctattttggcctgccgacgatggcaacatctaacgccatgtttagccgcgtcgccaaacactatcgtgagatgttcaataccagcggtaagccaccgagcatcgttctggcacatggtgccagtaagatgaacaatgctttcaatgacattattctgacctctcaaaacaacgatagcgactacaccaaagatgagatcacagcgacagcacaatgccatcaatggctggcggactcgcgcaaaaaagcactactggcacccgttggcgtagggactatcgatcaggcgctgcttgccgtcttgccccgaaaatatcagtcgctgcgtttgattggcttgaatcgtaagatcctgatttttgatgaagtccatgctgcagatgaatacatgtttgccctgctggaaaatttgctgaacctgcatcttcatcaagggggatcggtgatattacttactgccacactttccctgaaacaacgccagaaactggctgatatctggctatcttccgcaggccaaacaccgcaaaaactgcggcaaacagcctttccgttggcaaccaaaattacgctcactcctgaaaatccgattattgagcaacccctgcacagccgctcagatgtcagccgtgaagtcatcgtaaaaacactggactctctggatgcttgtgtgcaaaccgccctgaacgccgccaaaaaagggcgatgcgtggtttgggtacgcaattccgttgatgatgctttacacgctttccgattgattcagtcacagatgaataatccagaagattgcctgttgtttcacagccgctttattttgcacgatcgcaagaagatcgaagatcttgtactggagatatttggcaaaaatagcacccaactgcatcggcaaggcaaaatactgattaccacccaagtttttcaggaaagtctagatgctgatgctgacgagatgattaccgatatctgcccaatcgatgatttgatccaacggacaggccgtctgcaccgtcatactcgcgatgcagaaggaatttatcagcaaagtattagcgattgccgcccagcccctgtgttgtatctccacgccccaaaatgggacgatcaaccacaagcagactggctgagtaaagattttcgcaatactcaatatgtttatcgctcaccggggcgcctgtggctggggttgcgtgaattgcggcgatcgggcgctatcagaatgcctgccgaagccagaactttaatcgaagcggtttacagtgacgatgcgtatgaacacatacctgacaccttaagacataaggaaaatgaatttattggagaaggccacagcaaagaggccaaagcagaatcacagaccttgcgatggaaacatggatattgcaatcacagtgccagcggatggtatgacgatgacagcgatatcagcacacgattcagtgatatcgaaacggttgaaattctgcttgtaaaactggctgacaaagatgcattaataccgtgggcgaacgagggagaatttgccgttcaactcagtaccatcaggctaccaaaaaacaaatttgccgataagttactggcggttccagaatcgttttctcatgctgtagaacagctaaagagccaattcaaatccgctaaatacctgcaaatctggctgcctgaactcgaccccaatttcagttacgaccctaccatcggtttttatgaaatccaccagcaggaggcatgatgaaccttgttaaaaacgcatggctgacctttaaaatgcgggatggcagtcaaaagaaactgccactggcggctatctgcgatcccaacgtcatggattttgccctgccacgggcagactttcagggcgcggcctatcagttagccatcggcttactgcaaacagtgtttgctcccgtggataagtttcaatggcatgatttttatgaggcttccccaacacaagcagatttacagacagcctttgaccgtgtggaacatgcctttaatctgtcaggtaacgggccgctatttatgcaggattttgattcgctggatagcgtcaaatcaacgacgatttctgggttactcattgaagcgcccggagcgaatacgctcaaacttaacaccgaccattttattaaacgcggccaatatgaaatcatctcgcctgaaatggcggctatcgcacttttcaccttacagattaatgcgcctgctggtggtgtcgggcatcgtgtcggcttacggggcggtggccctctgaccactctggttcaaccccaaacgctggataccccactctggcacaaactctggcttaatattgtcaatcaagaatactgcggctatcccgaagcagacctccacagccccagtgtctttccgtggttaggcaaaaccaaactcagccagcccaccggtacggaaatttacgcttctgatgttcatgaactctatatgtattgggcgatgccacggcgtatccgtctgcaaatcgacgataaacccgctatttgccaactgaccggacaacccaccgaacaatctgttacccgctaccgaacccaaaactatggcaacaactacgccggaaattggcaacacccactcacgccctataaatggaatccgaaaaaagctaatgacgatcacctttctatcaaaggacaaccgggagggataacttataagctatggaatagtttggcgttttccagaaataacgagggacaaaaagccgctctggtcgtcgatcatttccaccagatttgtgattattttgcagaggaacacagcgcaacaccccggctatgggtctttggctatgatatggacaatatgaaagccagaggctggtattccactacacttcccctgttttccatcgccgttgaaaagcaggatgtcattttccggcgagccagaaatttacagactctttccgccaatgccctgatccaatgccgttcccaaatcaaaagtggatggttcaatcgcccaaatgatgtgaaagggaatatgtcatttattgatgctgcgttctatcaacgtactcaaacagctttttttaaagcgatacaacagattatcagcagccagcaggcgtcttcttatctctcgccagaagaggccaaaagctggctctaccaactgagaaatacctgtttcgatctgtttgatgaatatgtgctgtcagaaagcgtcgatccgaaaacgctgccgaaaaaagtcaaggcaaggcactttttgactcagtggttatttggtgccaaagagatcaaatcatttatgactgaataccaaatcgaacgccaacagaaggaggtgatcaatgaatagcttgagcgaaagtaccttgctgtgctggtgggaaagcatgtttctatcaccatcagaactgaaagctaaaggcagataccccgctccaacggtgtataaagcacagttaaaacgctgccagaatatcgacacggccatgttaaccggaggctttcgcgcgttatggcagaatttgtccgaaagcgacgctgaaaccgttgatgaaaaaaccatcataaaatgggcaatgattgccatgacggtcgtgcatgtgaaatacaatgtaaccacaacactggcaaccgcagccggcaccaaaacagaaaatgataaacctgtcgtcagtgaactccgttttgcccaattacagggtgccaagacccccgacgaattagttacccgcttacgacgcaccttgcagctcattaatggaacagtttccatgctggatctggcaaaagatattgagcaatgggttcgcgaatgccaccagcaaagaccccgtcgagcgaatcagcgtctcagcgtgcaatgggcgctggagtattacaaagcagcaaaataatcacttttagcctttgaggtatcctaaatgagccaatttattcaattacatctgctgacctcctacccgcctgccaacctgaaccgtgatgatatagggcgccctaaaacagccagaatggggggagttgatcgattaagaatcagctcccaaagcctgaaacgccactggcgagtctcagatctgtttcaggcagcacttgcgggacaccttggatttcggacaaaacgctttggcctcgaaatttatcaacaattgatcgaagcggacgttaaagaaaagcaggcgatagagtgggcttctgccattgcgggagtatttggcaaaaagaaaaaagacacgccactggaaatagaacaactggcccatatcagccctacggaaaaagccgccgtaatctccctgataaaacaactggccgacgaaaaccgggcgccaaccaaggaagagctaagtctgttgagcaaagagagaatggccgtagatatcgccctgtttggccgtatgctcgcttccagcccggcctataatattgaggccgcctgtcaggttgcccatgccatcagcgtacatgatgtggtgattgaagatgactattttaccgcagtggatgatctgaacgacggcaaaagcgatacaggttcagcgcatatcggagaaaacggatttgcagcagccctgttctacagctacatctgcatcaacaaaaccctgctgatggaaaatctggcaggcaatgaaactctggtcaatcaagccattgccgccctaaccgaagccgccgtcaaaatctccccttccggtaaacaaaacagttttggctcccgcgcctatgccagttatgttctggcggaaaaaggagaatatcagccccgctccttgtcggtcgcgtttttgaaacccattaacgatgaagatcaggctgcgtcggccattgccgcattggaaaaacaggtcgaaaacttcgataaagtttatggtgactgtgctgacacccgtcatagcatcaatactctcaccggagaaggcagttttgccgaactgattaaattcatcacgaattaaaaggaggctggaatgcaaacctatttggtttttcgattatatggtgtgctggccagttggggcgtagaagccgtcggtgaaagccgccccaccagcctgcatccgactcgttcagcgattttggggctattgggtgcagcgctgggcatccggcgtgatgatgaaatgcgccttgccgagttacagcaaagtgtcaacatcgccatcaaacaaatcgtggccggttcattgatgagggattatcacacgagtcaagttccctcccaaaacaacaaacagcaacacttcacccgtaaaagtgagttgggtgaatctgaactgaatacgattttatcctcacgggattaccgcagtgatgggctgtggatcatcgcaatttcactgaccgaccaagcccatctgacactgacaaccttgcgtgatgcgctgttaaaaccggttttcaccttaagccttgggcgcaaatcctgccctctgtgcgttcctacgatgccgcaaataacccaatctccctgtttgaaggcagctctggatacggaatttccgcctttaacgcagtcagagaaagctgatcactattggctgggtgacagcggtatcgtgagctatttttgggaaggggataaaaacgagattgagatccccgatgtggcggtattgaccagccaattgtgggacgaaccgctttcacgaacccgctggcagttcacccaacgtactatgcaccaattatcgctgatggagaaggcacatgtacctgtctaaagtcaccttacgaccttctgcctatcgagaacagtttttgtcaaaaatggcgaaaaacagtgtttattcttcccaccagctattatggcaactgtttacggaacaggtagaacgcaattttctgttcagggaagatattggcatcaacggtacacctgagttcttcgtactgtcccatacagcgccaatacccaattcggcgatgttccagattcagagcaaggcatttaccccgcaattacgcagcggacagaaactggcgtttaaactccggctgaatcccaccatctgtattacagataaggattccggcaaacagcggcgtcatgatgtactgatgaatgccaaacgtcaggcacagttggcgggtgctagcactgacgaaatccagccactgatgatgcaggctgtacaggcttggatacaggatgaaaaacgactgactagctggggtattcagtttgatttcgatcctgatgttgaacgctatacccaacatcgctgtcgcaagtcttccggccagaaagtggctttttcgagcgttgattttcagggcgtactcaccctttcagatcataaactttttctggcgcaatacgctaagggatttggtcgggcgaaatcttttggctgtgggatgatgctgataaggactctgtaatggcgtttattccactgaaaccgattcctatcaaaaacagaaattccatgatcttcatcggcatggggcgtatcgacgtcaaagacaatgcattcgtcgttattgatgaagtgaatggcgaacgtatgcatattcctgtcggttccattgtctgtatcatgctggaaccgggaacccgcgtcagtcatgaggcagtaaaattggcgtctgcaacaggaacgttgctgatttgggtgggtgaagcgggtgtcagactatattccgttgggcagccgggtggcgcccgttcagacaaattgctttatcaggccaaactggcgttggatgaagaactgaggctgaaagtcgtacgtaagatgtttgaactgcgctttggcgaacccgcaccgcaaaagcgcagcgttgaacaactcaggggaatagaaggcgcccgtgtcagaaaaacctatcaaatactagcgaaacaatatggggtacagtggcatggacgtaattatgaccataccgattgggataaaggcgatttaatcaaccgctgtatcagtgccgcaacatcctgcctgtacggcgtgactgaagcggcaattttggcagccggttatgcgcccgctattggttttctgcatactggtaagcctctgtcgtttgtttatgatattgcggatattttgaagtttggtactgtcgtccccatcgcctttaaagtggcggccaccaaccgtattgctcctgaccggcaggtgaggattgcctgccgtgaaaaattcaggacagataggatattgaagcgtttaatcccgttgatcgaggaagtgctcgctgcgggtgaaatatcccctccaccaccgccagatgatgcccaacctcccgccatccccgaaccgctctccatcggcgatattggtcacaggagccgataacatgagtataacgatcgtcgttaccgaagcagttcctccgcgcctgcgggggcgtctggctatctggctgcttgagatacgggcaggggtttatgtcggtgatgtctcgcagaaaatcagagaaatgatttgggaacaaatcacagaattaaccgaagcaggaaatgccgttatggcttggggaacaaatacagaatcagggtttgattttcagacgttcggtgaaaatagaagagaaccaatagattttgatggcttacggctagtgaaatttaaaccacttcctgagggttaattttgatcgcgttttaggcttttaaagtggtagaatttttatgctcaataaagtcattttaaaacaaatggttatatttagagtgttccccgtaggtacggggataaaccggttcaaatgtatacattttcactcttattgtgtgttccccgtaggtacggggataaaccggagactcacgccatgtcatgactgaaaaatttgtgttccccgtaggtacggggataaaccgatgatgccacgttactattcgccatacctaatgtgttccccgtaggtacggggataaaccgttttcatataggactcatcaggatcagccaatgtgttccccgtaggtacggggataaaccgtctattgagcgtccagcactgagtttattgtcgtgttccccgtaggtacggggataaaccggtaatgccggattaaaaacggggattgaaattgtgttccccgtaggtacggggataaaccgcctgcaatgggaacatacttcgcggggtcgtagtgttccccgtaggtacggggataaaccaacagcagaacatatcttcccataatagcaagactcactatgactcaaactcgtcatagagaaattgttttcactaaagtcactatacgaaatattcaactttagttactcattttccagcattattcgttaacagacttcatataacctatgataatctactgcgtccttcatttttctttgagtttattatgaccttaactaacttcagcaaattgttagccgctacactttgtcttgcgacttcatacagctatgcagatggtgagcgcccacttttttcattgacgatggcagagtctggtgtatcgcagacgaataacgatgggagtttatctcattctacaaaatcagaatcccgcattctgccgatttggggtgatgaagcgcgagctaaaggctacgatctgcctgagccatttggcgcaagttatggttatatgaatctgcgtcaggatatcattatagacagcattaaatttcaatttaccaatccgcttgtagataagagctttcgaaatctgattgcagtcaatgcaggtgatacccgagaaaaaaatgaatctcatatgcttaaactggatacttgggttctgccttttataaatgtatacggtgtatatgggaaaaccaaaggtacatcaaaaaccaatcttgatagtatttactttatggacatggaagacccctggcttaaaaacattccttttgaattaaatttcgaaggaaaaacctatggtggaggggcaacttttgccggtagttataaccaattttttgctacattagatgctaactacacacgtaccactctagatattttagatggggatattagtgcccttgtcattactccacgcgttggttatgaatttgtcttcgaaccattattcactggtcagggaaacaccaaagttcaggtatgggtaggtgctatgtaccaagatatcacccagcgttttaaaggtgatgtaagtaaactcaatttaccatccgacctagctgatttgtttggctcacttacaaataatacagcggataacggcaaatataaatcagacatcaaattcgacgtcgagcagcaccttgcccataaatggaataataccgttggcgcacgtttcgaaatcactcgtaacttcaatatcctatctgaagtgggtttcggcaaccgaaacagcctctttgtttccggtgagtttcgtttctaatgttcggctacaagacaatcaagaggctggtgatatccagccttcttatttttagcgtatcgtcagcacaggctgatatcttgcccaatcggcagaaaatcgatggttggctcagcgaattaggtggcagcaatcaactcgatgccagcaaaaaggttgattggggtgtgctgcccggtcctttttacactcctgaaatgggaatgggcgtcggagtcgctgtagtcgggctttaccgtcccgataactcagaccacaccagccagacctcctcactgggtctcagcggttttgcttcatctaccggcgcatttggcctgaattttaccaattacaattttcttgcccgtgatcagtggcggttatttgtttccggaacgctaaataacacgccgacttattattggggcaagggttatgatgccggtaaaaataatggcaataaagagaaatatcgagcgcaggaatttgatattcgccctcgcctgctctatcgcgtgacagatgctacgtatatgggattaggctggcatttctcatccctcaacgccagtgatccggatatcggtgccgcaaaatatttcgcgcagtccgtcggcggacgctccgtcaccagttccggtgtaagtgcatacttcagttatgacacgcgggatttcctgcctaatgcaaaacacgggcaggcgtttgaaatcgtttatacctatttttccccggaattagggggagataatcgtttcaataccacacagttacagttttcgacttatcaccagctatccgaaaaatccgtgctggctttcgataattatgcccgtttcagctctggcgatgtgccgtggaatcaattatccctgctgggcagtagtcaacggatgcgcgggtactatgaagggcgctatcgcgataccaatatcttaacgtcacagttagaattaagacataaacttgactggcgccacggtattgtcggctggataggcacaggtacattaagtgattctccttcaaagctaggtgcaaagcactggctcccttctatcggtgtgggctatcgtttcgagtttaagccacgcatgaatgtcagattagattttggtgttggtaaagacagcactggattctactttcaggtaggggaagcattttgaagtcattgatgacgctattattcagtttcctgctcatggcatgtcaggataaatccactcccatcatgcctgtagagcctgtactcatcagtgacactcaagaacagccagagatcgactggccagtgttgacacctattgaaccacctgaaggcttaagagcctgctgcgcattcggttacgatcttaaaaccgaggtggtggggattcccgttcctttctatgatatcgacaatatcgtggaggccgagaaactgggcgaacatcactataacgacagtgctctgggtgccagtgctgctttattggggataagcaatgaaaaaatcggcctgttatatacccagaaaggtgggtttattgatatctcccatgtgagagataccgcagactatacgctgtacctctttagccagatttatgctcacctaggtcaggagcggaaattaagcctaagtaatgagcttgcggcgcgtaaaattcacttttttgcctttactccacctgtagatcccgttgagcgctacactttaagcgcttatttagcggcaaaactggcatttcagttggcggcttggcacgaaatcgcccaatggtatggctatcaatcagtcccagggttccccgagggcatttctgcgttttccccggaagacctctattccaatctcttgggagcaaggctggctctgaccctgattctgcaaggtcacgcttcttcggtaactcaatttactacctcaatggcagccatattgccttctgctttgcataaactcgagccttattccaaatcagacacaaaaaagatgtttaatcaggtcgacgggctatggtggaacagtcatgaacgtattccacaaaagtttttagtcctgcgcaggaattatgaaatccaagacaatcgttatccattaatgccttcaggcaaagaaaagtttgcgcggcgtctgtccctgcctgatgaatataagccgttttcgctggataaattggctgaactacagttatggccaaccgaacagatgaaaaacttacctgttcccaattcctattggacagtgaaagactttaacgcgttggcagaacatgcccagcatgaagatgcgcgacaattgttattgagtagcaaataaatacagcagccagtgactcggcaaagcctttcgattaaattcgtaaggagatagctccactatctccttactctttcccgaatctccccaacgccctgcgcatcggcgtatgccgcttaatcagttcctgcaaaacctctttcagtaactgacttttaccgcttcccagcggttctagtatgtttttttcatgggattctgcttctgccagtaatccgaccaccacttgctggccgctgtcggtaagatgcactaacgtgatacggcgatctcccctaccattggaaaaacgagtgacatgcccctgcaactcaagacgctgtaatactcgggtaattgtcggttgtttactgactgttttttgcgctagcaggctaatgccaatcggaccacttccagccaacgccgataaaacacgccattccagcacggacaacccccgcgcctcaacgatgtcatgaaactcagaagaaaccagcatccatgcttgcccaagcaaagcaggcaagtaattatcaacaaacacttttgaatccggcatagtttcaacaacctttctatttcgggaagttttgtcttccgattctaaaaggttcatccgtgaaaaacacgctcacaatagtcaccccatcaatgttttcctgatacaagtgaaccaaatctcaggacgtatgtatgcagcccaagttgtttcaatatcatgcaggctatcgtaatagatggggagataacaggcgtgagactcttcagcgcgggatacaaagcccgttatggtcagatgccgagtgaaagtttatggcggagatgatgtgattaatttatatggcaaaatttaacgcagcccattgttatcgcgtgggctacgttagacataacattaatctcattgcagcgtggctgggaagccatgttttttagctccccaagcgattatcaatcccaccacaagcaatccaagcaaagtccaagggaagatatgaacaccctgagtgtctagcaatatgcctcccaacataccgccagcagctatcgacaaattccagacggtaaccaagattgattgagcgacatctgcaccagaacccgcagcatccgcagaggccgtctgcaatagcgcggctgctccgccaaaagttagcccccatattgccatagagatataaattacagcaggcaaaataccagcaagccccaatgccagtgcgaccaaagcaaataatccgatgcttatcaaaacaagcgaccgcaaatatttatcgatcaataccccaatcaaccatatgccaaggactgaagaagccccgaagattagcaaaattatgtcaactcgatgggaaagacccgcaggagcaagaaatggcatgatgtaggtataaaggatactatgtgccagcacccagaaaataagtaccgttaatactggccgaacaccgggagtggcaaataccgaacttatcgataaacgtttttctgatgattggccgggataatctggcacccgtaaacgaatccaaaccatgaccgctaaagtcaacaatgagagtaggccaaacgtcatgcgccacccaatcagtgagccaagaaatgcccctaaaggaacgcctaatgaaagtgccagtggtgctcctaccccggcaatggcaagcgctctcccttttagtggttctgatgccatccggcgcgcataacccgccaacataccccaaattaaacctccggccatccctgcaaataatcgggcaatcagcgcaaaagtataattagatgtcaatatagtcagtgtattaaaaacaaacaacgcgcctaaaactaccaataaaagcggacggcgtcgccagctttgagttgccgtcgttaatgggatagccgcaatcacagagccaatggcgtacaacgtgacaaattgtcctgccatcgattccgaaatattcaatcccatactaatttgcgccaacattcccgcagggacagtttctgtcatcagcgccaaaaaacccgtcattgccagtgcaagcaatgacgctaatggcaaagcatttgtttcacccgtgtgacttgtggttgatctcacttaactgccctcctgtaaaattctttatctgaaaatacataagagcgatttaaattatacgcaccctatgaggttcacagaatatgtggattgctagatcggctcataggtaaacagtatgaaggcgcatattagtattaaaaacaggctacagttcaaaatatatatgacaaatatgtcatcaataggaaaacgaataatggataactttagcgtccttgaagtgtttgttcgagtcagtgaagtacggagtttcacggcagcaggcaatcaactcggcgtgtcatcctccgctataagcaaggcaataagtcgcctcgaagaaaagctacgcgtacgacttttccaccgttccacacgcacagtgaccttaactccagaaggtacactttttctcaaacgctgccgccgcattctgaatgaaatagaagccgcagaaaatgaactttcccagtcacaatctgtaccgtctggaaagttaaaagtgagtatgccatcaattggcgtactctttatgcccaagtttgccgagttcagtcagcagtacccagaaattgaattagaaatagacagcactgacggcttagttgacttaattgaagaaggattcgatgccgtaatacgcaccggagaacctgctgattcacgattaatggcacgtgtgctaggctcttacaaaagagttatcgtcggttctcccacctactttcaaaaatttgaaatacctaaaaaaccagaagaactgattaatcatttctgcatgatgtatcgttataaaagcacaggcaagctggatatttggccaataaatcaagataacccaactttgcagctagaatggcctaccagaatggtaactaacacacttgaccctctcgtgtcttttgcagaaaatagtcttggaattacttgtattcctgatttagccatcagagaacagttgaaaacaggaaagctgataacaattctgaatgatttcaataatgacataacgacatgcaggatactttggccttcaagcaaatatttatctcccaagttaagagtatttataaatttcatggtcgaaaatctatttaagaatgagtgaagtatgagtgtctagtattcaatatgatactggacactcaattaatttcaatactaaataattccaagggttccgcattgagataataaactcttcaaaggaagatttggattagataaaaggagtctatccaaactaattatatgatcagccattctctttaaatcagcattttcaatatgtgatgaattagatatccaacgaaaagcccccttaaccggatcaatttgcattgtcagagaagcattatttttttcatataattgatagactgctggtttaacttctgagtttatgaaatctataatgctaattctaacattacagatatactttgaatacaaagattcagttgagcgcaattgtggatatcgacaaattatatctttatggaaagttttaaatttattaagtatagaacgctcaactgatatagaactatataaatccaatgcagagcaattaaagtcaatattaaattcaaaaggaactgaagctgaaaaaaagatagagtaatctataacctcatgtttaggcagttcagttgcacaatccaaatgaaaatattgaacatcattaaccaatgctaaatatacagcaaatgctcccaatatattaaccaatctttcttcacttgtaacattttcaatatcaatataaagattccagttataatatatttcaaaaatacaatctaagtcatgatacagagtgtcaaatttgaaatttaatggtctaaatgattctaaacgattaacccaaaatgattcatatggtgctaactcctcatgttcctgagttaaatcttctaaatcagaattattaataattggtaatgaatcaccaacgcttatgcaaagcatatcagccagaaaatctgcccgcaaatcttccccggtcaattgaataaattctattctgatatctgtcgttccggtagttacaatccagaaattttgtgctatatccactaaaatacctgcctgcttatgtgttgagacagaaagtacttcaagtgttttcactattcctataatatttatcaaataaactttcggaacacataatggattgcgataacgctcaccgaaagacaaaccacgtactaaagctgacagttcttctgctgaatgtgcccactgtaaacatgctccagcatatggacgtttccgactagaaaaaaaacttctctctgatacattttgcttcacatattctatggattttcctcctttaataagagatattaattttttaaatccttcaaatgccgcattatagcatttcatatttaatgaaagagctgtgtcagaacgattaatttctacattttgttgaactgctatatctcccgcgtcaaccacggtagcaattcgatgccaagtaactgcatacttatcctccattgcaaaaagagcccatgaagtcgcatgagttcctgcatatttaggtaacggagcatcatgataattaaatgcacctaatttaatattatctaatagtgcagaggttaaaataattggatttgatatagagaacagccattcaacagagttgttagatactaaagattctaaatcctgaatagtattgatacattttaaaccttcttttttagcccataaaagaaatactgaatctaaaggcataactacctcaagatgaatacctatagaaagtaagaattgacagcatctaacagctaaagtaccttgaccaataattacaaaagtgtagttttcacttgactccattgttttcataataattttctcatattagaaccaattttacataattcatataaaaacaccactaagtattattctaaaatataagaatcacatccaattaatcaacatacgcattcttgacagtaactcattaatccctggctcttttagtaactcaaaatgaggtacattaatttgggcaacatcaggaatgttaataaaacaattactattggtttcaaaataagacaattgatcgcccttagcactaaatatttttacaggggcagtaattaatctattatgaaagatactttccgattccgaacttaagctttcagaagtagttatgacaactctagaaattcttttaattagatcaaggcttaatcctgaatgtcttttactaataagacttgcgaaatcatcctcatcatttacatagtctaaatattccaataaatcttgatcatctgaacttcttgaaaaaactgaaaatagcagagagaccaaacttttattctcatagccactagatttatctgatgactggagttgtaacgaatgtcctttagtcatacctggagcaatcagtacaagttcttcaaccttttcccccaactgctcaagttgataagcagcttcaaaagctaaaatggttccaaatgagtatccccaaaggacataaggacctcgtggttgtttatttcttattgcagtaatatcagcatgaactaatttttggatagaaccatatggtcgttcatcttcatttagtccaaacgcctgtattccataaaagggacgagctttgccaagtttttcagcaagtagcctaaggctcataggatatccacctaatccaggccaacaaaaaattgatgataacgccccatgtggctgtagagaaaccaatctctcagcatatttattactatttacatcaactaaacaagccagtttttcaattgtcgacgcttcaaataaagcatgaagtggcaaattagaacctagtctattatttattgattgtatgatatctaccgcacttaatgaatcaccaccaagagaaaagaagtcatcataaacagaaatactatttttttcaggcattccatccagatactttgtatcactctctcgtttatagattttggttcagatttttctttaagactctccttgccaaaaattttttcaatcttattgaaatcaatttttcctgttattgttaaaggcataacatcaacaaaaacgaataaagtaggaatcatgtaatcagggatacgtctggccaactctttttttagaatagaaactaactcttggtgatcgtgattttcttttaatatcactccttctgtactaagttcaacacatgcaatcagaatagattggctaacatcatgatatttattcattacagcagcaacattaattaaaggtaatgattctaattctatttttatttcttctaattcaactctcatacctctaatttttatttgattatctttccttccaatgaaataaaatgaaccatccatgctttgataagcaagatctccagttttataggacatgataggcgtattagatcccgttgggatgaaagaaaagaaatgtttatttgttaagttttcttgattaaaatatcctcgtgcaatttgaatgcctgatatatagagttcaccagaattaccactggaaacagatctaccgttttcatctaaaatatgaaactcagtattatcaaccggtctaccaattgatactccttcatgatgttctttttttattccaattgaaacattatagaatgatgcattacaagtgaattctgtcggaccatagacattaattaactcgcaattaggtaatgtatccaagcattgcagtgccaatttctttgttaaactttctccaccacaaagaatatgtgaaagtgatgaacatttcgcaaatttatgcctgttaaccagcgattgcaacaaagtcggtacacactgcaacaaagagacattgttttttataatatcatctattaacttcgaaatatttttgtttatactaaaatcactaataactaactgagtaccacaacaaacagatagcatttcccattgagcagcatcgaaactaatagatgttttatgtattatttttttatctctgcttaaaaaaccttttttattcaaccatagcatttggttaactattgaacggtgctctatcattactcctttgggttttccagtgctacctgatgtatatacaatataagcaaggttttctggttttagctcccttggtttagaaacagattttgtcttcgcactcatttttacataatcaatgacatcactaatcgttattaaagtaatatcactactaataatatctaaaattttaaattttaccttttcctgaacaaatatatatttcattgaggaattttctatcatatacttcaaacgctcaggtggataatctggtgccaatgccaagtaggcagcccccgaaaaaataattccccataccccaattaattgttctaatgatggttcaacaaaaagacctatacattcatctatagaacaattcagatagcgtaaataatttgcaacatgcaaactaagatgtgccaattgccagaagcagagtttatcatcaccatccacaatagcgacattatccggtatatggcgtacacttgataaaaaaaggcctggcaaacattgatcaatggcatattcaaaacgttcttcttgaccactagtagaccaagatatacttatcttatcataagataatgaattttttagttccactaactctcgaatatctaattcaaatccatttatattcaatagcctttcccaagatttattttgtgttactgaatgcatatcctatacctcgttacaattcaaaaattcataatgaactaagatatgaaatcgaaatatcctgatgctgtataatcttttcctagttttttaaacctttcatcaggtaaatgatatccattatttaaatatttatttgcaaaatgaaaagaacttttatcgttcaaaccaatactttctagcatcctgagcacatctttaggaatttgcagatcgacactattgacataatcaattaatatattctttacaccactgccatctggcattctaattttaggcctgtcaataatgtaatccggcagaaaatctcggaacgcttctctaagtatatatttttcaactccattatttatcttcaatgattcatgaaggcttaatgcataacgtaccacttgattattcataaagggtactcttgcttctacagagttacgcatactagcgcgatcaacacgctgcaaatcagtacgatgtaaattatttaatctataaagtgaaagctcatcaatagaaggatatgttttgaataaatcatagccgcaaaaaatctcgtcacttccttctccacataaagccactttgaaaccaagcttattagcaataaaataaccaaaatttgctataatagagtctactgagtctattttttcgaagaattctccataatatactgcgctatcaatatcatcaattaaatcttgctctgtaaatgtatatattatctgacgtattttattttcttcacaaaatttctttgatattttgatatcgtctgaaccaggtaaaccaaacgaaattgcagtaacattagaatgatatttatttgctaaagccaatacaatagcactgtctattcggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccaaaaaaaaccgtgttggaatcatccattaaagaaatgatgtatgtcagccagaaatgggatgttgctgaagaatatgctatggctcttgttacacttgacccatactggtcggttaactatcaagagcttgctgaagtttatcttaaacaaaataagtatactaaggcattggaacaatatcaaaatgcgaagcaggcaggtttgcctagagtgacttttactgagtatatgattggtgtatgccatgaacaccttggcgatcatcaggaggccattaatagtttcaaaaatgtcctgacaatggatgaaacaaatatctcagcaggattatctggttataacatatcatcaaagtatgatttagaatctaaagaatattttcgagagttcatcaatcgttgggatgagcaaggttttctcacacctatgcataaggagatgatagtatgaataaaataacatctattaatgtaacgcgtttcgaccatatccaaatggaagtggctaatcttgatgaaagtattcgtttttatgaagaagtatttggatttaaaaagaaggaggctggattaagaagaatggttcgctgggttattttagggaatgaaagtaaattatatttgtgtttgcatgagtatgctgaacgaactggaattgaaaattctgggttggaaattacccacgtcggttttattgttgataatttcgactctgttttgcaaaaattaaaatcacataatgtgaagttacctgatggtgatataattcaatatcattcttctcgttctatctactttcttgatcctaatggttataaaatagaaatctctgagttcaatggtggtggaattgatccttgagcagtaatagtgtgtataaacaagaattaggctttacaattaaattagatctaaataaatatctttaaccattctatagaataagtaatctcaattaatgtatgtttttattagaggtcatgattatgctaagtgaagaaaacgagatatttaaatcaattagtgaaaggtcaaataaagaaatatattcacaatgtgttattcaattagatgaatatcgtgcaagaaaggttatgtctgaattatctaatggattcacacagtcttttgatggaaaaatgggtcataaacctgtcgagagtgagttaagaaaactaataacagagatttatgagcgtgtcaaaagtggcaatggaattgttttattaaaaggaatttctattactgaaataaatgaaattgaattaggtgagcgttttttgcggctttgtagtttgatggggaaaccagtttctcagagtgtgatgggagatacacttgggcgggtagaagatatgacgcatattgatcctgatgccagaggttatagaaacagagaagagttatttatgcatacagatcaaccagatatggtgtgtatgctttgcgtcaggcaagccaaacatggcggtgatagcaaatttgctagtgcggtggcgcttcatgaagctattaagcaaacgagactagatttattatcggctttatacacgggctatccttatcatcgcttgaatgaacatcctccaggagccagtgaaatcactgagcataatgttcctgtattctctgaatacaatggtgaactcagtattaggtacttaaggtttaatatgtttgcagctgcatttgctcgaaatgaaaaagtgccacctcttctgcaaaaagctgtcaattatctcgacgaattggctacatctcattatttttgttggattacttcacttgaaaaaggagatattctttttttcaataactaccttttcctacattcacgcactgcatttgaagacaatgaagatccagtgaaaaaaagattaatgtatagggtatggctggcgtgtgataatttccgttccatacgatctgaacttgctgttcatcctgaaggcgctggtggccgaggggggatcactcctcaacatggtaaaagaccacgttttgattatgacttatagtgatgattacttatatgaaatataaaacacttggaaatagcggtgcttatgtttcaaccatatgccttggtacgcagcaatttggtcgatgggttgatgaaagaagtgcccgtgaaatattaaatatatttactgagtatggtggtaattttattgatactgccgattgctaccctatttatctatcagatggaagtgatggtggtgaattatcagagtcttttattggtaggtggttaaaatcttattcaagacgagatgacctgatcatagcaacaaaattttcagcgccaatgggtgacaatccaaataataagggtgtttcaagaaaatatattatcagggctgttgaacaatcacttaagcgcctgaaaactgattatatcgatctttatcaggtacatgatgattatttcgatgttcctatggaggaaacgctaagtgctttggatgatttagtaagaagaggtttggtacgctatatcggttgttcaaattttgcagcttggaggataatgaaatctttaagtttatgcgagaaacgtggttatgttccctatgtgacagtacaggaaaaatataatcttctggaaaaagatgaatatgaatctgagcttatgggattatgtcaggaagaaggaattggcatgttaccctatgttccactcgcgaaaggtttcttgaccggtaaatatcatcgaggaagtattaataatggatttttcagagaaaaggatgtgagaacactttatgataatgaaagaaattgggaagtcttatatcttattcaggaaattgctgaaaaaaatgaaataacctgtacacaagttgctttggcatggttgttgcaaaggcctagtgtggttgctcctgtagtaggggttaatagtatcaagcaattgaagatagtattagcatcagtcgatgtttctttatgtagtacggatatagaggaacttgaccgactctaggaatatccaggaaaaagggggatgtgtggcaattgctttgatagatcactgttatagtattcttccgactggaaatagacaacaagccatttctttgttaaaccgatctggttttttggttagttctgagcgcatacagcatgatggtggaaaagagagtattttcatccattttactggttcttatctggaattgattgagattattgacctgaatcagtttgaatcttcttgtactgttactgaattgcgagcatcaaagtttggttatccctatgcgttagttgctgcgacaggaaagattaaaaattgtgcaaataaactgaaaaaattttatcaagatgttgctgatattaggtatgttattcctaatatgcaagggtgggaaaaagcggcatgggctattttaaatattcctgagcattatacaccaggatgttattttcaatttatacaatatcttttacgaaagccttcatgggcagaaataaactatggacaaaataatatttatggagtttgtggtttttatttttgtacaaatacgcctatcgaagatagggaacattggtacaactttttttctttgataggagattgctataaatttgaaggaaaaacattatctataggcatacagcagatatattggttacatcctgatgagttttatgcctattttggtgttgaacctaatttggatgaaagtcagggagccagattaagtgctgtaaaacttttatcctctgatatagaagtttcatttaactacttaaaaaagggtgggtttcttatagaaggttataccgaacaaggtttttatacaaaaattgatccaagcttaggatatgccttacatatagtgaaaggaaatggtgcgtttgattatgccgaggatattaatcgacggttactggaataaaactgacacacattttttattgagggtaaaatgaaagactttgatattaatgtatttgatgctcatgttcataccgaatttgaaggtgctccagaccactttagtgggataatatcaagtttagattcctttaaagaatcaataaatgggatcaattttgttggagctttgtcagactctgcagtaccttcacaaaatcatggtgatttgagtgaatatgggatttaccattgtgctgttataagggatttaaattataaaattgatataattgagaaaaatattctttctggcaagatttatgcaataaaaatcaatgttggttttatacatcggtatgcatctgatgaatttttccagccactttatattctcgctgaaaagctaaaagtgccgataatgtttcatagcggtgatccaggttggtctcatgctaaggttaagtatgcagatcctatttcttttgacgaaattgcggttgattatccaggtgtcaattttgttctggtacatgcgggaaatccctggtttcaaagtgcagcagttgttgccgctaaaaatgccaatgtgtttctagaaggttcatcactgattgatggagacacaaaagcatgttctgacgaacgggcaaagaggctgatctcaaaaccattatcttggataattgattatcttggttcttcggaaaaattaatttttggttctggctggccgatggtatatttaaaatcctatctcgatctttttcgtcagggggtacccgaagaagcttggaaagatgttttttgtgataatgccctcaagttatatggattcgtaatagaaaaaagatctgatgggcaattaatatgtgtaccaaaatacaaacggaaagattcaaataatgtccattattcaagtaaataatttatgtaagtcctatgaggtttatactaaaaatccagggttattaggtagcctaaaatcattcattaaaagagaatatgcgatagtagaagcagtaaaatcaatcaatttttccattgacaaaggtgaaattgtaggatttcttggcgctaatggagcaggaaaaactaccacaatgaaaatgttaactggtattattaaaccgtcttcaggacatatccaagtattaggttatactccttatgaacgcaagaacgaatatttaaaatccataacatttgtggcagggcaaaaacagcaattagcttgggatctaacaccaaatgattcttttatactacataaagttatttattccattaatgaaaaagagtttttaaattatcgagatgaacttgtggaaatgctttccctgaattcagtgattgatagaccagtccgccatttatcattaggcgaacggatgaaatgtgaacttgccttgtcattattgcataaaccatccgtattgttcttagatgaaccaactattgggcttgatgtcaatatgcaacgttcagttcgtgaatttattgctcattataatcaaataaacaatgcaactattcttttgacatctcattatatggccgatgttgaagcgcttgctaagcgagtcattattattaattcaggtgggattgtatatgatggaaaattatcacacttaattaaaaagcgctcaccaaagaaaattctaaaggctaccatctcaggcctgataaaaccagaattgagatctctaattaactcatcttccgatgatggtcaaagtattgagttgattgtagagcgagatttgcttccttctgtggtcgcaaagttgatggaagaaaaaatcatacttgatatttctattcatgatgagcctattgaaaaggttttgggaagatatttatcttcatatggtgaaactgatgttgaagcaagttaggagaagcctgctgttatggtgggtacttattggtcaatctttttcaagagtcattgcgtatcgcgctcagtccattatttggctgttaggcggtattatgcctatagcagtgatgtttgtttggttagggttagcaaaagaaggtgaaattggtagttatactgcaagtgattttgcagtgtattttctttcaatttatctcgttcgtcagttaacggcaatttgggttatgcggcgtttagatcgtgatattagacgtggtgaattatcgatgttacttctgcggccagtttctcctctctataattatgtatctgatcatgtaggggaaatgatggtcagaggtcctatcatttcactggtttttatattaggtattttactgacaggtaatttacatcgtttggatattagaaatttattgatttttattccagcgcttgccttggcgtggattattatatttcatctttattattgccttgggttgttagcattctggatcagtaactcgatggcattcgatccattgctttgggcgctttataccattttaggcggagtactcattccacttgatttatatccggagaatgttgcttcatggttaaaattattaccttttgcgtcagcattagattttccggttcaaataatattaggaaaattggatggcttactcttgttgattggatttggagtgcaactattttgggtcattttactgacatgtatcagggtattgttatggaatgcagggctaaaaagatattcagcatctggagcttaatgcaatgagatatatttcattatttttagtattactaagacattctttcttgctagaatttgaatttcgttttaatgctctggtaaatttaatcaattctagtctttcttgtttgttggcattattagtactgacaggatttttcggtcaggtatctcaggttggtggctggacttactatcagatggtagctttattgggggtaacactcattattgagtctttgattgatagttggttatttccaagcgttcattcgctctctgaatatattaggcgtggagatttggatcaaattattattcgtcctgttgatactcaattttttgttagtttccatcgttttaatatatgggatggtgctaattttattgttggttatgtggttgtgttattagcaatgtctcagcaggatgcgttaacgatttggaactttttacaatttaattttgctttgttactaggagcttgtgttttctattccctgtttatgtgttcaaatctgcttgccttttggtttactaaagtgtcagatgtttggattatttgctattcgttaatggatgttgggcgttttccggtcagtgcgtatccgggtgctttacggtttttgttgagttttttattacctgttttctttgttagtaatgtccctgctcaggctgcattgggaataatgagtatggaaacattattattggcttttgtatatgccataggtgctcttattttaactcgttttttctggttaaaagcaatttcaaaatatagtagttcaagtagttagtctattattatacgtgaatatataaatatatttatttaacatcactctggtttttttatcaggggagataagttaatcaatgaaattatctgcatttttgttatagtcgataatacaataaactgacttaccgcttccactaatgaaatcgaagagagtcctttctgagcctgaacggatcacgttgcaacaactcgccctgaatcatccgcatcgggacgtccgtacgagaggaaccggtttgctcatgcttaccagagggttaaagccgcgccagatcgccgttgagacaggatgcagtgtccgggttatctataactgggttcatacatggcatgacttcggtatcgcgggtctgttgggcggccatgccggaggccggtatcccgccatgacgtctgaaatgatcgcaacagcggttgaaatcgcctgttccgagtccctgactttgtcccgatagctcagggggttgaggaaaagtacggttctctgccctgcacgcttgaaacgctggcaaagacactgaaaaaacaggggatcacctataaacgagcccgtctgtcgttaaaaaaaacgcgatgaaacggaatttgctgaaaaatcggccttactggataagattaaggccggtgcacaatcaggccgctaccgtttggtttattttgatgaatccggtcttgccgcgtctcctccggtgcaatatgggtggagtccacggggaaaatcccatgaaaccgagcctcaaaactattgcagacgttccgtgcttggtgcgttgaatgacacggacaacagtctgttttatcagacggtatcaggtcacataacccgggcgaacgtgatagattttttggcacaggtggcaaagcagggagaccattgcctgacatttttagtgctggataatgcccgtatccatcttggtatcgagacaaaaataaaagtggagtggttacgtgagcataatatgtttttactttatctcccggcgtacagccctgagctgaatctgattgaaatcgtctggaaacaggccaaatatcactggcggcgatttattacctggactaaagagacgatggaagaagaacccaatactttactgggcggttatggtaacaaatttgcaattaatttttcttgagtacttatttatatattttcttaatgttattcatgtatatatccagtagtttgcaagatgtagcacgacagcaagtgaaaggatctccagaagcataggctactatgtgactggagtgagtgagcgctaccaccaaagttgcaacttgaaagattacgggtacattgaattactgcccgaatttttttgggttattaatgtaatctttcttttaaattgttaatgaaatcgtcagcacttagtgattttccgcaacttgataggataagatcttcaaattcataataagaactttttttatatattttttcacttagccatttttgtattttatcgaattttccttgactgatttcatttttaattgaaaattctttttctgctttattaaataattgagaagaaataacgtttccaatcaggtagcaagggaaatatccaaaatatcccgctgcccagtgaatatcttgccaagggccttcatgaagggaaggcgctatcccaaggtataaattatataaatcacgccatctattatttaaattttttaccgatagctcccctgagattaattctttttctatcttatatcgaataagtatgtgtgctgggtaggtaaaatcatcagcactaacacgtattccacttcttcttactgtattgaaatgatgaagtaatttttctttgctgaaataatttaggtatccaaattgtttattgagttttttagacagatattctaaatactcacttgagtggccaatttttttttcaaaaagcagggcaattccttcatgaatacacattcctcttgaatcaccgacaggttgcccacgaaattgtcttggtaatcgactttcataagaggcatgtcccatttcatgcataatggctgaaatacttaagataatattatctggtttgaaatagctacaaactctgatatcaccggatattccaccagtaaaaggatggacactctcatcgagtcttcctgtcctaaaatcaaatttcatttctaacattagtttttttgcaaatttttgttgttgatatttaggaattattggccagttatttttttcttttggtaatctgtttcttatagatgtaaagttggctgtgaatgattctatttgattgaatatagggagaatgaaatgatctcttaacccaggctggtgttgttctaatagtgcatcataagcgcttatatttaggctatctccaaatgagtacgccatttctcgtgttagtgtaattaattcttcaaaagatttttcaagagcttgctgatcagtttgattggcttgaaggtgccagactttctcgcatttcatggttgcttgtgtaagtcgatttactaaattttcaggtatttgggttgccatagtatgtaatcggtatatttctctcatattagctttttgccaatcatttaactgggtaatatcaatgcaatttagaagttcagtaatttcctggcttgctagtatttcatgttgcatagtactgagtagtgatatttgttctgatctcaatagatggctacgtatgggcatcattgttcttttatcccaatgtaggaccatgctggcaccatatagtgaattccatttctccattaatttctctaactttttataatatttcattttacacctcatcccattgataaatatatactttattccaatgtgaaccaataattaaatagccttcttcagtgataagaggtgctgaatgtattcctgtgggagcggtaattttccagcgaaactctccatttttatgattatgacaatgtactgattcagcaaaatggttaggatcatcagttgtacccacaaatattggatcgccattggggagggaagaaaatggagtatacacaaaacgggttcctacataatatttccataatatatcagtagttataagatcaatcccataaatatttttatcatcgctacctattgttgctatatgttggtatccaatggatgggcaagaaacaataaatcctcctgtttgatggattgtacgtattctacctgtaattatatcaaaaatgataatttgaccattctcttcggtacctatgatacccgtattaatactgtaatctaaggcagcgctaccttcaaatcttccttcattggcaacttcccaaattgtagtaccgaatttgtcaatacaaattaatatcttgttagttccaaaaataatatttccttcggatgttaaagctggtgaactataaatatcatctataatatttttttcaaaatctcgcttccatattaattctccattatttatattgattgcgtacatagagtgatcgtaactaccagcataaacaattccatttttttcatctattgtaggtgtggaatggaaagcgtcataagcattgaattgccataggcaatgtccatgggcagagatcattcttagggtagcgtcttctcctccgataatgaaatctccatttcttgttactgctggggaactataaatagggccatttgtttttaattgccaaattttctgaaatgtttttagatggtaacaataaatatatccatcataacaacttatgatgaatttattatttccaatgtagccaggaatactccatatacgttcattaagatttatctcaccacatattttaggcggttctgtataattatatcggatggtagaccatttttttttgatacttcttagtgattgcttgtttttataccaggtgttttttagatgtaaattgaatatatttaggttatatgtcattatgtttccttatatgaaaatattagctttcgttacaagaaactatgtttaaattataatattttattattggtctatcctagaattaaaattctagatgatcttagttatctaggatagatctttattatttatggcgttctgaatatctatctaaaaaatattgacgtttgtcgcgtaatgttagagtaaattttagtaactcttccataacatctataagtctatcgtaataagatgatgttctcatacgacctgtctcttcaaattcaagaaaagcttgagatacagataaatggttagggatagtgaacatacgcatatatctgcctattgttcgtaattgattaacaacgttaaaagattgcccccctccattgacttgcagtactgctaatgtcttaccttgtgtaggacatgaaagatttgtctctagtgtgacccagtctaattgtgatttgaatactgcgctaatggaaccatgatgttctggagagcaccagacttgcccctctgaccattgcattaattgttgtaattcaacgactttattatgggagtcagcagtagtatctggtaaggggaggtaaaagggatcaaagattcttgtttcagctcccagagaattcagtaaaagagctgcttcttgaacgagtaaacgactaaaagaaggtgttctgttagaaccatataaaagtaaaatgcgggctttatgtgaaaaatcttgctgtttatccaatagatctaaggaaatgatatctggtaacgcatgagccaaatttggtaaaatatttgtcatcgatttttcccaataagttcattaatatttaatttttttaaaattaactttgatttttattaatacaataatgttatatactttctcataatagttgtatgcccgtcatttgttacctaattatcaattttattattgtgatattaatcacggtttttccattgaattaattaaatttagcagcttcagcacccttatattaaatatactcgtttaatgtacgcaaacactgaacaggtaaggctggcttccctcgctactattgcaaaggctgccaaagaacctttcaactcaactatcgttacaacggccataaaccgggtatgaaagaaaaaattgtggatatggcaatgaatggctctggcgggagagacacaggccgtgtattaggtctcggtatcaatacggtgatgcggacattaaaaaactctcgccaaaacaagtaacatcgcgacagatcgcttatgacgatgtcacacttatctgtgaattggatgagcagtggttttttataggcaataaaaaacaacgtcattggctttggtatgcttttgatacgaaaaggaaacaagtcatcgcccatgtctttggcccccgaacggatgcaacctgccgaaaattgctcaacttattggtgccttttaatattcgtttcatcacgaccgataacgggggaagctatgccagagaagtggtgccggaaaaacatctggtaggcaaaatttttacccaatgtatagagcggcataatctcaatctgcgaattcatatcaagaggttggcaagaagaaccatttgttactcacgttaaatggaaatccacgaaaaactcattggcacatatatattgaaaaacatcattacaaccctttgggtcatgaccaaatactccaactcctgtcgctaaaggaatgtttggtcagcatggatgtggcagggacacaaaccaagattaccgagatgattttagcgaaattagccgattacttattagcagtcaaagagaaccagccctcattatcagcggaagtcacgacgcaatttcagaccttttggcataatacgcctgaggacattgttgggttaggtttttatgaagaatttgatacccaatacggaagcaaagatcatcgcagtctaatcagagcgagttgcgaaaggaaaggaatatgattttgtgagattttttatcagtagccaactaatgagaatgcaaggcaagccctgaaagcgactcgaatgcactggtttgtggagaatcaacttcattggatattagacattgcgttcagagaagatcaacttcaggctcggatggggtatgctgggaaaaatttagccctcataagaaaatggattttgaatatgctaaaacagaatacctcccgaaaattaagtttggagaacaaacgtagattatgttgtttgagtgatgattacttacttgaatcttttgggtgtttctaaaatagacgtttatgcgttagccctgggcagttattgtatgtaaggtgtttgtttgttaaagccactgaatattttttgaaaaattggaaataacgctatgaaagatcctattcgcaatgcctcattgtctgcggtaaaagtggcgagtgaaattgcgtataattatgtcagtgaggttcgaaaccaacgagtatttcccgattctgacgctttatcgggtctacagaatcttgatggggcattacctcaaaatggaacggattgccaacaagtgcttgtgcagctccataagtacggctcgcccgcgacggtagcgacaacaggaggccgatatttcggtttggttgttggtggttcaacgccggcagatattcaacgtagcttgaaagcgattgctgatgcaattgatgaggttaagcgtttaaacagaatgctatgagatatttagtgtctgtgaaaaccaaaatccgcgccatagcgcggattttaaaggagttctcacagggtcgagataacgtgagatctgataaagacagaatcgtttaatcagacgttaaacaagaagttcatcacatcgccatctttaacgatgtagtctttaccttcagcacgcattttgccggcttctttcgcgccttgttcacctttgtaattgatgaaatcttcaaacgcgatggtttgggcacggataaagcctttttcgaagtcggtgtggattttacccgctgcctgtggcgctgtggcaccaatcggaatcgtccatgcgcgaacttctttcacgccagcggtgaagtaagtttgcaggttcagtaattgataaccagcgcgaatgacacggttcagacccggttcttccagacccagttcagccatgaattcttcacggtcgccatcttccagctcagcgatatctgattcaatagcagcgcaaaccggaacaaccacagaaccttctgtttctgcaatggcgcgaacggtatcaagatgtggattattctcaaaaccatcctcattgacgttggcaatgtacatggttggtttcaaagtcaggaagctgaggtagcgaatcgccgctttttcttcagcactcaggtctaaggcgcgtagcataccggcctgctcaaggtgaggaagacatttttccagcgcatccaattctgttttagcatctttatcgccacctttagcttttttctgaacgcggtggatagcacgttcacaggtatccaaatccgccagtgccagttcggtattgataatctcgatgtctgaggctggatcaacctgaccggaaacgtgaatgatattgtcgttttcgaagcaacgcacaacgtgaccgatagcttctgtttcacgaatattggtcaggaattgattacccagaccttcgccttttgaggcacctttcaccagacctgcaatatctacgaattccatcgtggttggcagtatgcgctggggtttgacgatttcagctaattggtcgagacgtgggtctggcatcggtacaacaccggtgtttggctcgatagtgcagaaagggaagtttgctgcttcgatacctgctttggtcagcgcattgaataatgtagatttcccaacgttaggcaggccaacgataccgcatttgaatcccatatgtttatcaccttaaatcacttataaaccaacagacaagatgcctgtcggtgagttatacaaaatgggcgctattatacacgcaataatcagctgcgccacgcactgcctgttaagctcctgctctaaaggcatgcagacggttaatggccttgttcatgccttctttcatcagaatatcagtacagctcagtgcttcatcaatggcttcatcgattagcttctgctcactggcaggaggcttgccaagtacaaaacccactactttatttttgtcacccggatggccgatgccaatgcgcagacggtgaaagttagggttattactgaacttgttctgaatgtctttcaaaccgttatggccaccgttactgccccccagtttcatttttgctacgccgggtggcagatcaagctcatcgtgtgcgaccagaatttcatccggctggatgcggtagaatccggcgagagcaagaactgatttaccgctgaggttcatgaaagttgttggcaccagcaggcgaacatcttgcccattcagattgatacgggcggtatagccgaaaaatttactctcttctttcaggggctgtctgtggcgttgggctaacaaatcgacaaaccatgctccggcattatgtctggtctgtgcgtattcagccccagggtttgccagaccaacgattaattttatgttactcacagtcttagttcgcttattggcaataaaataaaaaaaggggtttagtttacctgcctcaaggcttgagtacaaaattcattatgatattgaaaggaaaggggcgttattccttaatagttgttcaatgtgttaaacatggatgttaagtaattgttattaattccccctcaggtgaagtgtaaaaatgcgttgagatttatacaacttgtgatcgccgccgcaataaccttttagataataaggctataatataaccaaggatgtgtctactttcgtgcttttgagttcgtttcgtttgcaaattgagttcagaaaagtattggaggttggtgatgaaacgtaaaaatgctttcattctcggtaacatttttatggggttagggatggcggcaatgctgattagtctgtcttttgtactgctcagtcatgtgtttagtttagaccagtctggatttgccacaggtatctcactgatgggtttatttgttggtgcattggtttggttggcaggtgccagtatcggtgggcgtgagcaggttagtgataagtattggtggttgaagaattatgacgagcgttatcgccgtaaaaaacacagaacatcatgatttttatattattatttatatctaggcaaggcggttattgatgaccaccttgcctttttgcttatatcagaagctggcgttgatgcccagactgaaattgtagttatgctcctgagagttaccctcgttacgggttacagaagcgaagccgcgccagttattgaacaggttagcattcacaccgacagtatattgacgccagtcagtgttctgtttgccactttcctgtacaaaggaaacttcagtggaattgatggcgctgctcagtttatagcgtgtgtcaccgaactggtgattaaactggacagaggcataaggattgaaacggcctaattgggtatctacacgccagcccagtgttccgactttagacgtgtagttctgatcagcaaaatgcatggaagtactgttgttaccggattcacggtagcctttgatatcacctttatcccatgcatactggataatcgggctggtggtgatttgattggtaacagcgatatcccagccagctgtgaggcgtccaccccattgtttaccggtggtagaaccggtttcccggcgtgtcgcctgacctaactgaataatacgtgtcagactatcgtatttgttgtttgagtaatggagatcgccacttaaccaacctttgtcatagaagttccacaacgcgtaacttgtcactacgtgagcacgtccttcatgcgtgaaattggaggcagaggtgcgttcatccttatagttagaatatacagcgcccagcagcaggttatcagtgagctgataatcaccacccagtgtgaaggtgttgttgtggctgccggtgtagccgccaaagatgccaattttaccctgagcattgccaccattgcgaagttgttgcaggtgaccatcaagggaagagcgaacacctttgacggggatacggttgacttgattcagggtcatgacctgtgatggcgcattgtagatggattcaatatattgacccagtatgagatgacctagcggggttgggtggaggctatcagcaaataaaaatgactgattactgtcaaattttgggtctttggaagaacattcagcatcagacaatgattctgagcaggcatagccaagagtattggaaataccataaaccagagggtttgcgatgacttccttgagcagaccgttggcatcgacacgcataatattaccgttgctctggctgattttctcatctaccagtttattataggcatcggctagatttgtggcacctttacgcgctacgccataggcagccagaagcaatgcttcggtctcggctggatcagtggtttttgcagcgatttttttcaacgcaccgtctaaaactaggtcgcgaacctcattattaggggtaggatattcgttaattcctgcgcgaacttgttgtaaaattgcgttgatatcatcttgggatttgccttttgtttgtaacgcaccgctgagcactgtttccaacagtctgggtgtaataccaacatcaggaacagttggtgcaataattaagccagcaccggcgttaaccagcagattaatctgttctccggcggcagtggcactcctgttgacaatatcataagcatcaaatggattcttttggccagcgatcaaagcggctgcgagatcattgccccctatccagtgaatatacacaccattagcatctgcacggttattatgtgcagccagatattttttgacttgctcagtggtattatatttagggtttaatgacccaatagcagtagcgccaccttgggcgtaattggtgccaccatctttggaagcagtgggtttactaccagtaatatgttcagcaacatactcagcataaagctgactggtttctccatctgtggtatatcgcccattattcccgctatcactcaggctatcgccaaagtcataggtgctgtcataagcatgggcattggaaatggtactgattgaaagcgctaatagagcaggtgtgaataaaaatgcttttttcattggctcttctccataaaaagtaattttttatttatcagcgtattgccatgcaatggcaaaattcagacgatacttcttctttgcgaagttagcggcgctgatgtgctagatactttaaataaatttatgttatacagatgatttagtgacaactactgtccttgattaaggatgattccctgttaactatattccatatcactttgggctttttagatataatatgatgcaaaagcatactttttagactgtcagagatgacgataaaaagtcacaatagccgctaccgattgtccggcaggttagcagcaacggtaataacacaccagaattgttcgggagttagggtactggacgtaccagatgatttattgttcgtatatgatgttgtctttttcttgaacgcatgctcagagtgcaaactctgttggggatgataagtgttggttaggttaacgtattgataaaaatgattatttgattattgaaattattcattcttgtgattaattaacaaagaaatattgacgatgtgtattaacatgacggaaaaaacccgttgacgcatccgcagcaacgggttttttcaggcaatgatttatttaatcacttgaataagttagcgcttaaaataagtgctaaaacttaaaattagtgctcaaacatcgcagagattgactcttcattgctgatacgacggatagcttcagcaagcatgccagacagtgtcagagtgcgaactttattcaacgctttgatctcagcagacagaggaatggtgtcacaaacgataaattcatctatcactgagttcttgatgttttctactgcattaccagaaaagatagggtgggttgcataagcaaacacccgtttcgctccacgctctttcaatgcctcagcagctttacacagcgtgccacccgtgtcgatcatgtcatcaaccaggacgcagtcacggccagcgacgtcaccaatgatatgcatgacttgagaaacgtttgcacgtgggcgacgtttatcaatgatggccatatccgtatcgttcaacagcttggcgattgcacgggcgcgaacaacaccaccaatgtctggagagacaacaattgggttttccaggcctttctgaagcatatcttccagaaggattgggctaccaaatacattatcaaccggaacatcaaagaaaccttggatctgctcggcgtgtaggtcaaccgtaagaacgcgatctaccccaacgctggacaaaaagtccgcaacgactttagcagtgataggcacacgtgctgaacggacacggcgatcctgacgggcataaccgaagtaaggaataacggcagtaatacgtccggcagaagcgcgacgaagcgcatcgaccataacgaccaattccatcaggttgtcattggttggtgcacaggtggactggatgatgaatacatcaccaccgcgtacattttcattgatttgaacactgacttcaccgtcgctaaaacgaccgacggcagcgtctccaaggctagtgtacaggcggttggcaacacgttgtgctagttcaggggtggcattaccagcaaaaagcttcatatcgggcacgagaaaaacctcaggcttgcgtccagagagatattgttgaccaatcgaacactattgttcattggttcaataacatgtatatcccagagcggaatgtatgcaatggtgaaatgttgactccacgcgcaacaaagccctgcatccactctggggattgatttaacaccttacgggccgatgcttctgattcgaactcgccgaaaacacacgcaccggttccggtcaggcgcgacggtgcgtattctagcagccatgaaagaagctgttcaaccttacgaaaacgttttcttgcgattgattcacaatcatttgtaaatggtgcctgtaataatgcgggtagagaacgaatcggagaatttctttttaattcaggatctgtgaagatcgtcggcgttgaaatctcaattccgggatgagcaaccagaaaccacttttcttccggtgatgccggccggagtttttccccaatgccttcggcaaaagcggcatggcctttaataaatacgggaacgtccgcaccaaggctgataccaagctgtgcaagttcatcatcggacaagttggcttgccagtggtaattcaaggcaatcagtactgtcgcggcattagaagaaccaccacccagacctccccccattggcaggcatttgtcgatgtggatatcggcgcccagatgttgggttcccttattattattctgtaataaatgatcctgcaataatcgggcagcccggacgatcagattattgtcatgagctacgccttcaacgggcgtcagcaggtggatttgattatcctgacggggggtaatcgtgatctcgtcgccatagtcaagaaactggaacagcgtttgcagttcgtggtagccatcagaccgttggccagtaatatacaagaataaattcaattttgccggggaaggccaagtcaacgtcattattgggttgtccagttatccatttttaattttatgcggttcttgccctgagtgagttccaatcgattaggcaacactggcatggtcgaagcatcataaccctgataattgactttccagatctcaccatttttcttgctactcaccgatttgagcaggtaattctcatctaactgaaaatctttggcatcgccgggtaagccaataatccagtttttcagattatccagaggaatattcatattggtaagctggtaaattagtgactcaggagtatcactgaggtattttttaccattattatcagtaagctgaatcatattcggctggacaaataattccaattctgttgtacctagtggattaagcaacaacagtttatagttatcaggcgaatactgttgccagaaaaagcgggcatagactttcttttcatttgccagataagcaaaagaacctcgggtctggtaatttttcagtttttgcagttgctgttcacggatatgccattgcggagaattggcggaacctgtacctgtaggaggctgtgtgacggtacaggctgtcagcaaaaccgcagagaggggaagtaagcgaaaaagtgatgatattttcattcagtaacccttagcaataaaatagtctgatgggtaactaacgcgctatccaagtctataatcaaggtgataatttagcgaaattttgtcaaaatttctcgaataaattacggcatagccgtccgattgacttttattgaattgatgcatcaagtagaatgctcatccaatgagagtccttatgaagggtgtgagtttcatgagaatggttattaatattatcatgagattgattcccgtgataactcaatgcagttaaaatgactttattagcactcggtatcaatcataaaaccgcgcctgtttccttacgtgagcgggtggcattttctcctgacacaatcgggcttgcgcttgataacttgctccagcagcggctggtgcgaggtggcgttgtgctgtcaacctgcaaccgcaccgaactttatctcagtgtcgagccgcaggataatttaaaagaccaattaatcagttggttgtgtgagtatcatcagctcaatcctgacgatctgaaagccagcctttattggcatttggataatgatgccgtcagccacttgatgcgagtggcgagtggtctcgattcgctggtacttggggagccacagattctggggcaggtaaagaaagcctttgccgaatcgcagaattatcaatccctgtcaggggagctggagcgcctgttccagaaatctttttcagttgccaagcgggtcagaacagaaacggaaattggcgcaaatgcagtttctgtggcttttgctgcctgtacgcttgcccgacagattttcgaatctctgtctaaattgaatattctgctggtgggggcgggggaaacgattgaattggttgcccgccatctcaaggaacaccgtgtgcgtcacatgatgattgccaaccgcacgaaagagcgggcgcagacactcgccagtcaagtgaatgcggaggttatttccttgtctgaaattgatacccggctggcagaagccgatattgtgatcagttctaccgccagcccactgccgattatcggtaaaggcatggtcgaacgggcattgaaagtccgccgcaaccagccgatgttgctgattgatatcgctgttcctcgcgatattgaaccggacgttgaaaaattgagcaatgcttatctatacagtgttgacgatttacaggccattattcagcaaaatctggctcaacgtaaggctgctgctgttgtcgcagaaggcattgtgcagcaggaaagccgctattttatggattggttgcgctctcagggggcggtcaatacaatccgggaatatcgggaacaggcagaaaaagtcagagctgaaatgacagcaaaagcattgatgtccatcaggcagggtgctgatgctgaacagatcattaaccaattgactcaccaattgacgaatcgtctgctccatacaccaactaaatcacttcaacaggcggccagtgatggcgatttggaacgcctgaatctcttacgggacagccttgggctggatcataactaaccctattcgaattaaggtctgatattacgaatgaagccttctattgtcgctaaactggaagcattgcaagaacgccatgaagaaattttggttcacctcggtgatgccagtgttattgctgatcaagatcgtttccgtgcattgtcaaaggaatatgctcaacttaccgatgtgacccattgtttcaaatcctggaaaacggttcaggaggatttacagacagcggagatgatgcttgacgatctcgaaatgcgggaaatggcacaggaagaactcaaggacgcaaaaattcgtaatgaagagctggaacagcagctacagctactgttgttaccgaaagatccggatgatgagcgcaactgtttccttgaagtccgggcaggaaccggtggcgatgaagccgcgatatttgcgggagatttgttccgcatgtatagccgttatgcggaagcccgccgttggagagtggagattataagcgccaacgaaggcgagcatggtggctacaaagaagtgattgccaaagtttcgggtgatcaggtttatggtcatttgaaatttgaatcaggcggtcatcgtgtccagcgtgtaccggaaacagaatctcaggggcgcattcacacttctgcctgtacggtggctgtcatgccagaaattccagaagctgaattaccggacatcagccctggtgatttgaaaatagatacgtttcgctcttccggtgcgggtgggcagcacgtcaataccaccgattctgcgattcgaattacccatctcccaacggggatcgtagtggaatgtcaggatgagcgttcccagcacaaaaacaaagcaaaagcgatgtccgtattggcggctcgtatccgtgctgctgaaatgcataagcgtcaagaagcggaagcctctgaacgtcgcaatttactgggttccggcgaccgttcagatcgtaatcgcacctataatttcccacagggacgtgtgactgatcaccgaatcaatctgacgttataccgccttgatgaagtgatagaaggcaaactggatatgcttattcagccgatcattatcgaatatcaggcagatcaactgtctgcactgtcagagcaggattaatgaattaccagtgctggctacaacatgcggctacacagttgtttgagagtgacagccctaagcgtgatgcggaaatcttattgggatacgtgacggggcgttcccgtacttatttgattgctttcgatgaaacgctaatctcatcggaagaattacatcagcttgatagcctgttggggcgccgcattcagggagagccggtcgcttatattattggtgaacgggaattctggtcactaccgtttgccgtatcaccagcgacgttgatcccgcgccctgatactgaatgtctggtggagaaggcattggaattattgcctgattctccagcccggattctggatctggggacgggaacgggagcgattgcactggcattggcaagtgagcggaatgattgttatgtgacgggagtcgatatcaactctgatgctgtgatgctggcgcaatacaatgctgaaaaaaacgccggaaaactggccattcacaatgtgaattttttgcaaagtgagtggtttgcagcagtgggtaaccaacaatttgatatgattgtcagcaatcctccgtatatagatgagtgtgaccctcatctacaagaaggggatatcaggtttgaaccagccactgcattgatcgctgcacaaaatggcatggcggatttgcaggcaattgtgggacaggcgcgccatttcctgtcaccaaatggatggctattgctggaacatggctggaaacagggaatcgttgtcagaaacctatttttagagaagggttatcaacagatagcgacttttcaggattatggcggtaatgaacgcatcacgataggtcgatggaataaaaatgaaacccatagttaattatgaattcaataatactcccctgattgacggtattattctggtatcaaaaattatccgccctgattttcctcagactctggtgagtgagcagctgacagcattggttgaagaagcccggcagaggctttcctccattaccgattccaaagtgaaattggattcgctgctgacacttttttatcgggaatggaagtttggtggagctaatggggtgtattgtttgtcagataccctgtggctggatcgcttactccattcacgtcaaggttcacctgtatcattgggtacggtgtttacgcacattgctcaggcgctggggctgtcggtacagcctgtcatatttccaatccaactgatattgcggattgatttgcttgatcagcccacttggttcattaatcccttgaatggggatacgctgaatgaacatacgctggatgtctggttaaaaggtaatattggcccaactgttcgtctgaaaaaacaggatttgcaggaagccgataatgtcagcctcgtgcgcaaaatcactgacaccatcaaagtttctctgatggaagagaaaaagatggaactggcgcttaaggccagcgaagtggtgctgacgtttgatcccgatgacccctatgaaatccgcgatcggggacttatctatgcccagctcgactgcaatcatattgctgtttcggatttaagttattttgtcgaacattgccctgaggacccaatctcagaaatgataaaaatgcaaattaacaccatagaacagcggttgattgtcctgcattaggtttatttttttattgatacagcaaatttatttgcccttaacaagagaaggtataagcatgcaacagaaagtggttaatattggtgatatcaaggtcgcaaatgatctgccatttgtattgtttggtggaatgaacgttcttgaatcacgggatttggccatgcggatttgtgagcactatgtcactgtgacacaaaaactgggcattccttatgtttttaaagcgtcttttgataaggctaaccgttcttctatccgctcttatcgtgggccagggctagaagaagggatgaaaatctttcaggaactgaaacaaactttcggcgtgaaaattatcactgacgtgcatgagcctgcacaggctcaaccagtcgcggatgtggtggatgtgattcagcttccagctttcctcgcccgccagaccgatctggttgaagcgatggcgaaaaccggtgctgtgatcaatattaaaaaaccacagtttgttagccctgggcaaatgggcaatattgttgaaaaattcaaagaaggcggcaatgaccaggtgatcctgtgtgaccgtggcagcaactttggctatgacaatctggtggttgacatgctgggcttcggtgttatgcaacaggctacccacggtgcaccggttattttcgatgtcactcatgcattacagtgtcgtgacccattaggtgcagcgtccggtggccgtcgtgcacaggttgctgaactggctcgtgcgggtatggccgtggggatcgccggtctgttccttgaagcgcatccagatccagaaaatgccaaatgtgatggcccgtctgctttgccattggcaaaactggagtcattcctgatgcaaattaaagcgattgatgatgttgtgaaaagttttccggaactggataccagcaaataaattcctacgctagtcttttgttagtcaccctctgccagttatgctggcagagggtgactaattgttactgaccttgaatcttttctgaagaagcacacacctcagacgtgtaattaactgccatctcttttagtgccttgggcaaagttgcataaaaactcagttctccttcaatcggtgtaactttggctcttgccagcgtttttaatggctggaagggaatatcacatacaacgatatgtttttctttgccaagttcgcgcacaaaaccctgaaaagcgtgtaatccgcctgcgtccaaaacgggtacggcatcccactgcatgatgatggtttgataatcagcacttttttctctcagttcggcaaaaatacgttcggcggcagcgaagaataaagggccgttaattcgtacaaccaataaccctttatctgcgctcgttaaagacgaagtgctgatacgcgtcatattggcaattttgcgcataaacaggagcgatgccagcacaatgccgatagtgatcgcgacgaccatatcgaataggacagttaatgacagacataaaagcatgacaataatgtcatctttaggcgcatggcgtattaaatccaccaccttatgtgcctcgctcatattccacgccacaatcagcaaaatggctgacattgccgccagtggtaaataagagagcatcggagccaaaactagcaatgttaataataccagtagagaatggactacagcggctatcggggaagtcgcgcctgcccgcacattggcggctgaacgggcaatagctgctgtggcggtaatgccaccaaagaaaggagcggcaatattgcccaacccctgaccaagcagttccccgttagaatggtgctttttccctgtcatgccatccagaattactgcacacagtaatgattcaatcgcacccagcatggccatcgaaaaagcagcgggcagcaatgccgatacggtattccagctaatattgagagaatgtgtatcgggcaaattccacgggaggacaaattggggaagaatggggggaatgccttggccttgtgtgccgtccgacagtgtgtaactaaaagatgaaccaatggtggcgacatcatagcctaacaggtgcatcgcgcccataaccgccgtacccgtgattaaagcgggtaagtgacccggtaactttacccccagtttcggccagaaaatcagtaccagaagcgtagtcaacccgataagcgtatcactcaattgtaatgaaggcagtgcttgagaaagtgcaatcaccttatcaatataattttccggtatgtgtaccagtttcaggccaaagaaattttgaacctgcatggtggcgatagtgatggcaataccggaagtaaatccaagggtaacagacataggaatatattcgataaaccggccaaaacgtgccaatcccatcacaatcaaaatcacacctgacatcagcgtcgcaatgagcaggccgctcaaaccaaattgctgcgaaacaggatagaggatcaccacaaaagcagcagttgggccggaaacgctatagcgtgagcctccggtcatggcgatgacaatgccggcgatagcggcagtgtacaggccgtactgtggcgcgactccgcttcctatcgccagagccattgccagtgggatagcgataacacccacggtaatcccagcgatgatatctctgataaaacgggggaaagagtaagattccttcatacatgagtcaataaacgcactaaatgggcgtatcccattaattttacgagtattcatttaatctaaaaccaaaaaataaggcgtccgcatgacgggctgaaaaagaatatgtaagagtatctcttttatcacccaataaaggtgttacaggtctaaaagtgagttaatagtagtacagtcgggaaaatgtagcattgttacgttctgatttttcagattaaagctgaattaaggctgaatatttcaacataagcagaaacaggaaaaacattacccattgcaggatcagaccaatcgtagccttttttaacagtttgattgctccgttaaagcgatcattctgggtccgtgattggggtaacttattaaatatcagcaataacgtttgatcgaactcggcacttttttcaggggatgaattgaggatctgaaaatagtggcagtcaagccaagtgcgccaacaatagtattggcagtacagcgttgtgaataatagtacggcatagagtgcaatgttgtttaaggtggcagtgttgaagacagcaatcagtattgctgttgcgctcaggatagaaaaaacagatagtgccgatataaagcgccagctttttaacgttgcgataatcactttgctgatcagattttcctgctgcatgttatgttccccgttataggtagatttttgcccattgagacagggcatccagatgtgtttgtctgaacgtgacatgcggtctggctttacgcaggattgctacgacagtgttgatatcatattcaggatgctgtttcagcagccatgctgctatcaccatcgcactacgtgacaggccaagcgtacaatgaacgaaaacatctccctgctggcgtagtttatccaacgcacaaattgctgattgcagagattcaggtgtcagcggcagtaagtcgatttgcggctggcaaacatagtctactgtgtgggaatcagatcgcctgtgccattcagcggtcatatcaaggacactggctgtcgtgacgggttgacaaggcaggctaccgagaataattccttcagttatgtggctgaaaggtgtgcttttacgccggaaccagagataagagagccatgctcccagttggtatggcgccagtagccagcgtgcagacagtgacatacggccatctggctgtttttgaaacacggagctgcctaatcctgcataacccagtgcgaccatcagtaatgatacggcaggccacagcagcagccagaaactaccacccagcagatatgccataagcgcgaacaacgcactgcctgtcaaataatagctgaacaactttcgtgcatagcgatcttgattggattgccagcgccagcggtatgaaactggcagtaggtaactgatgatgacaccaacggcaaaacccgtgagcatatcgacaaaatggtgctgccaggttgtcagaaccgatagtgcaaccagcactgaccaaatatgtagcaatccgcgccagtaaccacacacgtaggctgaatagcgcagccagagcaaccacagcagaataatgtgcagggaaggcgcttgattatagggcagatcaaataacgccagttgattaaataaccagccaaatagaccttctgtggtggggcgggagagcgaaaatttcaggggaaacagtaggaatccaatgcaggcaatcagtgatgcggtcattaatcgccagccgtgaagccactgttcacggcgatgggtacagataaataacgatattccgtagaacaggtcgatactccagtaagggataatcgaccatgaccaaaaagggatgttatgttcccaaccgaacatcacagtgccgacatcgcctctttgtgccgtgaactgattgacctgaccataagtaagaaagaaaaacggagtcagaaacaatagccagataacacctgtcagccataggcgtcgacgactatcgagagaagagtgcatgtagtgttccatcttatatttatttattcatcagcgatgaacgcgcttggcaatcgaaacagtgaaaatgccccagttatctgtcagttggtacagtttttcaaacccggcggcttccaccaatgcgtccatttccccttgagtacggcgccgcatgatccacggttgattgtcacgatggctggaaagaacacgggcgatgacctcaatttgtggatgccacggttggccggtgtacaccagataaccattttctgtcatagcatcagcaaagccgcgtagagaatttctgagtaaattattatcagggaacaattcatagagaccggacacaatacccagtgtcggcgccggcgtaatggatgcgatactttcagcattaaaggcatcgccgataacaaaacgaattttgtccgtcagatcgcgctcctcaatataagcctgcccttgattgacattgatttcgctatagtctcttaacaaaatagagtcgactttactgaaatcgttgattgcgtcaagaatatagcgaccgtgtccggcagcgatatcaaccatatgcacaggcatattctgttcacgtagactgcgaatagcatggcggatcaacatttcaatatggatcttgcgctgccggataccgcgccagccaatgctgttcaaataatttttatcgagcattcgccccaaaatgcccttaccctgcggttggttgcggtagacataatctaatgtggagccggaatcaaaccccgttttgagaccgatgcagataccctcggaagctctgccccagcgagtattcattaccttacgcatcaactgatagctgagtttcttcggacacagactcggtaatgatgtgctgagtgttcgaaattcatcggcagagtgactccaggtatcttctcggctgtaatcgtgctgataacgcggaagtgcaaaaacgcgttcaataaagacccggattttgtcaaaaaccagatggcgatctttttcacccaacgtatcgtggtagaagccatccatcacgtgtttttctttgataggggtatttaactgctgataaaactgatgctgtggttttttgttcacgacataatcactgcctgaaataaacaacagggtaggtagtgtaatggcggcggcatctttaactactcgctcggcggtttggtaaagatccaagagaatattgacggcgatttcccgggtaatcaacggatcgctattataagaggcaattcgggtttcatcgtgagtcagatacctggctttcacataggaattcacgaagaaaatacctcgtgctttttgcatcaattgcagtccctgcgtggcaaaagggatatacaatttaatatcaaatgcgggtgctgcgaggatcatggcgcggattttcggcgcatagtcgtgtacccaagcagagactaataccgctccgacactctggccgataactacgatatttcccatggcgatgttgtactgattggcaataaatctgacaaattcatcaacatcacgaatcgacgttcccatggaagggctgtaaccgcgtggcccttctgtcttaccgtgtccacgggcatcccacgcaaacataggaacatcaggcagatcgagtccgtcaatgacatgctggatgcgtcctgagtgctcatgaccacggtgaaaaataatgatcgctttgtctggattggcctgttgctgtggccagtaacggtaaaatagagaagcattatctgatgtggtgaaataatgttcttcagcaatacgttgatcgagttgtggtgtcatgttaacgcctcatttggagtgtgactgttcagccagccggatttcacgtaaggctttaacaacgcgctgatagcaagtcactaagagtaaaatgatcatgaaagcaaacaaagagctactccagcccaaggccgaagggaaaatcgcaataatcaacccataagctccgaagataaaagcacggtcactttttcctatcgggccgtcatagcgccgtgatgaaccaatcgtttgtgccagtacgccgatgaattcggtcaagatagtgaggaataaaataatcaacaggctgaagctgttcacatcaggtaaaaggcagaaggggagatagagggcaacatcagaaatgacatcccccaattcattataaatagcgcccagatgggacttctggttatgttcccgtgccagcatgccatcaatggcattcagggccatgcgaatgaaaagaaaaatgggtagcagccagtagaggtggggcgaaggaaataggctcaatagtgaaccggcaaagattgacaagaacagcgcggttaaagtgacctgattcgcgttaattccttgtttatacagataaattacgataggacgcagtagattttggaaacggggttttaaatcgtatatggtcattttctctaagtcctttagaggtcaatttatcagcattattaataaaataaaataaaataaaaaatctgaaagggcaattaagataacaatgatcttatttaagggatcaaaaaactatctttttaatcaattaaattatgatagttgcgtattattagagattgatgagtcggttaacttgaatggatgggacgaattgtctagagcacagcgtttgttatctctcatggaaatattgcgccgttatcactttccggttcagggaaaagtgttggcgcagaaattgaatatcagcttaagaacgctgtatagggatattgcatcgttgcaggctcaaggcgcgattatcgaaggtgagccgggaataggatacgttttgagacctggatttgtgttaccaccgctcatgtttacacaaaatgaaatagaggcgttggcattgggcgcgaattgggtggctaaacgtgcagactcccaactaaaagaatctgcaaataatgcaataagcaaaattgcggctgtgatcccggcagaattgaaacaaatgttggaggcaagctccttactgatcgggcctgctgcgacggctgttcagccggttgtcgagattcagcagatacgtcaggcgatcaatacccggcataaaatcactttcgcttatctggatataaaagatatcccatcagaaagaacaatatggccattcgccttaggttattttgaaaatatcagcattgtgattggatggtgtgaattacgcgaggaatttcgtcatttcagatcagataggatcatgcgtttgaaaattgaaaaacaatgttacccccgttcaaggcaagtattgctcaaagaatggagagcaatggaaaaaatttctcgttagccaaataaagactactgacagaaattgtcactcaccattgatactctgcgggcagttctactgtattaaaaagctcgcttaatcttcaatgtgatacatttaactgtgagagttttgtcatgttaacactcaaattttctacatcggtaaacgctaaaccatcccatatttgggcacattatgttgattttaatttgcggaaaaaatgggaaatcgatcttgaatatcttcaatttgaaggggagatcaaaacgggtcaatacggcaaaatgagattaagtggaatgccggaaattcgcttttatctttcaaatatcgaagtgaataaagaatttaccaatcaggttaccttccgcaaatgggaatattaacgttcagacatcaaattattacagatgaaaacaatatggcgtgccgtattcaggtgaccgtttcatttgaacctgatgctaatattcccgctgttcaggccgaaggcttctttaagcagggtacgcaagatctggttgaaaccgtattaaggctgaaaaatatcgttgagacagtatccccaaaacccaatctccagcttgtttacgtctctgatattgagcattcaactgctttttacaaaacaattttcaatgccgaaccgatatttgccagctctcgttatgtggcattttctgctggtggtgaagtattgtttgctatttggagtggaggagtaaagcctgatcgtgctattccgcgatttactgaaatcggtattatgctgccatccggtaaagatgttgatcgatgctttgatgaatggcgaaagaaccctgagatcaaaatagtacaggaaccccataccgaagtttttggccgtactttccttgctgaagatcccgatggccatattattcgggtatgtcctttggattagcctagaataaggtgtaattaagccataaatctttaagatattcccattagagcaggttgttgaggtgaactctgcgaagcttttcacctttatttcaggggaatataaatgcgaaaaatcctgaacataagttcaggatttttcttgagatatggcggtgagagaggggttcgaaccctcgatacgttttcacgtatacacactttccaggcgtgctccttcagcctctcggacacctcaccgtgttttgtttctgcggttatcctgttaggaatttccgcaagggttactaaataatagattcaacgccctatcaagagtaaccaaaaaagcctgattattgtgttcaggctcttttttagaatatggcggtgagagaggggttcgaaccctcgatacgttttcacgtatacacactttccaggcgtgctccttcagcctctcggacacctcaccgcattttgttgttgtagcgatatcacttgagttcgtcgctgcaacggggcgtaactatagggaaaagcagggcaggcgtcaacaggcttatgacgattttttcaggctttttgactgattacacaaataaaaaacaatttgaatgtttgatagtcatttactaaagcagatgcactttttgtaatatgtagtggtaaatatgttaactgggtaacattatcaatattttcattcctcgctttttggcagaggcttgcaaccatttcagcaatcggttaaccctatcaaaaaaacaacaaggaataagattgtatgaatattattttttttcactcttcctctaataccgatgagtggattcaaggaattcaggcacgtctgcctgatgccaaagtgaggcaatggtttagtggtgatcaagagcccgcagactatgcattagtttggcagccaccttatgaaatgttagccaatcgtcaggggctaaaaggcatattcgcactgggtgctggtgtcgatgcgattttcaaacaagaatcgaaaaatcccggtatgttaccggctgatgttccactgatccgcctcgaagatacaggaatgggcaggcagatgcaggaatataccattacctcagtgttgcattatttccgccgtatggatgaatataaacgataccaggaacagcgcctctgggctcctatgtctccacataaccggaaagaatttgttatcggggttttaggagccggagtattagggctaagtgtaattgggaaattaatggaatttgatttcaatgtgcgttgttggagcaggacgccaaaacaactcaatagtgtcgaaagtttttacggtaaagagcaattgggtgattttctttctggctgcaaggtgctgattaaccttctccctgatactcccgaaacgcgtggtatccttaatctgtcattattcagccaactaaaatcgggttcatatgtgattaatctggcgcgaggagcgcagcttgtcgaacaggatctgctcgttgctattgataaaggttatatcgcaggagcaacccttgatgtgtttgccgaagaaccattgtcaaatatgcacccattctggactcaccctcgtatccatgtgactccgcatattgctgctaacactgttcctgaggctgctatggatgtcatctgtgaaaatatccggcggatggcacggggtgaaatgccaactggtctcgtcgatagggaacgtggctattaacaagttgctttacagcatggcaggcgattagggacaataacgctatttgataatctattgggattgaatcaagttatgaacgaattttctattgtttgccgtatattgggtacattgtttaaccgcgcaccgcaagatcccgttctgcaacctttaatcactatgattgctgaggggaaactaaaacaaggcatggcctttggaacaggatgaatggctggatcgtttacagcgtggatnctntacagaagtgacggatcgactaacccccgttagctcnnttaaaaacggaaanntgttattcctaaaat

SEQ ID NO: 14980 - DNA, 134770 bp, Xenorhabdus bovienii
  Genomic contig Name=Xb4151_4152.C439
tggcttaaagatgggaaaatgactgccaaataggcacaagagtgggaatatttactcatagtagccataattctatacgtctttacaataaagaatatcataatattccttttcaagaacttcaaggaagaataaaaggtagtgttgagattgatgataatacttttattggcgcaaatgcaatcattatgcccaatacaaaaatagggaaaggatgtatagtaacagcattctcttatgtgcaaggaaattttagtgacttttcaataatcgctggaaatcctgcaaaaaaagtcggagatgtacgaaagattgattatagattattaaaaaaacatccagaattaattgaatcatatttaaaatattttaactataaatctattggggctcttattgatcatgaagaataataaagaattatataaaaatctctgcgaaacagagaaaacaatccctatatttagtcaagcttggtggcttgacgcaactgcaggaatagaaaattgggatgtagctatcgttcaaaaggaaaatggagaaattattgcctccctaccttatatgataaagaaagttcaatttctaaaaaaaatcactcagcccaaattaacacagtttctaggtccctggttcaaggaaaataatagcaattacaccaagtcactaggtcaacaaaaagatctaatgttttcactcatagagcagctacctgaatttcattccttttctcaaaattggaatcattctcaacaaaattggttgccattctattggaaaaatttttcccaaagtacaagatatacatatagaattacagacataagtaatgaggagaaattatggaatggatttcaatcaaatataagaggttatattcgcaaagcaaaagaacgttatgagctagaaatacgtacagatttagatattcatgaattcttaaaattaaataacaaggtatttgaacgtcaaaataaaactcctccatacgaagataactttgttatcgatctggatagagtttgttcagaaaaaaaatctcggaaaatttttattgctcaagataaattaggcagaaaacatgctggagcttacctaatatgggataacaataacgcatactatattatggcaggagcagacccatcacttccaaatagtggggcaacaagtttatgtttatgggaagcaataaaatttgcatctacagtgacaaaaaattttgactttgaaggctctatgcttgaacctgttgaaagattttttagagcatttggcgctgaacaaacaccatattttcatatctctaaaacaaattcaaagatattaaaaacatattatttccttaaaaatttaaaataacacttatattcctcccacttaaagatgtagtttcttaatgagaattaatcattacaaataaattaattacacattttaccctacatcttcatgttcatgttcatgttctaaagatatacaaaaatgaaatccattaattctaacatactgctttggttccaacttattataagagaacgatttggaattccaattaatgcttcatatacagagaaaggtataaaattatatcttcaaaaagaagaaaaatatattatacttgacgaattacaatcaagcttctattccatagatacaaaattgtcgtttactacttggaatggatgtgaagaaggctgggagacaatattagcctcccccttaccagcaccaacaattaaaaatttaccaaaacctttaattgaaaaaaagtcatatggacataatattcattatgatattattggtttaacttattggatattatctagaatagaagaaataaataaagagcaagtattagataatcactataggttccctgccattgagtctcatgcctataaaaataattatctaaatcgcccaattgttgatgaatggttacatattttaagacaaataattgaaaaaacttggccaaatgcagtgctaaaaaagcatcaatttagatttaatgctacacatgatgttgatagaccatatagatttaaatattgtaaattaactaaattaataaaaaatattgctggcgatgtaattcgtaagaaagtattttcatcaattatatatgctccttttataaaaatatcaaataataaacatgttcttaataaggatctatattttacttttgattggattatgaacctatcagaaaaaaataacataaagagtgagttctatttcatctgtgggcgaacagatagaactaaagacgctgattatgagattgaagacccactaatacgaggtttacttcgaaaaattcattctagaggacatgttataggattacatcctagctatagttccttccaagatccacaacaaataaaagaagaattttctcgcttacaaaatgtatgtgctgaggaaaatataaaacaaaaacagtatggtggacgaatgcattatttacgatggtcacacccagaaactctagttgcatggaataatgctggcttaaactatgatagcactctcggctatgctgataggcctggttttcgttgtggtacttgttttgaatatcccgcaataaaccctctaacaaatgaaattttaaacataagaataagacctttgattgtaatggaatcctctatattgaaatatatgaacattaaaaataccaacgatgcaaagaccttgtttttatattataaaaatatatgcaaaaagtttaatggtgagtttacattactatggcataatagtgaactttataataataaaatgagagaaatatatttagcattgttaactgaataggcatgaagtgaaaatatttaaattactagagaaacgttatatatatttctttctatcaatattatataaacttctactagacatatcatatgttaattttgtaaatccattatatggatattcaggttttcatattaatttcaatatattacaatatttttttgggtggattttatttttactattactaattttatctccacaccttatgaataaaatatctgactactttcattcccaagccttgtttgctttattagctcctattattgtactatacggaatggattcaaatttacctcttactcctgttatttattcattagcctccattttatttataaggtggttgaccaatacttctataaaaacacctaaaatatcaatagtaccaataataaaaaatggcgacaaaattttctatctaatatcattaataatggttatatatcttgtttgttggtattttttttctggtgcagtaaataatataaattttaatataactaaagtttatgaatttagagaaaaaaatagtgcaataacaaatataggtattttagcttatgttaatgattgggtctacagtgttttttctttatcactccttggctattctttatggagaaaaaaatacatcacgtttttatttgttataatatgtcaaatctttttctatagtatatcagcccataaatcggtattatttgcacctttttttgtaattggaatttatttttattttagtcgtactaatgctctatcatctgtgccattagtttttagcactaccgttctttgtggtttattattatataacatagttaatgaaactatttttccttctatgtttattaggcgtgttttttttgtacctgctaatttaacttatgtctattttgaatttttccaacataacccttattctatgtggagcaattctatattaaaatttatacaacctaatatttatgaggcgggaatatctaaaaccattggaatatatataggcactgacatatatgctaataatggatatataagcagcggttttgctcaagcaggattactaggcatattcttatatagtataatacttggtatatatctaaaatggttaaatatattatctaataaaggccctacattatggcttggattaatattagttgtaacacctttgagaagcttattaatttcatcagatctattaactgtgatgcttacacatggtctatttgtagctactctaatgttgattttactcagaaagaataaataacaatcatgaaaattgcacacttaacttcagttcatcatcgttatgacactcgtattttattaaaagaatgtacatctcttagtacatttggttatgatgtatatttaattgttgcagatggaaaagaagatgaacttattcaaaacataaatatactagatgtaggaaaaccatcagggaggctcaacaggatattaacatccactaataagatatataaaaaagccttagaagtagatgcaaatatatatcatctacacgatcctgaactcatacccattgggttaaaattaaaaaagaaaggtaaaatagttatttttgactcacacgaaaatgtttcacagcaaatacttggaaaaccatacttacaaaaaagtttaaaaaaaataatttctagattatattcatattatgaaaaatacagcttatccaaatttgatggtataatatctgcaaccacatcaatcaaagaaaaattaataaaaatcaataaaaacacaatcgctgtgaataatttccctatcataaatgatataaccaatacaaatatcatctgggataaaaaagaaaatagaatatgttatgttggtgcaatttctaatattaggggtataaaagaaatggttgaatctgtttctgatataaaaacaaacactaaaataaccataggaggaaatttcccaaataacaaatttgagaatgaagtaaaaaataacaaaaattcaaatgaaattgaattcttaggctttttaaatagaaagcaaataaatgaattattttccatatcaaaagcaggtctagtagtattacatccaactataaattacttagactctcttcctgtaaaaatgtttgaatacatggccgcaggaattcctataattgcctcaaatttccccttatggaaagaaattatatctagtaacaattgtggccttcttgtaaatccccttgaacctacagaaatagctaatgccatagattttataataaataactcagacatatcaaaagaaatggggaaaaacgcaagagtagcaatagaaaaaaaatataattggtctatagaatgcgaaaaacttttagatttctatactaaaatagatgaattatcgttatccaactaaatattaaactacataatgaatagtctagtttcaattataatgcccacttataactcatcaaagtatattgaagatagtattaactcaatcctaaagcaaacatataaacactgggagcttattattactgatgatcattcaaatgataatacttttgatataatatctaaatactctctaatatatcctcaaataaaaatttttaaacatgaaaaaaatcttggtgcaggggctgttagaaataacagtatagaacactctagtgggagatttactagcttttctagatagcgatgatctatggcatcctaataaattagaaaaacaaatttcctttatgcttaaaaaagaatgtgctctttcttatagttactatcaaaaaataaatgaagatggacaattaaaaggaattataaaggctcccaaatttactaacagcaaaaaattattattcacgaatgttattggatgcctaactgctatctatgacactcaaaaagttggaaagttatacatgccgctgataagaagaagacaagatatggctctttggttaaagataatgaatatttcaggcaatgcctatggcattccagaaattttagcttactatcgagtttcaaaaaatagcttatctggaaataagtataatgcagctaaatctcaatggcatttatatagaaatatattaactctaggttttgttaaatcatccatttatttcatttcatacgctttttttggtttaattaaaaaatttaaatagagaacatttaagaatggatataacaatagcaggtataggatacgtgggcttatctaacggaattcttttatcacaaaaacataaagttattgcgttagatattagcgaagaaaaagtcaatcttataaataaaaaaaaatctccagttgtcgataaagaaatagaattctatataaaagaaaaaaaattagacctcattgcaacacttgataaaaaacttgcatatgaaaacgctgactttgttatcattgcaacacctacagattacgaccctaaaactaactattttaatataaaatctgtcgaatctgtcatagaagatgttctgtattataatcccacagctataatgataattaaatcaacaattcctgttggttttacgaaacagatgagagaaaaatataatacggacaatattattttctctccagaatttctcagagaaggacgcgcattatacgacaatttatatccatctagaattgttattggcgaaaaatctgaaagggcacaattattttctgatcttctactcgaaggagctataaaaaaagacattcctattctttttactgaatcaactgaagcagaagcaataaaattattttcaaatacatatttagctatgcgagtagcatattttaacgaacttgatagttatgcagaaatcaatgaattaaacactcgccaaattatcgaaggtgtttctttagatcctagaattggtaatcactataataatccatcatttggatatggtggctattgcttacctaaagacactaaacaattacttgctaactatcaaaaagtaccaaataatattattaatgcaattgtggaagctaatcgtacacgcaaagattttatcgctgattcaatccttagcaaaaatcctaaaattgtcggtgtttatcgattaattatgaaatcaaactctgacaattttagagcatcttcaattcaggggatcatgaaaagaatcaaagctaaaggcattgaagttgttatatttgaaccagaaatgacagatgagtattttttcaactctaaacttattcgcgatttagaatattttaaatctatatcagatataattatctctaatcgcatgtctgaagaactcaaggatgtgaaagaaaaagtgtatacgcgagatttatttggtaacgattaattatttaaaatattaataatatttgataaaaattaaccatcccaagagataacagttattagatatgctactcaaattaatttaatgccacacttactattaacaattacactctctacctcattctgttatcatatgtcccatgctaaacatcgtcctattcgaaccagaaatcccgcctaacacgggaaacattattcgcctttgtgccaacacaggctgccagcttcatttaatccaacccttgggcttcacatgggatgataaacgcctgcgtcgcgcagggttggattaccacgagttcgctaacattaaacagcatcacgatttccatgctttcttggtaagtgaaggtttaagtccggtgaattcacaatccccgtctggggcgcggttgtttgccttaaccacaaaaggcacgccagcgcacagtaatgtcagctatcaggatggtgattacctgatgtttggcccagaaacccgtgggttacccgcttatgtattagataatatgccaacagagcagaaaatcaggatccctatgctgtcagacagtcgcagtatgaatctttccaattctgtggctgtggtggtttttgaagcatggcggcagctgggatattcaggggcgttattacgggattaatattaggccattcagcgcttgtatcacgctgaatggctttaattcttgattacaaacagcgataggatctcaaatcccatccccatactcaaacccattattgataccattaaaatgctggttcatatccagtgatggtttgtcactttcgggtttacccacaatccgcgccggtacgcccgcaacggtggtatgaggtggaacagcacgtaagacaacggaacccgccccaattttcgcgccacggccaatttcaatattgccgaggatcttagagcctgcaccaatcatcaccccttcacgcactttcggatgacgatccccgccagctttgcctgtaccaccaagtgtgacagattgcagaatggagacatcattctcaaccactgcggtttcaccaatcacaataccggttgcgtggtcgagcatgataccgcagccaattttcgcggctgggtgaatatcgacactaaaagagacggatatctgattttgcatataaatcgccaatgccttgcgctcttgattccagagccagtgcgctatgcggtatgcctgtaatgcatggaagcctttaagatagagtaacggtgttgaatatttgtccacggcggggtcacgcaggcgaacggctttgatatcacgggctgccgagccaatcatctctggatcgctgcggtaagcgtcttcaacaacttctctgaccgcaatcgcaggcataatcggggttgccagtttatttgccagcatatagctcaaagcactaccaaggttttcatgcttgagtaatgttgcgtgaaaaaaactggctaacatgggttcacaatcagccagctcccttgcttcattctttatatttttccagacttcgttcagttcttctcgagacatagcaatcattctcatttgactgtttcccgccctaagtggactcacttcccactatacactctgatacatcgaacgaggatttacggctattttagctaactcaagagttaaggttttctccctcatctcttgtcgctctgcccaataatgtctgggctgcttcgataacgttcttattacaatatagtatctgatagatctgttctgtaatcggcatctcaacaccggctcgttctgccaatgcccgagcttctttggtgttacgatagccttcaacaacttgaccaatctcacgttgtgcatcgtcaacgctgataccttgacccagcatcatgccaaaacgacggttacgagattggttatcagtacaggtcaaaactaaatcacccaatccggccatacctataaatgtcgaaggatcagcgcctaatgcgataccaaggcgactcatctcggccaagcctcgggtgattaatgctgtgcgagcatttgccccaaaacccataccatcagatatcccggcaccaattgcaataacattttttattgcgccgccaagctgtacgccagtgaaatccgggttcttatacacacgaaaacttttgccgcagtgaaaaagctgctggagttcttcgccaaattcaggggtcgtcgcagatacagcaattgctgtcggcaaacctgctgccagttctttggcgaatgtcgggccagataccacagccaatgggatttcgttacccaatatctcacgtgccacatcctgcaataaacgcccggtttctgcttcaaggcctttcgttgcccagacaatccgggaatccggctgtaaatatggttttatctgctgtaatacatccccgaaaacatggctgggaaccacgatcagaatattactgctggttgaaaccgcatttttcaggtctgcttcgagcaataagttatcagggaaagaaatatccggcaaaaatgcctgattgcaacgcgcctgctgcaaggcgtggatatgctgagggttatgcccccagagcacaacttcatgcccgttgcgagccagtgtgatggctaaagcggtgccgtatgaaccggcaccgataactgtcatagaagcggtattcatcaggcttcctgagtagtctcactaggctcagactgttcagcctgctgttgcaggtaattcatgaacagcgcatcaaagttgactggcgccagattcagttgtgggaaagtaccacggcctaccaggctggtgatgcactcacgggcatatgggaacagaatgttcgggcaataggcacctaagcaatgtgccaattgggttccatcaataccgtcgatagagaaaatacccgcctgctgaacttcacacaggaacgccgtttcttcccctaatgccgctgtgacagtaacacgcagaacaacttcatagactccctgagctaattcattggaggcggtatccaaatccaatttgacttccggctgccattccagctggaaaatctgaggtgctttcggtgcttcgaaagaaacatctttcgtgtagatacgctggatctggaaagccatttcggtgttgttttgttctgacataatgattttaccttgttaagacgtcctgattaaactttgatgacgtaagcataccgcttacacccgtgttcgttattttttgcctcgggccaatggcagattttcacctgaccatcccgtaattccctctttcagggaataaacccgttcaaagcctgcacggatcagatgctcagccggcgttctggattccagaccattcgctgaaaccacaatgacaagctgttttttatgcttttcaaactcacccagattattttctttaatctcagatggtgtcaggttaacggaaccaataatatgccctctgcggaaatcgtcacgggagcgtaaatccacgacgacagcatcttccttattgatgaaatggatagcctgtgcacgggtgatctctttactcttggagaacacgctttttgccgtcatgacaatgacagccaccagcaatgcaatccaggcaagactcaggatagtattccggctaataaattgcatgatttcttgcagcatggggggaaacaactcccgttagttaataacaaatatctaaggtagcagagtatacctgtgtgttgcgtcaattacagccaattagcgccagcccagtgtagattttgcggagagtttcgagaaaaagcaaaaatcctccgagattcatttgattgtcatgtttcaccaaaatattttatatcacacggagccggtgcaggattttcaccaataaatgagctaaattaactaaaatttatattatttaaaaagataaaaaacagtctgttctctggtcagaagtaacccctcatgaaataatcggacacgatatgatcggcaaggtactcaataagatggctgatagtaaggatctaaagagccgtaatcagcggcagaagcaggatcaatggcaaccccagaacagaagcttattgctctgtatattgctgtttgcctttttcagcacagatacctttgccaatcagatttcagagagtaaaaaccagctcaaggatattcagcaagatattgccgagaaagaggaaagtgtcaagcaacagcaaaaaaaacgcactaatctgctgagtcaattaaaggatcaagagagcacaatctcagaagtggggctttctctacatggcactcaaacccgcttgaataaactgggcaatgaaattacatcactgaatgcgaatatcaaacgcctgcaaattcaacaaaaagaacagcgtcgtctgcttgccaaacaattggattcagcattccggcagggaaatcaccaaggattagaactgctattcaatggtcaggaaactcaacgcaaagagcgcatactggcttactacagttatctgaatcaggcgcgtcaggaaacgatcaacaaactgcaaaaaacaaccgagcagcttaaccagcaaaaaaagctgcaactggaaaaacaaaatgagcagaaaacaatactgagcagccaaaagcaacaaaaacagaaaatggaagttgtccatattgcgcggcaaaaaacgttaacggagcttgagtcttcactgcaaaaagatcaacaaagtctgaccgagcttcggcagaatgaagcccagctaaggaataaaattgccaaagcagagcgggaagccaaagcccgtgctgaacgagaggctcgtgaagccgcacgagtccgtgcacaagtcgcagccaagcagaaacaggctcagcagaaaggttcccgctacaaaccgacggaagaagagcgctcgctgatggctcgaacggatgggcttgggcgcccggccgggcaggcaatctggccggtacgcggtcgggtcatccatagttttggtgaagcaatacaaggtgagctacgctggaaagggatcgttattgccgcagcagacaatacggaagtgaaagcgatttccgatggacgggtactgttggcagactggctgcaaggctatggtttggttgtggtagtgcaacacggcaaaggagatatgagcatttatggttataacaaaacgacgctggtcagtgttgggcaacaggtacgagccgggcaatctatagcgttggttggcagcagcggcggccagcagcagccttcactgtattttgagatccgccgtcagggtcgggcagttaatccattgccatggttagggaaataggggaagagaaaataatggtgaagtctcggttaatcaggcgagttatcccgttcacactgttatcttggatactcctgttttgtctatcattactgtttaccctgaatgcacatgccgcacgtctggccattgtcattgatgactttggctatcgtgttcaccatgaaaacaaaatattacaaatgccaacggcggtttctatcgcaatattgccagattctccacacggccgggagatggcgcaaaaagcccataaacaaggccgggagattttgatccacctgccaatggctccactcagtaaacagccattggagaaaaatacgctgcatccttccatgagccgagaagaaattggccgtattattcacgatgccatacagaaagtgcctcatgccatgggcatgaataatcatatgggcagtgcaatgacatccagtctcaatggcatggagaacgtgatgcaagtgttatcttcttaccaccatctctactttctcgatagcgtgaccattggcaagacacaagtcaccaaagcagcgatgggaacaccggttcaggtgctccgccgtcatgtttttctggataatgtgcagacagaagcagaaacacggcatcagctcaatcgagccattgcgcttgcccgtaagcaaggttctgccattgctattgggcatccttacccaaccacggttcgggccttacagcaagccctcacagcgttacctgacgatattgaactggtaacacccagcaggctgttaaaccccacttcagcgagcaaaaacgatcaccagactgcacgtaaatgtgcaaaacctcatgaaccagcagccgtacctgcaaccaagctggattatctcaagaggataggcaacgcattaacgcacaatgctattgttgagacgttgagtcagcacattgataaacttttgggaaaaacagagtcggcgcaaaaagataaaacagtacaaggcaacacaggcgcccgtacaacgacagacacctgtgctgatttttaacggctattccagatagtcagttaatcccaattcaggatcactttgccggattgccctgaacgcatgatatcaaaacctttctggaaatcatcaatcgagaattggtgagtaataatcggggtcaaatctaaaccagactggatcaatgccgccattttgtaccatgtctcaaacatttcacggccatagatccctttgataaacagccccttaaagatgacctgattccaatctatcgccatatctgaaggtgggatccccaacagggcaatgcgcccaccgtggttcatggtactcaataaagtgcggaatgcctgtggcgcgcctgacatttccagccctatatcaaaaccttctgtcatgcctaattctttcatgacatcggtcagattttccttactgacattcacggcacgggtgacacccattttacgcgccaaatcaagccgatattcattgacatctgtaatcacgacatgacgtgctccgacatgcttacacaccgcagccgccataataccaatcgggccagcaccagataccagtacatcttccccgaccagatcaaaagacagtgcagtgtgaacagcattgccaaacgggtcaaaaatagcggcgagttcatctggaatattgtccggaattttgaaggcattaaatgccgggataaccagatattccgcaaatgcacccgcacggttcacgccaacgccggtcgtattacggcacaagtgggtacgcccaccccggcagttacggcaatgaccacaagtgatgtggccttcaccagacacacggtcgccgatgttgaaccctttgacttcctgaccaatcgcgaccacttcaccgacatattcgtgccctaccaccatcggcacaggaatcgttttctgagaccagtcatcccagttatagatgtgtacatccgtaccacagatggcggtcttgcgaattttaatcatcacatcattgtgccccagttccggtgtgggcacatccgccatccaaataccttcttctggctttaattttgacagtgatttcatagtgataccttatgcaataacattcaactgtttaccgatacggataaacgcagccaccgcatgttcgatttgctcttcggtatgggcagcagagatttgggtgcggatacgtgcctgatctttcggaacaacgggatagaagaatccaatcacatagatgccttctttcagcagctcggcagcgaattcctgcgccagtttcgcatctcctaacataacagggatgatcgcgtgatctgcaccagccagtgtaaagcctgcggcggtcatttttgcacggaacaggttggcatttctccacaggcgatcgcgtaattcgtcgccatgtttcagcatatccagcactttgatagaggctgctacaatggaaggtgccagtgaattggagaacagataagggcgtgaacgctgacgcagccattcaacaacttctttgcgtgccgcagtataaccgccagatgcaccgcccagcgctttaccgagtgtgccagtgataatgtcaacgcgacccatgacatcacagtattcatgtgtaccacgtccgcctttgccaacaaacccaacagcgtgggaatcatcaaccatgaccagcgcatcaaattcatcggccagatcacagaccgatttcaagtcagcaatcacaccgtccattgagaacaccccatcggttgcaaccagaatattctccgcaccgtctgcttttgctttttccaactgtgctcttaattcctgcatatcattattggcatagcgataacgctttgccttgcacaaacgaatgccatcaatgatcgaagcatggttcagagaatctgaaataatggcatcttccggcccgaataatgtctcgaacaggccgccgttcgcatcaaaacatgaagagtacagaatggcatcttccatacccagaaattcagctattttattttccagttctttatgggagtcttgcgtaccacagataaaacgaacagatgccatgccaaaaccatggctatccagtcccgcttttgcggcagcgatcaggtccgggtgattagctaaccctaaataattattggcacaaaaattaataacttggctaccatcggcaacggtaatatcggcattctgcgcagaagtgatgatacgttcatttttgaataatccttccgcacgggtttgttccaactgctcattcattttctgataaaaagacgctgacatttttctctcctgagtacctgaataagtgaaaagcgtggtgtattttacttatagatcctgccagtgacgacacagtgagaaagataatatcaactttgtaaagccgatcacggcttggaggctgatatgcggcaagatctcaggattttcccctgtttaagctgctgtcgtcaggaatgttaagtgctattatacgcatcaaagataaagtgaactgactatttagaggtgagccaaatgattattgtcactggcggcgcagggtttattggcagcaatatcgtcaaggcactgaatgacgaaggctataaggatattctggttgttgataatctgaaagacggcacaaaattcgtcaatctggttgatttggatatcaccgattacatagataaggaagatttcattgccagcatcgttgcgggtgatgattttggcgatattgatgccattttccatgaaggcgcgtgctcatccacaacggaatgggatggcaagtatatgatggacaataattatcagtactccaaagatatattgcattactgtcttgagcgccagatcccttttctgtatgcctcctcggctgcaacctacggtggccgcagtgataatttcattgaagagcgtcagtatgaaaaacctctcaatgtttatggctactccaagttcctgtttgaccagtatgtccgcgatattttgccacaggcggattctcaaatttgtggcttccgttatttcaatgtttatgggccacgcgaaggacataaaggcagcatggccagtgtcgcctaccatttaaacaatcagattcaccaaggccaaaatccgaagttattcgccggtagtgaacatttccgccgcgatttcatctctgtcagtgatgttgccgcagtgaacctgtggttctggaaaaacagcatttctggcatttttaattgtggtacgggccgcgccgaatctttccaagccgttgccgatgccgttaccgggttccatcaagaaaaatcccctgtcgtggaatatattgaattcccggaaaaattaaagggacgctatcagagttttactcaagctgacctgacaaaatttcgtgctgcgggttatgacaaaccattcaaaaccgttgccgaaggcgtcactgaatatatgcaatggctcaatcaggataattaatcaacctctatgaagatattggtgataggcccatcatgggtgggtgacatgatgatgtcacaaagcctctaccgaaccttgaaggctttgtaccctaatgcagaaattgatgtcatggcacctgcatggtgccgcccattactggcaaaaatgccagaggttaatcaggctctggcaatgccgttagggcatggtactctcggtctgggtgaacgccgtcgtcttgggatcgcactgcgtgacagtacatatgaccgcgcttatgtgcttcccaactcgttcaaatctgccttagtgccttttttcgccaatatccccctgcgcacaggctggcgtggtgaaatgcgctatggcctgctgaatgatatccgtgttttgaataagagcgcctttcctctcatggttcagcgctatgtggctcttgcatataatgggaaaatgatgagtggtgctgaggatcttccccaaccgctgttatggcctcagttagacgtcagtgacgaagatattgcagaatcaacagcggcgtttaatatcgctgatcatcgtcccattattggtttttgcccgggcgcagaattcggcccggcaaaacgctggccacattatcattacgccgcccttgccgaacaattgatcacccaaaaaggctatcagatcttgctgtttggctccgccaaagatcacgaagccggtgaagatattcgagcacggttgagcgaaagtgcccgtgaagattgcctcaaccttgcggggcaaacgtctctcgaacaagccgttaatatcatcgcggcctgtgatgctattgtcaccaacgattcaggtttgatgcacgttgcagcggccttaaatcgtcctctcgtcgcgttatatggcccaagtagcccggattttacaccgcccttatcaaacaaagcagaagtgatccgcctgatcacgggttaccataaagtcagaaaaggtgacaatgcgggtggctatcatcaaagcctcattgatattcaaccagagcaggtcttagctttactggaaaaactgttacagtcggagaagcagaattaatgcgcgttttactggtaaaaacgtcttcaatgggtgatgtgctccataccctgcctgcattgacggatgcaaagcagcactttcccggtattcagtttgattggatagtggaagaaggatttgcccagatcccgacatggcacaacgccgttgaaaatgtaattcccgttgctattcgccgctggcggaaaaattggtttagaaaagatattcgtgaagaacgggcacgcttccgggaaacattacggcaaaaccaatatgacaccattattgatgcccaagggctgttaaaaagtgcctttttggtgacacgcttggcacatggctcaaaacacggctatgacagaaaaagtatccgcgaaccactggccagctttttctacgatcaccgtcataccgtcagtaaacagcaacacgcggtagagcgtatccgtacattgtttgctgatagtctgggttatcaaaaacccacagaacaaggtgattatgctatcgcccgccactttctgaactcacagattaaaggtcaaagtgactatctggttttcctgcacgcgaccacccgtgatgaaaaacattggccagaaaaccactggcggcaactgattgcagagatccagtcaacaggtatgcgaatcaaactgccttggggtgcagaacatgaacaccaacgggcattgcggttagcagaaggctttgcccatgttgatatattgccaaaattaacactggctgaagttgctcaggtattggccggcgcaaaagccgtggtttcggttgataccgggctgagtcacctcactgccgcccttgatcgcccgaatatcactctgtttggccccaccgatccgggtttaattggcggctatggaaaagaacagcttcccctgaaatcggtggataatacgatgcaaagcattgcaccaccgaaagtgatgcagctgttgcaaaacgtattaaaataatactttgcctagcggaagtgtaacgcaccagcgatttttatactcaaaagtaggattacccaatgagtaacgcatagttttgtctgcttcctgacactgtgcttttgcttcttgggtattaacccacatcaagatgctgccaacgctaagatcagcatattcgggatcatacccaccattgatcgcatcaaatgaaatccatttagggctatctgcgcgcaagacaaaatcgtatgcgcaagggttgccattgatcagtagcacatagccaaagatatgctcacgaagctctgtgtacatctcaagcagatgcttacgttgctcagccgagtgattgtaatcccagcgcttttggtacagatcaacatagatattcaccaattcttctgcactaaattcactcgaaggacgaatttctcctcccgctcgcttgaatttgttgatctcgttgctgcggttacggcgggtcttgtaagaaaagctgtctttgatcaggcagattttccgtttgttgaaaaaaggcttgtaacaggtattaataaaattattttcatgaataggtgacaatctctttgatttcactggtaaaaatagtttcgcatccattgcgataggaaaagtgatttcatcatatgatattagatacctatctttcatctcttccactaacttattgttattaaatgaaaaacaagcacctttaattaaatttcctgtttcttttatataaaaggaaaacttaccatcaagatgtctatccaaaaaagatataatattaggatctgttgatacacatcccccaaagagagcataagcttctttatatcgttcaaaatcgcattttttccatcctgaaaaaagtgcttttatttctgccataaaaaatatccccatacaaacattctggagttataaataaattatttaaaaccagtcaaatatcctattttacataaaaataatgtaatgagatacgaatgtatacttcaattaaaaacaagcaataataacatatagttatttatttatacaaaaatattaatttaattattatttgaataaaaaacaaactatactcttactacctataatatattatttttataaaactaaatcatggccccaccgaatcaaacaagcggttgagtgaagagtgaaacctccctcaataaaattttataatggctaagaatacatcatcaatttattcctaatatgggtagaatggcattgaataaagatcaattttatttgactggggaaattattacattgcacattataatctataacagtcgctattattggttggatcaatatttattttcattgctaaatgcattacagacatatgggaaaaaaatggaaatttttttataaccatgaaaatgccaagataaaattagatagtatatccaataatatatgttattggtgatctgaattctatttttagcctcgtcagaaatgcaaatattaccgtgaccacctaaacgacaacctttaatgaaagagcgattactaaaaatcgtactcaggatcattttttatagtatagtcttgcccttatatatctcaatatagctgacattgaattttttctgatttttctccacaaatacatctttttatcttttatttcccttaaaaaacaaatcctttctgttttattcatattattagtacattgttctattttatacaaccagaattcacattgtttgacatcatcaatagatattttaccttcagagtgattcatcaaagaaacgtcctttaatggaatatatatacctaaagatgaaaacattttctgctgaatagtaacagctgtttttttctgcttttttttatattcaaacctagggttatttggatgtgtacgatagtttaaaagagacttattaatatttgcaaatttagctctttttgacataattaaccgactccataatccataatcctccgcatatagatcatttggatcatatccatccgttagctccaaaattttatcttttctcatgatcacagtcggatgagcaacaggacaatggaaaaaacactctgcaacaatgccttcatgacttgtggcatgtatatcacccttagtaggattttctaaatatgttgtgaatccaccacaaacgactatatctggatgattctgcataaaatccacctgaatcttaagccgttcaggaatcgcaatgtcatcagcatccattcttgcgactagattactagatgccatatacaatcctttattaagagaaaggattaaaccaatattattctcattggttataaccttaacacgcatatctttctcggcgtatgaagatagaattgaaggacttgagtcagttgagccatcatcaataatgatgagttcataatcttcaaatgtctgtgataatatagaatcaatagcttcttctaaatatttttcaccattatagactgacatcaggacagaaattttaggataaacactcatttcttaaccttaataaaaaaataaaaactcataatatcactatcatatgtaaattgaaataaaaagctcaaaactatttaagaaagtaatattataattataataaaaaatcacactaccaacttactctattaattaccagaaacacaataaattcaccttatataacgtcccatatttaaaaacactcaagaatagtaaattaaaagatattaaatgctaacttttaaagtgatttcttattttataatattttttcttaaagctaaatctaacattcgtatttaacataaaattcaacacagatatactgtcaattaaacccatcaacaaagagtgagatttccttgataaattattcctgtacttatatataatatctattgcatgacacacagtcaacattctaaactccttaccgaagactctgtcagcggttaatacaacatctgccataagattaattttctcttcgtttatatttccagaaaggctgccttcacttttaatgtaattataatatttcatttttgtatagtatactttattacattttattaataccgctggaaatgacaaagcatcttcataacatgaaacttccggaaaattatttcctcttaataatttttttctaaaaaacttaccacaagaatgagcctgatacttcttatgtattaaatattcctttatagctgtttttttatcaaaaagaactggtgatattaaacttgacttatgtattatatcagcatcgtttctgacttcctgtaatggactaattaacatatctggtcttttatccataagaaaaccaacgatttctttcatggaaaattctgataagaaatcatcaccatcaacaaaagtaatatattctccattacttacttcgactgaatattttttcacttttcctaaacttttgaattcttttcttatatagatgaaagaatcattctcctcagaaaactttcttaaaattgatggtgtagagtcagaagagctatcatctatcaacaaaacttcatataggctaggatcgcaatcagacaaagcatcctttatactattgatacatttgagaattaatttttccaaattatgggcagcaacaacaattgatagtatcttggaagaagctaaatctatatcacatgctttaattgtcataatgttctctttctatattattgtaataatatcatcacttaagaaacagatttttgtttagtctgcgttatttttcggcgatttaaattgatagtattcagccaatgtcattccccggactaatggccgcaagaaatcaaataacccttccaaatctcgataaagctgctcaatttgctcttcatctttaaaagtagggcttccacctggcataaattctgacgaatgcaacataaactcaacataatcactaccaccagccaaggtttgttggacaacttttttcatctgctccaaatttccaccttttggacgtagccagttaacagatggggagcgctgcttaccccgcaaatgatcatacttttgcttaataaaattcatgattggagagtgtttatactgaatactcattggcacttgcaatagcgaagaatcaccttctttagcgatatcctgtaaatccataaagtaagcctgagtaggaaaatggctatagtctgtcccgccatttccgttaggatcgcctttggtaaaatgccaattgatttttggcgtgacagaacaatccacctgataaccatactcaaccaataattgagcataatattcattaaatgcccaacgaccagcacgatgactcaacatcttagtctggagtttctcctccagcagattagtcattaaatcaatttttgctttgatttgatctttagcgtattcaatcaaataaggcttatagcgcatatcatcagcggttagagatacaatgggtggattgttccaagcatgtaaatgcataccgatttcacccgtgtctctggcaatcacatccttggcaaattcgatatagctatcatccattgccatctcataattggtcagccagacgggtttaaatccaaagcgttcacaaaggttctggaaccttggcaaatattgcgtatttttagtcgaaattttatcactgttttgccaaagatcatcaccttcagtgtcgatcgtgataataaatgttggtaaggtcatcaatatacaccaaaatgtgataataactgtttttaatggtactcagaccagctatacagcgcaattagattattcaggatgaacgattgtatgtatgattgacactacatatcgtgtgattgaaaagcttaaaatgtatactctgtggctacttgctgcattaaaatcatcatatcgtattgatattatatagaactcgaaaaatgataaaaaatcataatggaatcaaaaaaattctggtgataagactacaacatcatggcgatatgctactaatcacacctgtaatcagtacattaaagtaccactatccagatgcaaaaatcgatgtgctcctttaccaagaaaccttgcctatgctggaaaactcacctgaaatttcgagtattttttcaatagatcgcaaatggaaaaattttggagcaaaaaaacatttattacttgaatgggacttactcaaaacattaagccaacaacgctatgatttaactatcaatcttgccgatcaatggcgaagtgcctttattacccgctttatcggagctcctattcgcctcgctctggattaccccaaacgtcaaaattggaagtggcgtctttgccatactgaagtagtatccacaattggtcacgattctttgcatacagtagaacaaaacctttcgattctaaaaccattacaacttactcctctcatcaataaagtaacgatgagttatggtaaggatgatttgcagtgggtaaaagatacgctttccgggtacaaattcgccgaaaattacctcgtcatacaacctacttccaggtggttctttaaatgctgggatgaaattaaaatggcaaaagtgatcacagcgctacagaaggaacagcaaaatatcatcattacttctggacctgataggcgggaattagagatggttgatactatcttgtcatactgccctgataagaacaatatactctctctagcaggacaattaacgttacctaaactagcagcattgattgatcactcaaaattatttatcggtgttgactcagttcccatgcacatggccgcagccctgaaaacaccctgtattgcattatttgggtcatccaaactgacgttctggaaaccttggcaatctatcggtgaagtgatttgggctggagattatggcaacatcccacatccagatgatattaagacccatacagatacgcgttatttggatttgataccaacagatgcggtcatttcagcagcaaggaaatatatttcatgaaatctctacggttagccatcgtccgtcaaaagtatcgtccagatggcggggctgagcgttttgtcacacgggccctagaggctctcaatcaccaacaacttgaacttaatatcattacacgctcttggcagggagaaagtaatcctaattggaatattcacctatgcaatcctattaaatttgggcgaatcagccgtgagcgtggttttgcaaaagcagcgcgaaacttatggcaaaaagagcaatttgatttagttcaaagtcacgaaagaattgctggctgtgacatttacagagctggagatggtgttcatcagcgttggttacatcagcgcgcaaggattttgccaaagtggaaagctcactggctattaaataatccataccacagatatgtaatgaatgcagaagaggaaatgtattcctcaccatcattaaagcaggtgatctgtaatgctgaaatgataaaaaaagaaattatcgaagaatttagtctcgctgaagacaaaatatccgttatatataatgccattgatagcacaaaattctttcctgcccatgagcaaactcgcctgcaattgcgacaacaatataacattcccactaccgcaaagtgtctgatttatgtaggctctggttttgaacgaaaaggtttgtctgccgcgattaaaactattgctaaaacaggagactatctgttagttgtaggaaaagataaggaacaggtaaagtatgaagaacttgctaatactttaggatgccagcatcgtatccgtttcatgggattacaaaaaaatacattgttgctttatcaaatgtctgatgccttattgctaccgacattatatgatccatttcccaacgtcatccttgaagccatggcgtgtggtttgcctgtcattaccagtacgacctgcgggggagcagagtttatcaccgaaggtaaaaatggctttatctgtgacgcactcgatatcggaaaactagaagaggcggtttattgtcttcctaataatatattaggtacggatatgtcaatatcagcgcgaaatcaggtgataaattcaacacctgaaaatttatctcaacaattaattcagctttatcaacgagtttcagaacagtgaaagaacacattctttttattattgatggattacctggtggaggagctgaaaatgtgacgcttcgtcttgctatcggcttgcatcagcttggttaccaaatttcgttactttcactcaatactcaactggtttacaacatacctgaaggtattcactacattgttagcgcagacagctaccaaggacctttcagaaaattaaatgaacttaagcgtcgtgctaaagccatggataaggtgttatcggaacttttccaacagaaaggtaagccgactttggttatttctaatcttcacaaaactgaccgtattgtcgtcaaatcaaccatactgagttattgtaatgtatggcattgtattcacggcattttttcccattcatatctcagcaataaaaaacctctttcttattggataaaaaaagagaaaataaaaaaagtttataaaaataaacaagttatttgtgtttctgacgcagttagagatgatttggtaaaaaatattggaatacacccaaaacagataacaacaatctataatccatttaatttcaatgaaataaaacacagagctttacaaccaaatccttatcacgggaaaaattatctactgcatattgggcgctttcatgaagttaaacgccatgataggttaatagcagcttttgcacaggctaaactcccatgcaagctgatcattgtgggtaacggagccaaagacatagaaaatcatattaaagcgaaaatccatgagctaaatttaggtgataaagtaattttggcaggctttcattctaaccctctccctattattcatggtgcaaaggccgtagtcatcagttctgacagtgaaggattacccacagtattaatcgaagcattaatttgtcatacgccgattgtcagtactgactgtccgggaggggtaagagagataatgacaggtaaactcaaagaatatctgagtgaaatcacagttgacgctttagcagaaaaaatgcagctcgtttacaatgaaccaccggtaatcacagacacgatgtatgaaaaatttgcgataaataatatattaagacaatacactgccttaatagagcaatagctagctctacatgcttgtccataaaaggggccgcattttacacactttcttcaggccaatgtggtactatagccgcagtctatgtcagtgaatttgatagaatgttgcttcgcttatatcaggtacttctctaccttatccaaccgcttatctggttacgcctgctgttgcgcagccgtaaatcccctgcgtaccgtaaacgctggggtgaacgttatggtttttgtgccaaaaaagtcgcaaaaggtggaatattactccattccgtttctgttggagaaacattggctgccattccattagtaagaatactacggcaccattatcctttcctgccgattaccgtgacaacaatgacaccaactggctctgaaagggtgctttctgctttaggtactgatgtcaaccacgtttacctcccctatgatttgcctggctccatgagccgtttccttgataacgtcaaccccaagctggtgattattatggaaacagaattatggcccaatttgattacccaactgaaccaacgcgaaatccctctggtcattgccaatgcaaggttatcaacccgttcagcagcgggatatcaaaaaatcagcaactttattaaaaccattttaaataaaataacactgattgccgcacaaaatcaggaagatggtgagcgcttcatcgaactcggcttaaaacgttcccaactcgccgtcactggcagcctgaaattcgacatttctgtcacgccagaactggcagcaaaagcggttacactgcgccgccaatgggcgccacatcgtcctgtctggattgccaccagcacccatgatggagaagaaaccatcatattggatgcgcactgcaaattaattcaacaatttcctgatctactgttaattctagtaccacgccatcctgaacgttttaccaaggccgcagagttaacccaaaaagcgggattaaattcgatattaaggagctctgacacaatacctgatcccaatgtgcaggtggttatcggagatactatgggcgaattgatgctcttgtatggtatcgctgatctggcttttgtcggagggagtctggtcgagcgtggcggtcataatccactggaagccgcagctcatgccatccctgtcattatggggccacatactttcaactttaaagatatttgtgccaagctggataaagccaatggccttatcgccgttacggatagtcactcgttgagtgccgctatcaatagcctgctgacagatgaggactatcgtctttattacggtcgccatgccgccgaagtcctgcacgaaaatcagggagcacttcagcgattgctaaaattactggaaccttatctcccgccacggggtcattgatgagcaagagaaaacgcctgtccgttgtgatgattgctaaaaattccgccgatttgattgcagattgtctgctatccgtagattgggctgatgaaattatcgttctagacgccggcagtaccgatacaacttgtcaaatagccagcgaaatgggcgcgaaagtctacatcaatacgcaatggcccggcttcggtcgtcagcggcaactcgcacaatcctatgccagcggtgattacattttcatgattgataccgatgaacgtgtaacccctgaattaagaacatcaattgagcagattttggcagatcccgacgatgataaagtctatgactgcgcacgtctcaacctgtttatggatcgtttcatgaagcacagtggctggtatcctgataaagtcattcgtctctattgccgcgaacattatcaatataacgacaatcaggttcatgaatcacttaacactcagggtgtccgcatcgtgacattaaagggcgatttacgtcatctcacctgccgtaatctgatggaattccagcaaaaacaattgaattacgccagagattgggcaaaataccgccacgaacaaggtaacacagcccgttatttttctatcttcagccatacgttaggcgcattttttaagacatggctgttaagggccgggttcctcgatggcaaacaagggttggtattagcaatggtgaatgcccagtatacatttaataaatatgctgccctctgggaactcacccaaacagagagtaaaaaacgatgaaaaaaaaagcaatttatcctggtacttttgaccctatcacccacggccaccttgatattgtgactcgtgcggcaaacatgttcgaccatgttttacttgccattgccaatagtgacagaaaaaaccccatgttcaatctggaagaacgaaccgcactggcaaaagaagtcaccgcccatctgaagaatgtagaagtggttgggtttagtgaactgatggccaattttgccaaaaaacaacaagccaccattttaatccgtggagtacgttccgtttcagattttgaatatgagtggcagcttgccaacatgaaccgacattttatgccagaactggaaagtgtctttttattgccctcgcaaaacctgtccttcgtatcatcatccttgataaaagacgtcgcacgccatgatggtgatgtttcgacattcctgccagaacccgtagcacaggcaatgctgaagaaattcggcaaataagatagcgtgaaaaagggggcgatcatcgtcagcccccagataggcttaatgctgacactgacgacagaaaaacgtgctgcgttgccccagttttatactctcaattttttcaccacatgtcggacaaagttcaccttttttgccataaacaaataattcctgcgcaaaatatcccggcttaccatcggattgtagaaaatctttcagtgtagtgcctccctgctcaatagagcgatgtaagatctgttttatcgtatcggccagtaaataagcttcttcctgtgtcaatgaattcacagggcgctcaggcagaatatgcgcaacatacagagcttcattggcatagatattcccaactccaacaaccaccttgttatccatcaaccaaggtttgatcaccgtttttttgtggcgggaaagggtataaagatattcaccatcaaacgcatcagaaagaggctcagggcctaaatgagccaatacagaacactcatcaagattgtcactccatagccacgccccaaaacgtcggggatcggtataccggaggattttgccatctgccataatcaaatcaacgtgatcatgtttttcaggaggagattcattcagcaagatacgtaaactaccagacataccaaggtgaataataatccagccctcaggcagttcaagcaataagtactttgcccgacgccggacactgagtaccggttggtcagcaagcttcatgatttgttcggaaactggccagcgcaagcgcgaatttctgacctcggaatattggatcacattacccgtcaaatggggctcaattccccggcgactggtttcaacctctggtagctccggcatactgactccttaaattaactatctacaacatcatatctcagcagattacgataccgttttcatgtatcatttgcagccaaatttggttgggatagttgagagaatagattaattactatgcttgatataaaaaacagatttaacataggcaacaacaagaaatccttatggaatttatccattattggtctgtatatcattcttgtttatctgccggatattacaagatataaaaatcttgtcatgatcctcatctgtgcaaccgcactctgctatctcgtaaaagattttcgtcaggtagtcaattcactacgtagttcgctatttttatccattttgttattcgtcttggcaatattctattctatcggcatttcaattgattctgctctgagtttcaaggagatgaacaaacccatactcaatggattactgctgttcagcgtgactttcccaattgtgctctatcaggaaaagaaacagcacatcgcgaagatgattctgattgcgtttattattggcatgggtcttatctcgctaacagatattgcgaaatacctcatcaattattacgcaactggcgaaatgccgtttatgaattacaatcatcgggaattttcttacggatttctattctatttccctgtattgctatgtacctgggcattatggaaaaaacattctctactgagttggctactactgattattgcctcagctatcagcctgttcttattactcggtactctttctcgtggtgcttgggttgccattgttgtagccacagtatttattattgtgattaatagagagtggaaactcattctggctgcgacaatatgtctggggctactggccggatcaattcactggtcagcggtatctaaccccgccacgaaattgctgcttcacaaactcacccaaacagacagcagttatcgctatagcaacggcacccaaggttcagcatggtcattaatcatggagaatcccgtaaaaggttacggttttggtaataaagtctaccatcaggtctacaatagccgtgttgctgattatcctgattggacattcagaacttcgattggtccacataacgtatttttatcgctttggtttgctggcggtctcttcggtttgattaccacccttttgatgacgctttccacattatttacaggaagccagatcattcgccagcatagcgggatcatccgacaagctggcctcatccttctgacggcctttattggtctgtttatcgtcaggggagcttttgaaaatgcctatatcaatgaaataggtatcttattcggtttaatgattgcgctatacaagcaaaaagatgattaggaactgaacttattgttgttaaatgccagcccacaatgggctggcctacaaacgatttcagtaatcgcttatttagacaggttttccgctatcacttgcatgataagctttgcacgctgatcccagttaaaacgttctgctaccaatcgctgtgagtaacccactttagccatcatttcagcagggttatcaatcaatgattgaatctgctctgcaaagctctctgcattttcgctatcagcaaaattgaccgccttctcatccacagcatcgcgaatagaaggaaaatcagaaataacaacgggtttgcccattgccatgtattcaaaaagtttgaggggggatgtataacggctgccaatgctggttttcgttaatggtaaaacgcaaatatcattctctgcaataacctgaaaacgctttttcggctggataaacccaaggaaattgactttatcactcacgccaatctgttgggctgtacacttcaatcgttcaatctgcacgctatcaccaccggcaatgttcagtacagcattatcaaggtaatacatcgctttcataacagtaggaacacctttccagcgatgcaaactacccaaatacagcacctgagttgtttctcccggtttgtgccttctgccagaagacgctttttttgtagattcaaccgccagcatatcaacaccatcaggtgctactatcatcggtgtcttaacgctatattctttataaatatcctcactcaatagtgaagtcagcacaaacacggccttggaatggcgataaacctgttgttccgtgtttctgagcttatgatatttacggcgatttttacgtttatctaatttatgggattctttaaacgattgggcaaaaacttcgtggctttcaaaaaaatgcggaatatcaggatgcttacgcaggagataattcgccattttaatattgcgagtaaaaatagcgtcaacttgatgatctttcagccagcgagaaacctgaaaataaaacaatttctgtgtattgaggggaaaataccactttctacgcatattgcgcagagctatcagttcagcggaaggcggcaatgctctgcctataatctcctcaacacgattttgaccttctggcgtaatcaggcagacgctgtgcccctgacgggcaaaagcatcgacattctgcaaaatctgcaacgaagcaactcgataatcaggtacgggataagggtcaatatacgcaatcttcattatttttttatcgcgcccaataaacgatttgcagaatgttcccaagtatacatcgtttcaatccgctgacgagccagttttcccattgctttccccctgtccggcaaggacaaaagatgattgactgcctcagcgatagccgctgcattgccaggtgcgaccagaatacccgcatgattttcattgccgaccacctcaggaatgccaccaatataactggctatcacaggacgtccgcatgccatcgcttcagcaatagtaataccaaatgcttcatcaccaatactgggaaaaatacccgcatctcccgcagcataaaattcaggtaattgatcatgaccaacaggaggatggaaaatgactgttttttctaaattcagttcagaaactttttttttcaataagttaagatcatcacctgcgccaataatcaataaccttacatccttgtcacgcagtaaagccatcgcatcaatggcgactttcatgcctttccaacccaccagcctgccagcgaaagtcagcaaaaacgtattttcattgatatctagccgatgccggagatcagaattaacaggtttaaacttatcaatatcgacaccattataaatcacgtttggaaattgtttaaaatggtgctggatctgccaagcattaaagtggctgcatgcaacccacgcagatattttgttacccaatgcccgatcacctttgaaaaaactggtgccaccactcatataacaaaactttgtgcaggaagttttcggcatcattctgggccagaaaaaatcaaagggtttcgtcaaaatcacccagtcaaaattttcagcgatgaccctttcacgggcatgacgggcaaaagaataacgctcaacaatacgttgaaaacgtcgcccaatattgatgactcgttctctgggagtaaatggaaatgtgtgaacatgaatatttcgctctcccaatactggcctaacgtcacctgttccgccgaaaatatggatctcgtgccccgcatctgtcaaagcctttgctaattcccaaaccgctgtttgaataccgccataagacatagtaacggtgacatcgataaatcctattttcatttatccattatccttcatgtattttccaacaagttctgaacggaaacccagacttgttcaaccgatattgctgacatttcatcttggcgagtcgcctgttgataatctatcggatgttcaatcaccgccaattttggatgttgctgaggagcaagaaaacggccaggatgaaaactatggtatactaaggcaaaatcataacgtcgacgggaaaaccatcccctccattttgcctgtccctttgaaaaagcggttattgaatgaatttcactaatattctcaaggatctctttcgtttttttatgtgccaatacatcaatattcgcttcaggccatcgtaatttcaacgcccggatcactggcgttataagcaaagtgtcaccaaaacgggcaataataataaccagaatatttttaggctgcataatgacaagtataaaattattaaaccgataattggaattagagcactatacatcaaagctattcaatactctattaactgacagatagttttcatgctccccaaaacaataaaagaaacactatttcaaatgattaagaaaaaaataaccactttataatcagatgaaaacagacactattacggatagatggtcaaaatggaactatttacgctccatactaccgtaaaagataaactccattttttctaacatattatccatgctaaataaatcggcagcccgttccaatgaggcgttccccatctgcaaacgcaactcagcacttttcattaaaacatctaacctttcagttaactgttcaacacatcttggctcgataatataacccgtatcaccatcaataacggcctcagtgattgcgcccaccgaagtagatactacgggcaaaccacaggccattgcctgcataatgccttgtggcacaccttcattgccaaacgaaggtagtgcaaagacatccatcgcattcagacaatcaggcacatcttgtcggttaccgagaaaaatgacactctccgacagcccttcctgtttagcctggggttccagattttttcgctgaggaccatcccccacaaacagtaattgccagtcgggataacacgagtgcaatattttccaactatcaagcaagtaacggtgccctttccaggttctcatcgtagcgacaatacccagggtcggtttatccgctataccaatacgctgacgacaaagttgcttattttcgggatgaaaacgcgtcagatcgattcccgtcggcacagaggtcatgtgaggtaatgggtaaccattattcgtatgcagatattggcgtaacttctcccctgttgtcacaatatgctgacaggatttcaaatacagccagcgagtcgccacagatgtggatacgttagtggaaacatggcgggttcggactatcggtggcataccttgcaatgtggcacatgccgcagccactaaccaagaatcagtagagctatgagtattgatgacatcaaattgacggccttcggcttttagccagcggcgcatcgcccgcaagcagggaaggcgttttttttcaatcggcagtgcaacaacaggtacaccatacgaatgggcttcatgataaatcgttgacgctgggcaacaaacaataacaacctgatgaccgcgttgtatcatgccctgagattccgtcaggatgcggatctcttgccccccccaaccacacgatgattcagtgtgtaagatattcaaggtttttttagtcatttttcagaatcacgcctgacggttcaaacattaaaaaggcgttagtatagcggaacgagatgttacgtccatgcataacctgtttttaaccaagctatccaaacattctggcaggtataaaaaaacccagcatacgctgggttttttctcaatccactaaaattatttaattttagcttctttatacaccacatactggcgaataactggatcaaattttctcagttccagtttttcaggcatggtgcgcttgttcttcgtagtggtatagaagtgaccagtaccagcagaagaaaccagcttaattttatcgcgaatacctttagccatttttcagctccttagtatttctcaccacgggcacgcagttctgccagaactacatcgataccctttttgtcaatcacacgcatacctttagcagttacacgcagagttacaaaacgtttctcagactcaacccagaaacggtgagaatgcaggttaggcagaaaacgacgcttagtcgcatttaatgcatgggagcggttgttaccactcaccgggcgcttgccagtaacttggcagactcgggacatgtctattctccaaaaatcaaatcagctcgagctttatattgggtatgaccgcctcgtcaggcttaggagcccatctcagcacattttcatcactgaaaagactcacattatctcaataaaaaaacttactgagataggctcttctcgccaaacccaagatcctcaaaggtggcgtagtatacgccctcattcgctgatgctcaagtcccgaacaactaagatctgatcggatcgcaaaaaaaccagactaaatccaacctctttccacaaatgagacgcaatgttgcttcccaatcacgatatgatccaaaaccttaacgccaaccaactcacaagcatcaataattttttctgtcaccaatttatctgccagactgggttctggattaccggaggggtggttatgagcaagaataatcgatgcagcattcactttaaccgcctgtttcacgatttcacgcggatgcacttcaactttgtttatcgttcccttaaacatttcatcatgacagatgactttattctgattcgtcaaaaacagcaccacaaagacttcacgatcctgccaggacaataaatcctgcaaataattttgtgtcgcgactgggctactcatcacatcttcatggataaattgactggagaaaaaacgttttgccagttcagataccgcctgcaactggacatatttgcatagccccatccctttatgtgaacaaaaatcggcataatccgcagagagcaggtgataaagtgaaccaaatgatttcagtagatgttccgccatttgcacgacaggaatccctcgggttcccgtacgcaaaaatatagccaacaactcggcatccgtcagggaaacggcgccataagccagcaatttctcccgaggagcaagatttgaatgcaattcatcgcttatttccatcaccgtaacatccatatattccccctcattccctttcgcccagtggcttcacgccgccaatatcccatgatgaaaaaagcatcgccagccccattttcatggcttgcgtagcgcttcgcaaacttgtcattttttggcacctgaataaggcaggttctcaacttaatattttcttatggtagaatcttaggtaattgtaacttacatgtggacaatcagaatggcaggattttccagcaaacagctttctggtaaacatatcgtgctcggtatcagcggggggatcgccgcttataagacagccgagctggtacgccgtttacgtgatcgcggtgccgaagtacgcgtcgccatgacgccagcagcagaagcttttattacgccactgaccttgcaggccgtatcgggtcatcctgtctccgatgaccttttggatcctgccgctgaagcggcaatggggcatattgaactggctaagtgggctgatttgattattctcgctccggccacagccgatctgctcgctcgtttaaccgcaggtatggcaaatgatttggttaccacgatttgtttggcatcagcagcccccattgctgttgctccagcgatgaatcagcagatgtatcgtgcgcaggcaacccaacataacctgaatgtactcaaagagcgtggcgtgctgatttgggggcctgatgagggaagccaggcatgcggtgacgtcggcccgggaagaatgcttgaacccatggcgatggtcgaactggcaacacaacatttcaacaccgatcaggatttctccggtctttgcatcaccattaccgcagggccaactcatgaagctttagatcctgtccgctttatcaccaatcacagttccggcaaaatgggattttccatcgcacaggcagcagcggaacgcggtgctgacgtcacattgattgcaggtcccgtcaatttaccgacaccaccgggtgtcaaacgtatcgacgtaaccagtgcgctggaaatgcatgagtacgttcaggtaaccgcagcttcacagcatattttcatcggctgtgccgccgtagcggactatcgtttcaaacaaatagcgacggagaaaatcaagaaacagggtgatgaggtcacatttacactggtgaaaaatcctgacattgtagcaagtgttgccacgatggaaataaatcgtccatttgtcgttggatttgcagccgaaacccagaatgtggaagaatacgcccgcagaaaactcaagcagaagtctctggacttgatttgcgcaaataatgtatctctggccgaacatggcttcaacagtgataccaacgcattacatctattctggcatgatggcagcgttaatttacctcacagtagtaaattacagctcggccactgtttattagacgagatactcaaacgctatgacgaaaaaaatcgacgttaaaatccttgatccccgcattggacaagaatttcccttaccgacttatgctacacctggttctgcgggtttagatttacgtgcttgtctggataatgcagtagaactggctccaggccagactgaactcctgccaacagggatcgccatccatatcgcagacgaacaattggcagcggttattcttccccgctccgggctgggtcacaaacacggtgtggttctgggcaatctggtggggcttatcgactccgattatcagggacagctgatggtttcagtttggaaccgtggtgataagatgttcatcattgaacccggtgagcgcattgcccaaatggtttttgtgcccgttgtacaggccgaatttaacttggttgaagattttgaaaccagcaaacgcggcagtggtggttttggtcattccggtcgtcaataactttccataaagcctgataccgtcaaccgattttcatattttttgcccatgatcgtggtgggcaaaaaatagctggatttgttttgctgttttagcaggggtcttatcagacatggcagaaaaagaacgtacaaaaaagaaaaatagacgtgaggaaatcttacagacactggcacatatgcttgaatccagtgatggcagtcagcgcattaccacagcaaaactcgccgcaaatgttggggtttctgaagcagcactttatcgtcattttccaagcaaaacccggatgtttgatagcctgattgagtttattgaagacactttgatttcgcgtatcaatctgattctgcaagatgaaaaagacaccattacccgcattcggttaatcctcatcctgcttttgggatttgcggaaaagaaccccggattgacccgtatcatgacaggtcatgccctgatgttcgaacaagacagactacaaaaccgcattaaccaactatttgaacgtattgaagcgcagctccgccaaattttaaaagagaaaaaaatacgtgatggacagggattcaattatgacgaggccgtactggcatcgcagctactggcgttttgtgaaggaatgctttcccgttttgttcgttctgaattccgctatcgcccgacccaagagtttgaaatacgctggccattgatattaactcaactgcaataactgagcctgcaccgtgaaattccctctttcatgctgagaatgataacgtgcggttttttcgttgaattgtgttaatatgcatcttctcgttgagtttactataaagtaactcagtaatggcatcgttaccgtattacatgcggggtgtcatttctactactcaccccgcccggccattgggcgagggttttttttatctctcagccgtttttacccagcgggcaatcagataccgtattctctgcgataggcttccaccgccgccaaataaggctgcatatctggattttcacgtagatatctaatcaagtcattcaaagtaatgatggaaaaaactttgcagtgatagtcacgctcaacttcctgaatagctgaaagcgtctcctgcccgcgttcttgacgatccaaacacaaaataacaccagacaacgttgcaccgtgttgtttgataatttccatcgactcgcggatagctgttcctgctgtaatcacatcatcaacaacaacaacattaccttgtagtgggctaccgaccagtgatccgccttcaccatgatctttagcttccttacggttaaagcaataaggcatatcgatgtcatgacgttctgccaacgcgactgccgttgtggttgcaatcggaatacctttataagcgggcccaaacagcagatcacacgaaataccgctatccaacagtgctgctgcatagaaacgaccaatcaatgccacatcacgcccagtattaaacagccctgcattgaaaaaatagggactcttgcggccggatttcagcgtaaattcgccaaatttcagcacctgctttttcagtgccagctcaataaattcgcgttgataggctttcattggaatttttcctctttgatttcttgtcatacttatcgccattttgcaggcataaaaaaggcgactattcagccgcctgattaatttattatttcaacgcatctcgctgcgctgcaaaaatcgtttctaacccctctttagcgagggaaagcaatgagagcaattcatcatggctgaacggttcaccttctgccgtgccttgcacttcaatcatccggccgtcatccatcatgacgatattcatatcagtttcagccgccgagtcttcaacatattccagatcacaaagaccttcaccctcaacaatcccgacagacactgccgctaccattgatttcatcgggctttttttcagcttgccatcagcaaccaacttgttcagtgcatccaccagtgccacacacgcgccagagatggccgcagtccgcgtaccgccatcggcctgaatcacatcgcaatccagcgtaatggtatattcacccaattttttcaaatctactgcggcacgcagtgaacgtgcaatcagacgctggatttccattgtgcggccagtctgctttcctctggcggcttcgcgggcattccggctattggttgctcgtggcaacatgccatattcagccgtgatccaaccttgcccctgacctttcaggaaacgaggaattccttcttcaacggaggcattacataacactttggtatccccgaactccaccagaaccgagccttccgcgtgtttggtgtaatgacgggtcattttaataggacgcacctgccctgccgttcttcctgctggacgctttcctactggactcatagtgttctctccgctgttaaaacattattgggggcgcattatacgacctaacacggcgaatgcctatcctgcatctacgcggagagttataatccgctcatcattctataaattggaaacgaattatgatccgtagcatgaccgcttttgcgcggcgagatatcaaggccgattggggaaacgcagcatgggaactgcgctccgtcaaccaacgttacctggaaacctacattcgcctgcctgagcaattcagaagccttgagccagtcatccgcgaacgtattcgttcccgcctgactcgcggcaaagtagagtgtaacttgcgttttgatctggatacccgtactcagggaaccttgatgctgaatgaaaatctggcaaaacagctggttgaggcagcaaactgggttaaacagcaaagcaatcaaggcgaaatcaatccagtagatatcctgcgctggccgggcgtgatgtccgccgaagaacaggatttagacaccatcagcatacaattgctggcagagcttgatctggctcttgatgcctttatccagagccgtgaaacagaaggtcaggcacttaagacgctgattgagcagcgtttggatgcagtgacggaagaagccagcaaaatccgccagcaaatgccagaaatcttacaatggcagcgtgagcgcttacagaccaaactggaagaagcacagattcagttggaaaataaccgtcttgagcaggagctgattctaatggcacagcgcattgatgtggcagaagaactggatcgtctggatgctcatgtaaaagagacacgtaatattctgaagaagaaagaagccgttggccgtcggctggattttatgatgcaggaatttaaccgcgagtcgaatacactggcgtcgaagtcaattaatgcggatgtgacaaattcagcgattgaattaaaagtgctgattgagcagatgcgcgagcaaattcaaaatatcgaatagcatttcataacataccagaacatatcacaaagccagcatacaccttgttgtatctggcttttttgttatcagagcattgcagagtgaatcacagtagcgcatgattagggtgtacccaaaggtgtacccaaagcacatttagaaaaccattttgggtacaccccctatttttcattggagattgcacaatgcctaaactcaccaataaagagatcagggcgtggataaagtcaggcaaaaggttcgaggggaaagcggacggtaacgggctatatttacgttttagagaggctgaccgaattccatcatggcgtttcagatataaattggctggaaagtctagaaccatgaatttaggaacgtatgctgacctatcgctagccaaagcgcgagagcttacccgtgagttatccgcacgtgtttcgctgggctatgacgttgctggcgaaaagcaagaacgtaaagccgaagcactggcaaaaattgaggctgaaaagaacgctatcaaagtatcagacttagcggctgagtattttgaacgtcagatactgccacgctggaagcaccccgacatactccgcagacgcatagacaaagacattaaccctcgcattggtcatatgaagttggaggatgtaagaccccgccacattgatgaaatgctcaagagcattgtagacaggggcgcacccactatggcgaccgatgttctacggtggctaaggcgcatgtttgattatgccattaagcggcagatgatagagattaacccgtgttcggcatttgaggttgcggacgctggcgggaaagaagtatcacgcgatagatggctaaccagagaagaactgatcattctactgagaacgttcagaacgtcttcaatcagccgccagaatgaaatcagttttaagatactgcttgctctatgcttgagaaaaatggagctatgcggcgcacgttgggaagaattcaactttaaaaaggcagtctggcactttccggcagaacgtagcaaaaacggtgatgcggtagatatcccactgtgcccacaggttatagagtggtttatggaattaaaggctatggcttgcggtagtcaatatgttctaccagccagaaaaatgcagcatcgcatgatcccacatattcaggaatctaccttacccgttgcgctcgccaaagtaagacgggaattacctgttgatatgcctaacttcactatccacgactttagacgaactgccagaacccacttagccgcgttaggtgtagatccctttgtagccgaacgttgcctaaatcaccgtataaaaggcgttgagggcatctataacaggcatgattactttgatgagcgtaaagccgcactagctcaatggtgtgatttgctggtagcgctggaaaaaggcgaagactacaacgttactccaataaaacaaattaaacggaaatttttatgaagaagccacctgagattgatagatttaagttattttcattccaaggacgtgcaacacccaatgctgtagctctttcacttcttggtattaacccttatgcagcagttaaagatataccggaggaatattcagaaaatgttaatatgctaagaagtgctattgtgaataatgtaaacgctgtcaatccgttacaggacacaaaaacaaactcagcggttgattctgatatcgtatttggtgctgcatatccgtacgtgtgccttttagaagaatttataccagagatcattaaatcaagaatagaacaagctctaaacaatatatatacaaagtataaaaatgatgagtggaaaacatacattcacgcccttggtggacaagaattagttcaaaagatagcgatgcagaataaaaaaggtcagggacaatatcgcaaaaatgatgagcaaaaaggaacttacaaactgattgggctacttgtactactactgcaagaaaaaactataaatggctgtcaaccatcaaacaattacggctcaataggtaagcctaacaagaaaagaatttatgaagatatcaaagaattagttgatggaatgaacaaagacttgttagctgacggaattaacaaagactttttaggtggtgttggatcctccacattctatgacaaactaagagatgctgattactacttaaacgagagcgatgaacaattggttcataaccaataggccactaaatccccataaacctatccatgaatattattgcttacaaagtaagcagcaatgacgagcagtaatgaacaatgatgggcaatgatgggcaatgatgggcaatgttactcatggtattgacacggttttatatggtgttacatgattactaaccccacctaccacacaaataacataacgcactgatataattaaaataattatcaggtattcgatttttattctaatctttaaaattcatcactaaccttattttttaatggattaaaatagtttcaatggattttatgattgtttcaatggattccattcttggtggaaatcgtgttttttaagccctagaatgctcctaacacgtcacaacagagataggcataacatagggaggccagaagcagcatggtgaagcagaaaaacccacgcatgaaaaatacaagcccataccctgaaatcggtaatgcacgtaaacgccataccgcagactttctgggtatatctgattcaacgttacaccgttggattaaagataaaaagataccgcagccttttgaattagaggatggtttttttgtctttgatgcagcagaaatacgtaaatgggtagaaaataaaaaatcacgaagagaatctatagttatataaatttatttataactttattgatttatctttatgataaattaaatcttatccaacataactaacaaacccaaaaacatcaataaataggtgttgaatttttacgcccatatataaccataaaaaggacacaggttatgaatgaagtatcattctataaagatgaaaatctatcatatatctttaactacaagttcataccgtttgaagagaacggtaaagatactgggtttatgattcgaactattgaattatataaactggcaaagatgaaagattcaataaaaaaattcactgaactcacagggtttaactttgataatctgatcccctctgtagaggaaataaaacttcttattaagagaggacgaagtgttgtatcaaattattcaaagcttcctgaaaaagaggatgccgagctgaaaagtatggttgacatattaagcaatgctcaaagcggtaaaataaaaaatcctaacagctattctatcagtaaccgagcttggattacagatatgcaccacgcagtagaaaggaaagaagactctattaagcgtgagagaggtaaactggagaaagtgaatggtctctatggtttactatatccggttattgaatggttattttctgaaaaaataatggggtttaaaaaagaactattagaatctatccccagagaaacagtgaatttaaatgctttactatccggaatggattgggaacatagtcgcgcatgtaaactaattatatcagcgacggatgagttagaacgttgtattaataaaatcattagtcaatgtgttactccaaaagataaatatacgttaaatcatactcccgtttatcaaagtgattactataaattatattacagaaaagaaagtcatcatttaaagcatgtgttaaccgctgatgaatacgttaataccatggttaatgctaaaaatagaactaaagataaattgagctatatgtaatttaaaaaaaggaaattattatgtatattaccgccattccagatgcggccagaacttttcatgccaattttacccgtggggctgaatacacctctagcaatagtaatacttttgctatttctcctccctctgaaaatttattacgcgttgctatttcagattcaagttggtttttaaataaattgacgctagcggatgtgagccaagaaaacggcgatacggttaatttaggagataataccctccatacgggaagagttattgacggccgattccataaacgtgtcaacatggaaggtgctccttatgctttagaagaaacagatacctgcgctgcaatttcttatgaacaaatgtcactcattgccaacagtggcagtggggatgatgaacactttactaaaattatgtctgacttgttttctaaaacggtttcgttagacatgatcagaatcggctttaatggtgaattctgtgcctatccgactcaacccgatatctataaacgcgggcaagatgttaataggggctggcacgcaatagcgaaagaatttaatcagggttcacaagtgatcaccgataaaatttccttaggcaagaatggggatttccctaatttagatgctattgcaaattatcttatcatcaagaaaatccctgaagagttccgcgaagatcctcgcttagtggtcttggtcggttcagaactggcggcactctatcgagagaaattatttagtgcttcggataaggcggcagatattcaagccagccaactggcactcagtaccattgcgggacgctttgcgctcattccaccgtttatgccaggtcgtcgattggttgtgactacattagataatttgcatatctatacgcaaaaaaatacccggcgtttccgcgcggaatttgtcgatgaaagacaggtgtatgaacacagttatttgcgtaacgaaggttacggcttaggggatggcaacctttatgccgcagttgatgaaaatgcgatccacattgaagaaggggtattttcgctatgagtgaatcgcagttaatgaccacttggatttgtgttgcaacagagggacaaaccattgatagacgtgttatcgaagcgcaatggctgaatgaaatagcagaaacctacgatcccaattattacaccgcactgatctgggaagagcataaccgcaatctcgataatttaggggaggtactcgcagcccgaaccgatgtcattgatggaaaagcacggctctatttgcgattaagaccgaatctaaagctcatggaatataacagacaggggcaaaaattattttgctctatcgaggttcaagaggatttccaaggggagggtattttttatttgggtggtcttgccgttacagacagccctgcgagtgttggaacagacagattaaaattcagtattaaccgttctcacttttcccgaaagaaaagtaagttttcgattagttcaccggtagtatttaacctttcggatggactcaagaatacgaaaaatcgttggtttacagcaatctccgcaggttaactcttttgcccagtttaggctgggctgttttctcatccctatcaacttcgtagtttaagccgattttaatcatgaaaataaaaaggttgcatccgtctgaacggttgggctatattggaaacacgttagcaaaatctaacgtcaggcgtggaaacctgagaatagtaaaggcgacagtagacgccacatgcgtctttttttgtgtcgtaaataatgcctatctaatggcggcctacgcctatctgaattcaatggtggcgttgtcggagcacccgaaagggtggctggtttcctttactaccagtatttccacctctgataacgtcaccgcccctattgagcgtggaaactctggcggtgatcacttttacaaagtaaaggagatcatctttatgatgacagtccctacccaaactcaatttaaatttatattcctgtgcgtaaaacgttctgatactaccgctaaaccattccgtatagaggctacagcgctagatgaacacaacgcaagaatactgcttgttcatgattttgttctcttgtttgcagggcgtttacctgtgcagccaaagagagagaattgatcatgacaaatacaatccataaaaatgccgtcatttctgctacaggcgaaaagcagctattaagagtggcgcagatgacggcatttctcgccgaattattaaataacagcgaagggaagcctatttcaagcgaaggcatggcagtcgtcatggagtgtttatcagaacaagttgaactcattattgaggaaagcagcctaatgaacagggatattaaataatgaataatcaaaactatccagacgcttcaacgataccaacaagcataccttccgtgacggatatcgttaaggcagccaacgggcgttggtattatattttaagcaatttaggggtatctgtacccgaaaataacaagcatggagcttgccctaaatgtggtggcaaagatcgctttcgatttgatgataaaaacggtaaaggaacgtggttttgtaatcactgtggcagcggtgacggactcgatttaattaaactggtgacaggtcaagatattaaaacgacgtgtttcgaaatcaataaaatactcctcttacctgagtttaaaaaaataacgccaaccagaataaaaaaggctagcgcacaaaaaggtatcgagctatttgaaaaactgaaagccttatgtctttcaggcgaaagccaatatctctcaaacaaaggcttaaccaatcatcaatatttaattacgcagcaacaatatacgcaaggtgggattatttttccaactggatcacttttattgccattagttgataaccaagtttcaattaaaggcgggcaattaatcagcccgaaaggggaaaagagcctgttatccggttctgtgctttcaggttcatttattgtcgtcgctgataagacggataaaaacattgaacaggtggtgattacagaaggttttgccacagggttaagcctgtcaaaagtgattgatgctttcattgtggcggcggttgctgccactaatctggttaaagtcgcacaacagttgagagaacgatggccacaggcaaaaattattattgccggtgataacgattttattgatggcaaggaaaacacgggcaagttatgggcagaaaaagcggctaaggcggtcgatggttgggtaactctgccacctactcactataaagcggattgggatgattaccgacaagaaaacagtgacaacaaggtaaaagaggctttctttgaagaaatgatctactgcggaaaagataaagcctatttacctcaaggttttcgactcactcaagaatatttatggtatgacaagcttgtcaataaatcggatggtgataccgaagtcaggaacatcaaaattagtagcccgataaaagtgactgcaattacctgtgatgctgacagcagtaattacggacgtttattagaatgggaagatacttacggtaattgccgtaagtgggctatgccgatggaaatgttaagcggaagcggtgaagaattacgccgagtgcttttggtgaacgggctatcctatatcaatacttcagggcaggcacgggcgcacttgatggaatacatatcactgtgtcgaccagagaaaaaggttacttgtgtcaataaaactgggtggcacggtaatgtgtatgttttacaagatgaagttgtcggttcaggtgcggattccgttattttgcaaacctccagtgtccaaggcaaagattttagagtgtcgggcacaagtgaagaatggagagaacacataggcaaatattgcacaggaaacgcaagactcgccttttccgtgagtttagcctttgcctcatcattactgaaattagttggtgtaggtggcggtggctatcacttaaaaggtgaatccacggatggtaagacaaccacaatgaaagtggctgcgtctgtctgtggtggaacagattactggtatacatggcgagccactggcaatgcgcttgaaggtacagcctgccgccgcaatgatgcaacattgatgctagacgaaatcagagaagttgacgggcgtgaggcgggtaatattgcctatatgctggcaaatggtcagggtaaggccagagcgaaaacagacggaagtgtcagagaaaccaaccgctggaatttacttttcttatcaacaggggaactctctttagttgaacatgcggcgaatgcgggcgaacgcacttatgcaggtgtggaagtgcgtatgatccaaattccgagtgattcaggtaaacacggtgtgtttgaagacttacaccagtttgccagcggtaaatcactggctgagtaccttgaacaggccgtgactaaatatcatggctcaccgttccgcgattggctgaaatacctcactcatgatctgacatctatctcaggaacggctaaagccttattgaaagaatataccgcaaacatgatgccagagaatgcaggtaatcaggttggtcgcgcaattacccgttttgcccttgttgctatggcgggggaaatcgcaacacgagcaggaattacaggttggcaacaaggggaagcgtatgcagcggctgaaaaatgtttagcggcatggatgaaagagcggggacacaccgcgaatcaggaagatattacggcattggagcaagtgaccgattttatttcacgtaaccaattcagccgctttgcggattggtacgatgagaatagtcgccctctcaatatgatgggctttcgtcgcgttgaaaaaggcactgcaaatcaagatccaactgttcaattttatgttttatcctccgcatggaaagagatatgcaagggctttgattcgcgcaaagtagcccgtttgtgtgttgaaaagggttggttagaagcaggcaaggacggcaggatacaaacgagtatacgcctaccagaaatagggcttaaacgggtttacttatttaatagtgacgtcttaggttctgccgaataatcaggataaaactgactgtcttatatttaatgtgtaacagtggtaacactggtaacaaccagttatatcaaggcttaccactgttaccagtcaattttggggagtggcaacaactggtaacaaaaataggctgttaccacttgttaccagttcgttttttggagtggtaacacattaatctcttttaaatcaacgctgttaccagtgttgccagtgttactactgaaaatggaaaggtagttatttaactggctttattctggcaggcaattgatgtgaggattatcaacaatgaaagtattaaaagtatattgcccagagtgtgacggacaggcaacaatcaaaaaaatcaaaacgcaagaattgaataacataccggaaatttattgttgttgtaatgatgttgaatgtggtcatacatacgctttaaccctaagtttttcacattcgatacgtcctagtaagttggtacaagattcacgtaatcatgtattgaaattgtagcaatctgagaaatagcatcaataattttatgggaagaattatcagatgcagaacgcgaaatttcacacaatttcagtttacatttcctcctaccctgcatagagactgacttttagtttttatgttgggtttcctaccaagtaaaaatctcacgtaaaatagaaaaagtattttatttcaatgaaatacaatttatcacccagaatgtaaacgaatagaaaactgaaatttgctgaaattcttttcactcatttcagtttgagatttttctcacacagcgagtactggcacggtctggcgatttggtttgtagaattttaaaactgaaaaaactttttgatccaaaacgtgcaggcgggtgcggtgtagtgcgttttacgtcgggtttacgtttatttcgtggggattacgtggcgtaggcgtgatgtagtgacgtgaaccaaatgaatccatctagaccgcaaaattttatctgcgtagcttagcgtgcgattggttgcgttatatgaagatgtaaaagtcaccgttaaaggtgagccgtgccgagatctgagttgttgaataatcacccaagaaatgtacaattaatatgtacagatttggaggaatattatgcgtacatacacctcaactcaagcccgtgccaacatcgcggaagtgttggacacagcggctcacggtgaacctgttgaaatcactcgtcgagacggtagttcagcggtcgttatcagtagagctgaattcgatgcttggcaaaacgctaagctggatgcagagttcgattcgattatgcaacgtcatgggcatacgatagaggcactgacaaatcgatgatatgggtcagcgcacaggaagttatcgcttttcatgaccgaatattacaacggcttcccggcgttgccggaatgcccgattctggtagagctgaagcgctcatctatcgggtacaaaaccgtacacactatgaaggcataacagatatttttgaacttgcagcgacctattgggctgctatcgctcgtggtcatattttcaatgatggtaataagcgcacagcgtttttcgttaccatgacttttctctatcgtaatggtatcaagatccgtgataacgacaatacattggaaaacttaacagtagatgccgctacgggcgagaaaaccgttgaccagttggcgcagcacctgcgcgaattggtggactatactaacccgagctgtaatccatgataacagcacgtttttttgaggatgcaaggaacatctcaatttagcgtgtacccaagggtgtacccctagaaaatattgaatatcaccaatccagtaatgacaaggccttactccccatactcaatgaataaattcaatcgaatagcatttcataacataccagaacatatcacaaagccagaatacaccttgttgtatctggcttttttactatcagagcattgcagaacgaatcacagtagcgcatgactatcgtgtaccactagggtgtacccctaactatcacagaacctatttaggggtacacggctattttttattggagattgcacaatgcctaaaatcacagataaagagatcagggcatggataaaatccggcgaaaggcgaagttacagaacgaaccggaagcactgtcaaaattcaccggtaagtatatggaataacacgatccgtcatgggagttcctcgatgatgaagaaaaagccctgaaagccatgacatttgctgttaataacaatgatgccaacggctaccgtgaagccaaagatcacgctatcaaggcactgaaaaaaatggttgagccgatgacggaagctgaaatacaggccttgatagagcgcacacggcagaccatgaacgaaagcaatctacacgattgatatatcccattcatgtctgataagaggtgtaattcaatcattgagaagtgaagggttcgttcctagcttatagttaccaataccatatcaatattgagcttggcaaaaggataaggagtttacggaaagggttattcttggatggcataacagtatttgaattacactaaaggtaagctatccgtattatcaatctataccactaacaaatatgagaggttcgatacatggagcaacaccaccagccatttgaaaaaataaaaagaattgatgaatctggtatcgaattctggtcggctagagagctttctaagcttcttgaatattcagagtaccgtcacttcacgcctgttttagaacgagctaaagaagcctgctcccatagcggacacaatattgaaaaccatttcgaggatgtcctcgatatggtcaatattggctcaggtgcacaaagaaaattaaaggatataatactgtctcgctatgcctgctatctcgttgtacaaaatggagatcctagcaagccagtgatagcggcagggcagacatattttgcgattcaaactagacggcaagagctagcagatgatgcgacatttaaaagactacgagaagatgaaaaacggctattcctgcgcaatgagctaaaagagcataacaagcagctagttgaaacagcccagcgagcaggcgtagaaacaaatattgattttgccattttccaaaatcacggctaccaaggtttatacggcggactagaccaaaaagcaatccaccagcgaaaaggcttaaaaaaatcacaacgaatattagatcacatggggtcaacagagcttgctgctaacttgtttagagcaacccaagccgaggaaaaactgagacgagataacgtaaaaagcaaaacacaagcaaaccagactcattttgacgttggaagaaaagtaagagatacgatccaagagttgggcggaacaatgccagaggatttaccatcacccgagaaaagcatcaaacaattagaaacgatagcaaagaaaaaactcaaaaagtaatcacatcgctaatatgtgactttcatgattgaatacatttcaatcatcccattggtacacctcgatttagcgtgtacccaagggtgtcccctaggaaatattgagtagaacaaactcagtaatagcaaggcttcataccacctactcaatgaataaattcaatagggtttcataacataccagaacatatcacaaagccagcatacaccttgttgtatctggcttttttactatcagagcattgcagaacgaatcacagtagcgcatgactatcgtgtaccactagggtgtacccaaagcacatttagaaaaccattttgggtacaccccctatttttcattggagattgcacaatgcctaaactcaccgataaagagatcagggcgtggataaagtcaggcaaaaggttcgaggggaaagcggacggtaacgggctatatttacgttttagagaggctgaccgaattccatcatggcgtttcagatataaattggctggaaagtctagaaccatgaacttaggaacgtatgctgacctatcactagccaaagcaagagaactgaccagagagctatcagctcgtgttgctttgggctatgacgttgccggagagaaacaggaacgcaaggccgaagcgctggcaaagattgacgctataaaggtatcagacttagcagctgaatattttgagcgccagatactcccacgctggaaaccccccgacatactccgaaggcgtatagcgtgcgattggttgcgttatatgaagatgtaaaaaaatcaccgttaaaggtgagccgtgccgagatctgcgttgttgaataatcacccaataaatgtacaattaatatgtacagatttggaggaatattatgcgtacatacacctcaactcaagcccgtgccaacatcgcggaagtgttggacacagcggctcacggtgaacctgttgaaatcactcgtcgagacggtagttcagcggtcgttatcagtagaactgaattcgataattggcaaaacgctaagctggatgcagagttcgattcgattatgcaacgtcatgggcatacgatagaggcactgacaaatcgatgatatgggtcagcgcacaggaagttacccgaccatagattaatgcgacagaacccttctgataatctcattcaagatgaagcaaagcggcattattttttaagataatgccgttgataatattacaggatagataaaccctgattatcattacttcccagcagggattttcgctgatttccaggcagtaaataatgccaatagtggagtaatggcgaagagtaaaaatagccaataagaagaggaggaagcaccactgacaccaccgggttggtaaaacccaaacacattaacggtcatacccgccaatgcagaaccaaatgcgctcgcagatagctgaacgatggtaatagatgcccccccgatatctttatcagaatcggcagaaacctgtaagatgcgggtcacaatgtgcggccagccaaaaccgaccccaaaaccaaatagccccagcccaagaataagcggcaatatggtttgccactgacctgacgatgagcgcggcagcataacaatcagcaacaccatgccaagcagcataaagatagggccactcacaatggaaaaccgcatctttgccccctgccaacccgcgctgagtatttctgcaatcgtccagcctactgctgctgctgcaatcatatatccggaagccagtggagattgcccatgcagaacttgcagaaaataaggaacaaaaacgtcactcgacaggccaatcactaataacaacatggttgtgaacaataccagatgaggggaacgtaaactcaacgcattctggggcaatagtttcactagggtacggcgctcatggataatcaataacgcgatcaataccaccgccgcaatgataccactaatattggtcttcagatcttgtgacaagctacctgcggaaaccgccataaccgcagccgacagcagaaacagctgtacaatcggcaatgccgctttggtttcattctgtacattttttttcggtaaaatcaggtaggtaaataaggcatacaacagcgtgattggcaacatgatgccaaaagcataacgccatgtgtccatttcagcaaaaatgccgccgatggcaggcccggctaaagtcgctacgccccacataccagaaatcaacgccatagcacgaggccagagtgattgaggaaaaaccagatttaccatggaatatgaaagtgcaaacagcaacccaccgccaaatccttgaatagttctcccaatcaacatcacttccatcgtcggtgccaacgtacagaataaactgcctacaaaaaagaccagtgccgcaatcagataggattttctcgctcccgaagctctcaataatcgggcagaaagtatcgccccaataattgatgtcacaacaaacagagttgtattccaagcatagagattcaaacctccaatgtcgttgacgacagaaggcaaaatggtaatcgcaattaaagagttaatagcaactaatgctacacccagtgaaagcgccattgcattcgccgcatttttgctggaaaaaagatcactccaactattttcctcagttactatcatgattattatcctgaacaccagttgagttgtgaaaagtcttacgataaattaaacaagataaatcttggaataaattaatgtagggttcaacaatatgtcaagcattgacttggaaaataacatcataactgcacagactgtgagcgaacggttattgatgctactgaaaacacgaggcgccatgcaagcctctgatgcaggcaaaatattgggaacctctggagaagcggctcgtcaacaatttgtgaaactggctaaagagggtctggttgaagcagaatcagaaacgagaggagtgggtcgccctattcagctctggcatttaacggacaaaggccacgcccgattcccgaatactcacgcagagttaacggttcaactgttgaccatcattcgcagtcaactcggcgaaactgccatagatttactcatcaacacgcgcgaacaaaaaacttctgccagctataaaatcgcgatggaaggcgctgcggagttgcaggaaaaaattgagcgtctggtcgcaatacgcaatcaggaaggttatatggcgcaatattcggttcaggaagatggcgcgattctgtttattgaaaaccactgtcctatctgtgcagccgccacaatatgccaaggattttgtcgggcagagctgaaactgtttcgggaaattctgcaagccgaagtggagagaacagaatatatcttgaacggtgcccgacgctgcgcctaccgcatcacgccattgaaatagacggaataaaacctacacgactggaagcacgtaggttttattcgccttaatttccggtcgattcaaccaaatacaaaatccatcagttcatccttggtcggtgcgccatcagagccagaacggctgacagtcacggccgcaacacggttgcccagctccaccgcatcacgcagcgacattccctgagacagcccagccagcatgccgccacaatgcgcatcacccgcaccaatggtatctgcaacgttgacctgataagcaggaatatattccggttcgcagcccggctgacatatccacgctccctctgcaccaagacgaacaatggcagtgaacccccgctcattaacataacggccagcctgtaccactggatcgccggcgccacacagcatcgccgtttcatcaagatttaaactcaatattgttctttcagcaggcagtgcctgaataaactccctatctatatcaggcagacgagggccaaaatccaataccaatgtcagccctgagggagaagccagcaaccattcacgcaaaacgtctgcttttgggtttgccaattcatagccgctggaatagatatgcccctgctccggaagcggaatagtcgccagaatatcggcattccaactatcgtcacaaccggggacagaaacgtatatgcgcttatcatctggcgtcatcatggcaatgcaccagctattgtcacgttttggatgacgcaatgtcactgttaatccgagcatttccatctcttctgtgacacgttctccccaaacaccattacccacgaatatgccattgataaccggaatttgaagacggcacaatgcccgcacaacgttgaaagcacagccgcctacttgccgatcaacttcttcagcttcccaatattcaccgctgtggggtaattcagataacctgagaacaatatctcctgtagccgaccccataaccacaacaggcagtaaaggtactttcatcttgtatacctacccggcatcaaatacagaccataacaaataaaactgacaaaaaatgacaggagcaggccaagactggaattcgcaaaaatgccaactgcccatggaccactgatgaagtcatttttcgtcaccagaaaaccgacaaatgcacccaataaccaacacaatacggggatccatttaatgccactatttgaaccatcaccattgtacaagctatcaggacaataaccctgcttacggcggacgacaatgtagtcaagtaagaatatcgcctcccacggagccagaaacacaccgcagaataacaggaatgagacgaatggccccatgaagtcgccagtaacaaaaagaagataaatcgcaagagtcagaacaataatggaatcaatggtaacagcatggatctgtttgacttttatccccaatgtcaaaaagttcaagctagcagaatagaggctcaatactgccattgttactatccctgccgttgccgtcatcaagtaagggatcaccatccaatccggcaaaatcgagccaatttgagcgatagggttctctgatgtgggaagattgggtaattgaacagagagcagaatgcccgcaaacaataacagcaccaaaggaatcattcctcccgcagtgactgctgtaaaaattcccaatttggaagaaccttcgctctgatagcggctgtaatccgctcccgtagccgcccacgctatccccgtccccgcagcaaccaccgaaaccgctggcaggaatcccgttaaccaactgccggatggcatagctagcaccgctttccactctgtcgtaaacagaatataaaacacgacaaccagtgtcatcgcgccaaaaacgtggataatccagcgctgcatggcaatgagcatctcttttcccagcagagtgacgccaattgacagccctgcaaataatatcatgctgatcacggtcaaaagtgtactttcagtgagcccgcaagcctgaaataacgcagagagtgttaaagttccagtaacgatattaatggactcccacccgagggagatgccccagaaaatcatggtcggcgcaatatttcccctgatgccaaaaatgttacgagaaagcgtcagagttgaagttcttcccagtttaccgctgaaactgagataacccactaaggcaaaactggatagccctatcaataccgccagtgcagattgtagaaaagagagtttaaaggaaacaataatggcaccataaataatgccaagaatgccaatgttggcggccgaccagatccagaacagatccatcggtgtacccgtgcgttctgaaggagggacaatatcaatacctgtgtgttctaccttccagaatccctgattattctgctgtgtacccattacgttttccatcattgtctcaagggaaggtgcttaagacacaaggaataaagccctacctgagttgatttgactaatctgtaacatttccttggcaggaaacacgattatattgaataacgtcctgaaaacggctctggtcatggtttgaagggtactcactcccctaggttggcacaaacaatcgcgcgcattatcggagtaccatcaaaaaatctcaccatgaccagagcactacgtaccgactcgattaactcttgacgaagccaacaaagcctctgattcttcaagtgcctcatagcaactcgacggtcgctatgttattccagagccagcatagtgctcagactttgaagaatacataacacacttatttctcgcatcagatcaggtagtttcaaagtgatactgacaaactcccgacttcttatataagcaagatttatactttacattaataattaaggccaatgaaagtccaatattgttattttgtgatgccaatctaactccaatacactcttaccttagtgtaaatgctaatgtacacttactccgccaaataaccggggttaaaaagaatgccaaatcactttgttgactgggttcgcgaagaactgaaaaagaaaagtagtagtcctcgttacatacaattacaacaagccattgaaattgcgattaaaaaacaattaataaacgaggatgattttttaccgcctgagcgccggttagctgaattgcttaatatatcgcgagtgacagtcagtaaggctatgcagctcttggaagaaaaaggggtgatcatacgccagcaaggtgttggtacacaggttgccaaacccggtggaagctcactcaatcaggccgtgggtttcacttcccagatcgtgaaagaaggtggaacggtatccaattattggttatcgcggcgtatcattcctgcaccggaagatattgccagaaaattatccattcacatcggtgaaaaaattgctgaactgcgtcgtatccgccttgccaacggtacacctgtttcccttgaaaatacctatattccccgtgaatatttgcccaatcctgaattattggaagattccctgtatacgcattgggaagagcaaggtattcacctcaccaacgtgaatcacaaaataaaagctattgcctgctctatggaacttgccatattgctcaatatcgctgaaaaatcgccattgctgcaaattcatcaaataagccagaataatcagaacgagattattgagttcagtgaaatattatgccgtggtgatatttatgggttggatttcaatgcaccacagaatatcgacattaaatataataaaaaaagccgccatcaatagacaatcaattcaaaaaaacattctctctttctcatttacctatgatgatttatccctttctgccagacatctggcagaaagggatagagatagctactcttttcctgctgaattcaattgctggtaaatatagtgtttataactatcgaccagagctttgtcctgacagtcattcaacgcaccatcacataaatgacgcatcgtcatattggcctgatagaatggcggtgccgtcaatcgagcgcgttccagaatcataccaccgaggaaggagatatccgtcagcttgcctgttgtaatggcagttccctgcgccagattatcccgcatagtaaattgagttatgtgtgccggatcagctaacggagaatcatattgcccaaaatgaatacttggctgatgatcaccaaaatagaggaaaagcgttggtttatcgcgtgtggcaacaaattcactgaaatccttgatagcaggatcagatgccttgattttctccatataatggctgaacttacctactgctgatgaaccctccagtttgcctgtcaaaccgtaatcatcgctatgcccttcatcataagggccgtgttcatacatcgtcagagagaaaataaagataggcttgtccgtctccttggccagaatcgtcttcacataagacagcatatcttgtgttgggatcgtccataaattttcctccagactggctggataacccagttcctgtggctggataatgcgatcaacacccattgtcttgtaagcatgtccagcatgataggctgacttattgaatggcgtcagtacaacggtgtaataaccattatctttcatggcgcggaacaggctgttttgcaggtgatcaacgacaaaataaaatactgcatttttgcgggagccgaaatcatccgtgttcaatcccgtcaaaacagagaattcagatagccatgttccccccccaaaggtttgcactctgagtgggctttgagcgctgacatcggcatcacgctggaacatataaagatctggcagctgaacattggcaggcaattggtaaatatggggattaacggtggattcctgtaatagcagaaccacatcaggtttcacatctgactgaggctcaggcaaggtaacgctttttgcctgttgcagaaaatagtccgcagactcaccaaattggggcggctggtattcagtatctttagctgacatcatcatgttagtcatggttccacgccctttcggcaattcccgctgccatgttgcgtagtaagcattggtggtcagattgacgacacagacaccggcggcaaccagcgccacactggcaacgcgccattttatcccacatgcagggcctgcttttcgccaactcaacaccatattgaagatcaaccagatcagcatcgctgccatcgcaacacctgccagccagtaatgacgcagggtttcctgatttgacgggtctagcatgacattcaaatcggaaaacatcaggtgttctttgtagtaatggacttttatctggttgatgaatttgatgataatgaatacggttccggtaaacgccgccgaaaatagccaacgggctgaaaccaaaaacgccagaccaaagatgacaccgaatacgccgacagaaactaatgctgggtagatatcactgcttttttcaaacactattatccaggacgcaatcagcagcacccccaaatagatccccgagattatcttttttttcatacgccattcagttccataattgagttcagttttgcaccgaccgatgaaaataacatggttgcccgatataccgtgcataaaataaggcaccattttcgttaaaaccattcatctgaaaccatttcgcgaaaaaagttcacgaaattaattcggttggaacaattttttagaacattccctcatcccacagaatatgccaatcagattttctcggtcaggaacaatcgcggcaatcagggagtgctggatattgtgccaatgccgagttcgagaaagggttttgcaatccagcggaacactgtttattttatttgcgataagatatcgtccaattccatcttcaatggattgtcatacagcgctttttgctgcgtctgcgcgatttacgcagcaaaatggagataacttgaaaatgggtgattttctgtcgctaatgttttgggacgctcggcgcggcgttgatacaagtttttcaggttggcaaacaataacggaggaataaaacctgctcccctttcattcacgcgctctttgcctagctgatctttgggtacgatgcgaatactcataacctttttaccttttatctttctggttcagtggcctattgtaattccatcattcgtaaggagtacccctttgcttaggacaaatttatattattagacattgtcattccatctgaacgatgggaaataatgtaagataaaatagtttaattacaaaataatagaatacatgctctattaaacttaaaattagcaagaggctactttgaacataataaaaatcaacaaacagataggggatatatgatacagaataaaaaatccgtccaattatcacattctgttgttcattattactgtgtgggagaaggcgatggcattgtgtttttgcacggaactaacagtgatggagaaagcagttttggccatatcgtcaatgaattctcgaaaaacaatacggtgattattcctgattatgccggatgtgggaattctacccttccacaaggcgaaatcacggctgaacaattggcagagcaaattgccgcgattatcaaagacagcgcaaaataccctgttactttggttggcacatcattaggcgctgtcgttgccgccgttgtcgctgccaattatcctgagttaatcagcaaactggtattaaccgccccttgggcaagcagccaagatgccaggcaccagttgatgtttcaaacttggttggaattagaacaaaacgccccagacagcgccacggcttttggcctttctcacgtattaagcccggtgtttctgacctcattgggcaatgaaaaaatcaaacagatttgcagtaaagcatcggcaaaagatacggataaaagaattcagcttggactaaatatcgatattaatgaatcattaggcatgataaagcagcctactttagtgatagggttggagttcgatactctgatcccgatttatcaagtagtgaaggttcatcagaaaataacacagagccaatatagtagaatagccagtgggcatgctgtacaaatggagaatccacaggattggataagttgtattaaaaattttttacagagaacatgacattcccactgtcaggatcggcttcgaaacccgagcaccgattttgcggtggtgataatctcatatcggttattaagcgcagcattaataaattatttttcctgaaaaaacatcaataagacatatcgaaaattaaaatctctgtacagattttaattattacaacattaaacttaagaatatttttccaccaccaactattgaatatgaatatccccaagcaaatattatataaataataatcattaattaaatataaaacaccatttcacattaattagttttattattttatacatgagcatgcgattaaataagatatatggacaccaacttgaattcagtcggtgtccatatatcttatttagctgtcactcctgttaaataatttggtctgtgtagcagttttttattcagaaagagtgtatttgagttgttatcttattattccatcagattttttatggaaagaacaactctactgacttattagtatggttatctgactacatcagagcaattgaccaaagttgcatatcgatcgttcaaagcagccattgcagctttatgtactgagtcagctttaaccagtgaaccatcaatatatttcaagtcacggctagcgcaagcatctgcacagacaaagttttcatatcccaactctaatgctttgatagctgtagcagtgacacacatatggctcataaaacctgccaatacgagctgctttcggctagtcagtgataacaagtcacttaattctgtattgtaaaacgaactaggtaatgatttggtgacaatttcctcctcagtattagcttcaacatccttaatcaaacttgctttatcagtggtagggtcaaatatagcagagccgggtttggcatgatgtacaacatgaaagacaggaacattattttttctggcatacgctaatagcttagcagcgttggcgatagcttctcggccctgttcacctaattgtaaagcaccatcagaatattctctctgaaaatcaattaatatgagtgctgctttattccaatcaagtttcttttctgatgatccagatatttctagtaatgtttttggtgagttcattatcttaccctttatttgttaattaaactcacttaggttacgaaatctcatatcaaaagtaattatgaaatattgcatatagtatgtgcaaaaaagttcttatacattgaaccgccatcaactggcgagaaagatgcctactattatagcaactgaccgctcttctgaaaaattgcactctaggtcgtcgatacgcgttattagaggatatccagcgtgagcgtaaccgatatgagaaaagcggctcaacccataccccaaaaagggttattgagtccatagaggccatgatgcatcacatgaaaaataagttagccgagcttgaggctcttattgccgaacatataaaccagcaccctaatttaaaaaaagattttgaacttttaacctcaataaaggggattggaactcagatgggtcttaacgtacggatacctttactcgtgcaacgtaagtcgctgcatatcttggtgttattcctattgcaaagcagtcaggtacatcggtgtatggtcgagtgcgcttatctaaaacggggcctgctaaaatcagggctaagttctttatgtctgcactcactgcagttcgttttaatccccacataaatgatttatataatcgattggttaataaagggaaggcaaaaatgttggctttaggcgctgcgatgcgtaagttagttcatttgtgctacggagtattaaatacgcagcaatcatatgatgaaaactatgctattagaacttgaccatcaagatggtagcttattagtcgaatccgccatttataaatgttacgatttatatcttattgattacacagagtacatatatggatagtgtaaattgggatgatttgaggttttttacagcgctagtagaatgtcgtacagtttctgctgcttcaaaaagattaaatgtgaactatgcaacagtatctagacgaatagagcgcttagaacatactttgaggcagcgtctttttgatcggacccaggatggttatattccaacagttgaaggtctaatcttatataaaaaaacatctctggtgagagaaaatgttgaaagtttagaggagtactttagtctgggggggaagtttaaaaaaagcgtagttatttcgatggtttcttcaatggcagaatatttcctcattcctaagctaagtgattttgtcaaaaaacatccagaaattaggctagaaattgatgtgtcaaatcggaatgttagtattccaagaaaagaagctgatatagcattccgtttagagcttccagaaaaaggagaatatttaagcaaaaaagtaggtgatattacttataaactctgtgccacacctgaaattatagaaaaaattaaaaatgaggtaaatgttagcattattacctttaacagtgattttagtcatttacccgaatctcagtatctaatcaggcgctttggaaataaatcaattcggttccaatcaaactcagttactactcaacgtattgcggccgaaaatgggtatggtgtagccttacttccatcactggcaattaaaaatagcccattagtttctttagaattggatgaacctataatacgttcaatatggatgctgacatccaaacacacaatgcaaatgacagcaagtcgattagtcgctgatgaactacaaagaatttttgatgggatgaaataaatggattatcgactctatattttattaaaaattttaaattgacaatcaccatctataaaattatcaatatgattttcccctcctcgcagagatctaaaaataaaaaaatctaataataatcctttccacgctaatagtaacgaagagctagtaaaagataataaaacctacctttctttcctttattaggttcttgttgatgtggaaatttccgcaatggaaatatgtgctcatcaaatgttaaaaaatgatgatatgccttatgaatttagattggatttagcaaaacaagtttgggatgaaagtaggcatgaagaagcaaattccttcgtttatatcaataacgatgaagcctttcatgtccaaataggtaataaatggatatcgtatttagcagaaatcaatgaattaagtgaggagcagctattgaatgttatggtagttgcttcggaaaagataggtatcccattgtttggaaaaggagggtggaattcagaaatacggaaactcattggtttatagaaaccagggaaaaactatcatcttgatagagataaagacagaaggtgtcaggcgcttctggatggaacatattgatagtgatagccgaatcgtagataccctgccctgaatgtaacacagatggaacaaagttctcagatatcaaaatatagagtgatgtttataatgttcctgtgtcgaaataatcttgattaaaaaaattatcatgaataaatcttccgacactatttttagaaacggtatatttaataattattttaaataattatattttataaggaacatattatggatttccctatttatgactttgatggcaatcgtctatatgatgagattggaaaccctgtgattactatcactggtggatttgaaatgctgaaagatttaggtacattgatcgacatacaacctgattggggagtagacttaattaatggaattgatgatagctttgatattcccttcaccaagtttgatgattttgaggtaaatgttgattcgatcaacttttccagcattattaatggtatttctggtttaaatcaggagcaaaaagataaattagaacgcatcattaatgaacaaaaaaaactagctgacgaagatcttcaagcagctaacagaaatttgatggatatgaatcatgaagaattttctttatatcaaagttatatttcagaacttcaaaaagcaaaatctaaaaaaataattgagttaattaataaagcaattgacattattaacaacacaccggaaggaagaacgctaagtgatgtcagtaaatatccttacgagaaaaagcatgagatagattttggtagagtctcatatgtcatatatatggtaattgacaatgtaaaaaagttaaatgaattgttaaataaaaaacatactgaatctgttaacattaatgagctttctcttgatgatttggctgattataaacttcgtgaatcacttagtaacttatttttatattatcaaggcctgaaaaataaattaaataaagcattggacagagagttagaaagaatagagtaccttgagaaattatttactaaagataatggaatgaatggatgggacatgctttctcattttagaggagactcaggtcggacactcaaccttcatgacatcggtgtgcataatcaagttcgtgaattgatgcataagcaaggtggatttgagaagccagaaggcagcattcaatctcgttttatttcacaaattcaacgtggtgaacgaattgattttaaaaatcaatatgatttcgctaaggaagcaagaataacaattatcgaccctctgtgggctattggtggtgcaacagtcagcggggttttgacagatattaaggccgaaaataccggtgataaatataatgtatctggtgtaataagttataaactcgatgataaattttccagcccttgggatatatacaactggagtcctgttgaacttaattttggtggaacaccatatgatatcactggtgagtggtcggaaatagttaatttcgatgtggacaaagatgtttatgagaataaaattaaacccatgattggtcaataggaataattgattaaaatcattagtcgcgcattaaatgcgcgactttatggaacatatctatcaattaaaaaatggtttgataaaaaatcataggtagaaaatgacttattattgaaataatagtcattaatattgacactaatatagtttttttaaaatttcttttaaatataaaaaaataattaacaaacatcgttagagtaaaaaaacacacaaatatcataaataaaatagcgatgaatagcataacatgtccattgttgaaaaatttcccgtaacattatcccaaatgaaataaatcattagtagtaaaaatggcgttttgtgacgcaattgacaattatttcgataaatattgttgacgtgttgtttaggttgcggtgacgtaaatacgtcaccgcaaaatctgtggcacgggcgtggaaacccggtagactaaacggcgcatcgacacgcactagcgtgtttttttatatgcgcagccatgaacatatgtagatatggcggttcaggcagggcaacctttgggttggccgatacccgttcaggtcggtttatttgtcaaccttgatgcttcactgatagatacaagagccataaaaacctcagatccttccgtatttagccaaaatattctctagtgtggttcgctgtttttgcgtcagccacgagaatgaaccattgaggtcgtacttactttgcatgtcaccaagaaatttcgcctcaaaaccagtgagttggatctttgcggttagtgcatcgtgtagtgtttttctcagtcctccatgtagatgggcttctggtgtgctattggttggtttagttgccttttttgatgtcgctacagagcctttatccagctctgtaataaggtcaatctgcctatctaactcgacttggaatattaatgtgtcagcaggacgacctcgttttttaatctctaatttcatattgctgtaggtgtttaagtcttttgtgacggtatttaatattctagtagtgaagttccttagatctgtatactgcttatcaagcattagcatgaatttaaatttatctatgcttatttcaatatttgccttgtacacttttcgttgtgttatttctttgagaagccattcatatactcgcatggaatatttgttctcgaaggctttgacgtgttctaggttgtacttgataaatctttttaattggaaaagaaaaggctgaatgtgagggctgaaagtaagcgttactgattgtgtcttacggttgaattttgcgtagttgacccattgaaatatttctctgtcaatatctcctgtagggtacagaatctgtacagttcgactcataagctctcgtgtcgcattcgttagacgatgataggcattatcaagagtgagtcccatcatcttcgcatactcctgataagtgaatgtgaccgttcgttgttcttcagttggattttccaatgatggatttagtaacgctacgcaacacaaaattagttttgtttcatgttcagttaccgtcgtacccgccataccgccagcgcagatcttaaagaactgccttctgctgacttgcatggggatctcctcactcacattgttcattaacacataccccgacggaaaacccgtaggtatgtaattttgggcctagatttatgaatatttttcttttcattatggattctgcctgtcatcaacatcatccgtttaaatcgtgtaaactccctacgctcacgatttatccacacaaacagtatcatgaacgaatctgatggggaattcgcctaatggataatgcaaattcaggaaacaggttaatgatcgacgagatttgcggagccactcgtatcaatgtgcaacaaaaaaaccatctgaataacccaaaaccggactgggtggcagaagaaatcccgattgcattggtctacaacggtatttcccatgttgtgatgatggccagccccaaagatctcgaccatttcgcgatgggcttttcattatcagaaagcattatcacttccccacacgaaattcacggcatagataccgtaatcagttgccacggcggtattgagctgcatatcgaactttccagccgtcgttttacggaattaaaagaacgccgacgcaacatggcaggcagaaccggttgtggcatctgtggcaccgaacagattgccgaaattttccgcccgatcccccccttgcctttcacccagactttttcatgggattatcttgatcaggcgcttgcacaattaccccgtcttcaggaaatcggcgcagctacaggctgtacgcatgctgctggctggattgatgctaaaggagtattgcttggcggcagtgaggatgttggccgtcatgttgcactggataaattattgggaatacgagccaaaacgggctggcggcagggtgcggtattagtttccagtcgcgccagttatgaaatggtacaaaaatcggctatgtgcggtgtagaaattttgtttgctgtttctgccgccacctcgctggcaatcgaagtcgcagagaaatgcaatttgaccctcgtgggtttctgcaagccgggacgggcaacggtatatacccatccacaacggctggtggattaatcaagactgtggaacatccacaaattgggttcaatgtagtagcccatctgtttttcaatatccaccagcagcggtaccaacccacccggaatgatgtattccccactttgtgggaatttcatgcctgtccattcttgccattccgccacagtaccgtaaatatccatggagcgtagtgccggtttaatgatttttgcccccaaacgccaatgagtgcggatccaagggtcaaaaggctcgcctttttcatttttccattcacagtactgaacgaagtcttgcaggggataactacgtttcaggctcggcctgaccggaaccacaaaaccctgcaatcccgcttcacgggcagtctgtttcacgctgttgattaataatgcaggcacattatgtccacggaattcaggggcaacagtcaccgaaagcgctgacagcagagtcggttgctgttttccttttgctgccatcccagcgcaatacacggcatcccatccttcatccggcaattgatccaaagagtgctgttcccacgggaaaggaatggcattcaatagcccaataagacgctcttcctgcccttgttgcagaatggcaaatttttggaagcggctaaaatcaggttcatataatttttcccaatgttgttgagcaacaggatcctgattcataaaaaaaggccataaatgacgaacgagatcatatatttgttcgtctaaatcagtcctctcttccgcagattgaatgattattttagcgtccataattacccccgattaactctattgggtataaattaaacatagtaagcagagaattgcacatatacgatattcccgtaagatacccatctttaatgataaatttaatttatcattaaatttatttattcctgctcaaattcaattcttaatattaaatcattaacacattatctttatttttcattcgaagatatatctacgtaaaaatgcttatatagccagattaaaaacattagtttctataatggtattcattaatggaataattaaaataacttgattaaataaatgatttaaggattttttgcaaaaaacaacatgactaataacaccgtaatatcaggtgattaaatctacctgcgtcacatttttagtaaaaagtagattgttgctttcttacgctaaaacagcaaaaagcatcgaaatttaataagttagactcaaattttaattaataaactctgtaaaacccagaataaataataataattatcatttacattatcatttgaaaggtgtaggttttcttcgcgcaataaatcaggccgtttttatgattgggtaacgagggatcccccgattctaaatgaggataatgatgaaaaagatcaatgtattagtcgccgcgttaggcgcattagggtttatggcacaagctcaggcaagtgttggatttggccagagtcaagaagacactacacctcacattaaggttggtgccaccaaagcgagttcaagtccacacggtggctcaggtaatgaaccaggcattggcgtcagttccgttcgtgacggtatgctcatcggcttttccggattaacccgtatggctcctgctgacagcaatggtattcataatatctcgatggcaggcgcacccggctctcacggtggtatgggtgtatttcatttcagcaaagtcgccaatgcggacgtttactttggcgaatggtcacagacaggtaatgcaacagacacaacccataccgtttattatgcgggcaaggacattaccaccaatatgccaaccgacggtacagctacctatgtggtgaacggtattaaccagtacagcggtgacaatgccctttccggcacattaacggcagattttggtgaaaaaacgctgatcggctccatagaaaataccgctatgacagtcagcattgatgccgatatccagtctgatgcccaattctcaggtcttgctacaacaggtgatcttgagggagaaacccaaggtcacttctttggtgatggtgcttccagtctggcgggatatgccaaatttgatgatcaatccaaggataccgctttcggtggttcgaaacagtaattgctaatgtttcagagaacaatgccaaaaatggcattgttctctgttttgtttattgccgttttatttatcgctattgatttctggctatttatttctaataacgtgagccttgtgagctggtttttcgatgtctgacaatataacaaccccaatattattaacggcactgatggccttatgtctctccctgccggtttatgctgatgaagataccaaccgcaaaatctggcaggaggcgcagcacaatcaacaagaaaatgaagctgatctgataacgccagagcctatttttattgaggatggtgcttcatcgatagtcattaacggacagacatttcaggtagaaaacaacctcgataacatcggtcaggcactataccttgccactaaccatcgacagtggccggacgtcagacgttttctgacggcttatcaaaaactatccgggcatgatgtcatgctggcctcttttgcccagggcggcctggcgcgttttgaaggcgatttggatctcgccgcctatcattatcaaaagctcctgaaccaacaacccgacttcacacgcatcaagctggaactggcccgtgtttattttgaaaatcataaaaatcgggaagccgagcaactgtttgtaggattgagtgaacagaacctcttaccggaaacggtcttgaaaaatatcaacagctatttgaaagcgatagcattgagaagtgactggcgtggctctttttcggtaggttatgcctataacgataatgtcaatatgtctccggatcaggaatcaacctgccttgaatataaccctgatgggagttgccaggaggaacgccggataccaaaagccattaaaaagtgggggatgtcttatgacgccacattaagccgacgttaccaactttccggtcatcacggcatttttggacgtggcctgatttatggcgaaaactaccgtgattaccacgctgaaaatgaaaataccgtcctgctggtcagcggatacaactacaaaagcagaaatcacgatttctcttttggccccctgtttgaatataaacatcgggcgggtgatacctattaccgcgccacaggtgtcaaaacggaatggagacaaacattcagccctaaaacagctctcaatatcgaactggagcataaacaactgcggcatcagcagcgttaccactggaaaaatggcgacctctcctcatcctatctcactctttcccatgccatcagcaaagaatttgtcatatttggtggcggtgactgggtctatcggaacaatccgcaaccggcggatcgctatcaacaatggggaattcgggcaggcgtatccggacagatctaccccggtattaatggctcactgtctgccacactgcgagagcggcgctttggtgcttacagcccgatactgctcgccagacgtcaggatgatgaacagatctatactgccgtcattaaagtccctgccgctgaaatattgggtatgaccccctctatcactttccgccatcgacgcaatcacagcagtgtgaattggctgtacaactataacaaaaacgaagtactgctgaggctggaaaaatatttttaatcaataagttatgattttctatttgcgtgatgatgattgacaaattgaggcaaggaatatcaatggtataccgagttaaaatacagctaacccccattacaattgcactatcactggcattttcgctgacagcacctcccctgtttgccgaacccaaatctaccgtcacttctccaagcaagcagacggatttgggcaaaattagtgtcacggataacagtgataaagatgaagccggtcataatgcggtctatgacaaagatatctccaatatctatatcggcaaggaacagatagagcgctataaaggagcatctcccgccgatctgataaaaggtgcggtgggtgtctacagcggtgatgcccgtaatagcggcgctttggatatcaatatccgtggtattcaggggcaagggcgcattcccgtcactattgatggtacggagcaggctattacagtggggcgcggttataatggcgccaataaccgcaactatattgatcccaatttaatcagtagcatcgaaattgaaaaaggtccttccctgagccgcaacatcaaaggttcaatcggcggagccgtggttatcaaaacattaaccattgatgatgtcgtaccaaaaggggaaactttcggcatcaataccaaagtggaaaccagcagcaattcagttaaggaacgcaagccttctttggtactgggacaagactaccgcgatgttcccaactttatccaaaatggcgtcgaagctgatcctgagttgaaaatcacgccccattcgtcaaaagacaataaatttcccggatttaaagataatgccttccgggtcgcattaggaactcggcaggaatattttgatctgatgctggcttatagccaccgtcgtcaggggaattattttgccggcaaaggcggtgcacaccgctatgatgaacctattacggcagcagataccgaattaatgaatggctataaaacaacgttagatccttacctaccgtttgctgcccgtatctatcgccccggcaatgaagtacccaatacttccagtgagatgcgctccgtattaatcaaaaatacttggcgcctcaccaatgatcaggcattacagttaggttttcgcaatactcacatggaatttggcgatatcatgccttcgcgcttgggctgggtgaaggccgaagataatgctgttccacaatggccactggcgaatgtccaccagcaagccgtcaatctgacttataaatggcaagcggcggacaacccctatatcgattttgatatgaatctctgggcgacccgcacgacaagcaatactaataccgctgggggatatccccgaacacctgtagagagggactactcttgggataatggcagtggtgtcaaagcctctcacattgatggcacattgattgataccgccaaaaccaatgcccaaaacaatcgctggggcgtggatatctccaataaatttaccttggcctccagtttggatctgaccttaatggggaatttccaacgtgagcatctcgactccaatgatggctacaatcccttaaatatgtacttcttccagtcgccagcacggaaagggcagcgtcaggaaatcaatctcgcctttaactttgactggcgaccaacatcatggctggcactaagtgccggtgccaaacgtgtctcctattggtccaaagatgattttcttagtgaacgacgtgcagcaagagatgaccgttatagaaataactcggaaaccaccggacatcaaataagttactaccgaacgatgaccgaaagagaagcttatataaaacagaaaaaactgtctaaaatgagtaggaaagaacgaactgaatattttaaggtaaagacaggagatatcacctcccgcgatgggcagcagcgcaaaatggttcgtcaagaagtcgactggctctacaattccagcaatggccaacttaataaaagcgataacccctactttaatgggcagttggatatgcaggaaaagattatcgacccaatcacgggtaaagagggatataagtatgaatatggctcaggagttgatgcaaatggtataaggcgtgagattcctgatgctgatccctgggaacctgcttctaaacgcaaagatcacgcgtgggcgcccactttctctgctactgcctatgtaacggatgatttccgtatctatacccgctatgccgaagccgtcagaatgcccagtatttttgaagacactgtgggtttctccggtaacaaaagcaatcgcgtaggccaaaaattcaaacccgaacgagccaaaaccactgaagttgggttcgtctatgatttcagccaattggttgatgctgaacgccatgccgatatcaaagtttcttactacaacaccgtgattgaaaatgtatttgaccgggataacacctatgaattttctcaaatggacaaacagaaacttgccggtctggaactacaggcgcgttacgacaatggcagtttctttaccgatatgggattaacctacaacctgaaaaataaagtgtgcgacaacaattcttcattgagaatgaattcattgaatcgctacgatataccagaatgtattgatggcggttttgcgggaggctatctgcgtacttccattcagccccaatattcagcgaatctgactgtcggcgggcgcctgtttgatgagaagctggagctgggcagccggatgctttaccacagcaaagcagagaacaaagatgaaaaatggctgatggaagcattacctgatgtctataagggccaatcaaataacccaatgcgctggaatccggttttcaccgtcgatgcctatgttagctaccagatcacgccaaccctatcgatggaactgaccggaacgaacttaaccaatcgctactatctcgatcccctgacacgctccatgatacctgcgccggggagaacctttaaactcagtattaccagccagttttagaggatgatatgaccaacacagccatattggagagtccaaccaaccattttccgctactgcccggaaagcaacttctggttggtatcctgattgccattttattgcatatcagtctgatatggctgttcaatcgacattcctcatatgatgacagcgctcatcatgtaaaccaaagttcgcccttaacagggctttccatcacgatggtagccgcttcgtcatggcaaaatgagccagagcctgtctctcctccgcccccgttgatcaccgcgcctgaatcgccgacaaagccagaaattgctctggataaagcggttcagcccgaaaacaggctggaaaaacccttggaatccgtcaaaccgcaaaaacgccaaaaacagcaaaaagaaaaaccacaggagaaggtagaaaaaaaatcagcaccatcaccacaagttcagaaagacaataatgaagaatttgaaaccagcggcactgatcaaatcaatgcacaaagcagcatgagccgagccgcaaccacacagcctctggtgggtcagggcaatagcgcgctggataattaccagtcaagactcaagcaagaagttgaaagccacaaacgttatccccgtaaagcaaagcgaatgaaacaacaaggcacagtgaccattggttttactctgcttaatgacggttcattcacggctgccagagtgatcaattcctctggcaacagcgtactggatgatgccgcgctggatgccatcgcccgcgccagttcggttggacccaaaccggtagatatggcacccgatgtaacgcttaaaattgattttgagctgaattaaataacctgagatttgcttaattgcttatacattccaacctagaaaaccgagcttgaatttacgggattgtgatatcgctatttttaaacgaagctgaggttaaaataagaacattaggtatttttttcacccattcatttcccaatacaaaagctcgaaaaaatccgtcccagcaaatcatccgaagtaaattcaccggtaatttcacacaatacctgttgcgccagtcgcaattcttccgccagcaattcccctgaacgggcaaaaaccagttgttgatggccttcctgcaaatgttctgctgccgtgttcaacgcctgtaaatggcggcgacgggcgagaaagcccccttcggtattgctgttgaaacccatcgcctctttgagatgatcccgcagcaaatcaataccttttccctcacgggcggagaggcggattaatgagtaaccacttacttctaatacgccggtttcttctccggtcatatcggtcttattgcgaatcacggtaacaggcagtgatgcaggcagctttgccataaattccggccagattttcgcaggttcaacggcatccgtggtcgtgctatctaccataaacagcacccgatccgcctgctcgatttcctgccatgcgcgttcgataccaatgcgttccacttcatcgctcgcttcgcgcagccccgccgtatcaataatatgcagcggcattccatcaatatgaatatgctcacgcaaaacatcgcgtgttgtacctgcgatatcggtgacaatcgccgcttctcggccagccaatgcgttaagcaggctggattttcccgcatttggccgccccgcgataactactttcatcccttcacgcaacaaactcccctggcgtgcctgtgaacggacgtgatcaagttcttcaatcacttcatccagcctggcttctatcttgccatcggaaagaaaatcaatttcctcatcaggaaaatcaatcgccgcttcaacgtagatacgaaggttagtaagcgcttccaccatttggtggacttgatgggaaaatgttccttgcagagaattcattgctgaacgggcagcttgctcagaactggcgtcaatcagatccgcaatcgcctcagcctgcgccaggtcgagcttgtcattcaaaaatgcacgttcagaaaattcacccggattagcaatacgcacagcagaaattgtcagaatacgttttaacagcagatcaagaatgactggcccaccgtgcccctgaagttccagcacatcttcgccggtaaaagagttggggccggggaagtaaagtgcgatgccttgatccagcacagttccatccacatcacggaagggtaaataatcagcgtaacggggcttcggcaacttgcccaataccacctcagcaacttccgccgccttagggccagaaatacgcaggatgcctacaccgcctcgtcccggaggagtggcctgagcgactatcgtatcggtggtattcatgaaactctctctttgactaatcaactgaaataataaaggcggccaatgaccgccttctagtcagctcttttaaagagctactttttttcgcgggtatgcaaaccgcgtttttccagactgcggaaaataacctgctgctggatgatggtgaccaagttactgacgatatagtacagcaccagaccagacgggaaccacaggaagaagacagtgaacatgacgggcatgtaagtcatgattttctgctgcatagggtcggttacggtcgttggtgacagtttctggatcacaaacatggtcgcacccatcagcaatggcagaatgtagtaagggtcttgtgcggacaagtcctcaatccaaccaatgaatggcgcatgacgcaactcaacagaacccatcagcatgtaatacaacgcaaggaagattggcatctgaatcaccagaggcagacagccacccagcggattcactttttctgttttgtacagcgccatcatttcctgactcatgcgctgacgatcatcaccatgacgctcacgcatcgccgtaattttcggctgcaacagacgcattttcgccatggaggtgtattgcgccttagtcagcggatacatgataccgcgcacgataaaggtaatggcgatgatggagaagccccagttaccgatgaattcatgcaggaatttcagcaacttgaacagaggttgagaaataaaccacaaccagccgtaatcaacagtcagatccagatgtggagcaacttcagccattttgtcctggatttcaggacctacccacagggtagaggagatattctgcttgctgttaggcgcaatattgacggtttcacctttgtacccgattatcgccattttctggtttttcaggtcaatagtgtaaaacgtgttggtagagtttgcgcccggcacccaagcggtggcgaaatattgctgcaacatcgctacccagccaccgttggtcgttacggctaacgctttatcttcaatatcgccgaatttgtatttttcgtattttgcttcagcggatgaataagcagcaccgcgataagtatgcagagcaaagttgctgctgccagtatcacgacttttcggcagctcaacactctgcttcaactgaccaaagaacgccatctgcaacggcttgtcagtcacattatcgatgttgtaatcgacagaaaccgcgtaattaccgcgtttcaaaatgaaggttttgacataaacaacaccatctggtgcagtgtaagtcatcggaatacgcaattcattctgaccatcagccaaaacgtagctatcctgagtggtgtggtaaaacgggcggtcagcttgattatctgggccattggtgccagttaatccactttgagcctgataaatgaattcaggggtgctttcgagcagtttgaatggtttgtttgaaccgagggtatcaggataggccagcagatcagcctcttcgatatcaccgccacgggtattgatgtgcaaagaaagcacatccgttttcacggtgatcagtttaccttgcccactgctagcttcactactcggcgtatttgcttgttgcgtgatctgtgccgttggttgtgggttctgatctttctcccacgcctgccagaccaagaacgaaacaaacagcaaagcgatgaaaagaagattgcgttgcgaatccatcgttaatgttctctgttatcttcgttttttttaggtgggacaggatcatcaccacctacgtgtaaggggtggcattttaatatgcgtttcactgttaaccaactgccttttatcattccaaacctgcgcaatgcctcaatgccatattgagaacaggtaggatgaaaacgacagcgaggccccaacagtggactgatcaccaactggtagcccctgattatcgcaatcaagagccgcgaaccaagcgacagtgacgacgccataatttgcccaacgcctccgttagctcacgattatcaagctcagcaacccctttcctcaccaaaaccacaaaatccatggaaggcaaattatgctggtttaaacgaaaactttcacgagccaatcgcttaatacgattacgttcatgagcgcgtttaacattttttttagcgacggttagaccgatgcggggatgccccagctcattaaggcgcccaagaatggttatctctgcggagcttgcccgttgtggctgctggaaaacataagtgaaatgctcgggagttaacaaacgtaactccctcggaaaagcgagcttaaccacgtggtatgattagctttattacttagaaacagtcagacgagtacggcctttcgcacgacggcgagccagaacttgacgaccatttttagtggccatacgagagcggaaaccatgagtacggttacgcttcagtacggacggttggaaagtgcgtttcatagcgatttctacctaacttaaaatttgttactgattcagcaaattcgttggcgaccagtgagaaataagtagacaccgatgcctcagtcgcaacatcaatatatagaaagaggcaggattgtaataaaatgtactacccctagtcaatccatcaatctaagatgacgcgagcctgaccgctttcctgtcggtttttttactttaaccagacattaccagacttttgctacccgaggtgcttatccaaaacttaaccagccaatggccggaaaaaatcgttggcgtaacacgcagggtggaggattatacggactgtgtaataaagcgcaaggatcatacaccgatccttacaccttaatcgtgatcatcacgttgttttcgcatcatattttaaacaatagctaaatggaatttgctatataccatgattacactacagtatcttctacgagccttatattctccgagtgccaaagcgtggcgatctccctgtggataaaaagcgtcaaagctgtgtaaaagaatgaagatctataccgtcttttgcgttatgatctccgatcccgatctctctatgcggatcgttggggagcgatgatagtcaaaatcgccacaaggtacatgcgaccttcctcatcatcggaggagtgacgccttgtacccagtataacgtatctattattccgatttcttttattagtcttgttttaggggagttcgccgtgtcactttcgctttggcagcaatgtcttgcccgattgcaggatgagttacctgccacagaattcagtatgtggatacgaccccttcaggcagaactgagtgataacactttggctctctatgcccccaaccgtttcgtgctggattgggtaagagagaaatatataaacaatatcaatttgttattaaatgatttctgtggtcctgaagtaccgttactgcgttttgaagtcggtaataagcctgtttcaccgaaccagtctacatctcagaaaatcattgccaacatgccgatagctactgcgccgtccagtttatctgtacgcccaagctgggataatgcaaaagcccagccagagttatcctatcgttccaatgtgaacccaaaacatacgttcgataactttgttgaaggtaaatccaaccagctcgccagagctgcggcccggcaagttgccgataatccgggaggcgcatacaatccgctgttcctctatggcggcaccggcttgggtaaaactcaccttttgcatgccgtcggcaatagcatcatggcgcgcaaagccaatgcaaaagtggtatacatgcactctgaacggtttgttcaggacatggtaaaagctttacaaaacaatgcgatagaagaatttaaacgttattatcgctcagtggatgccctgctgatcgatgatattcaattttttgcgaataaagagcgatcccaagaagaattctttcacacgttcaatgccctgctggaaggtaatcaacagattattctgacctcagatcgctatccaaaagagatcaatggcgtcgaagatcggttaaaatcacgttttggctgggggctgaccgttgccatcgagccaccggaactggaaactcgcgttgccattctaatgaagaaagctgacgagaaccaaatccagttaccgggtgaagtggctttctttattgccaaacgcctgcgatccaacgttcgtgagctcgaaggcgctttgaacagggtcatcgccaacgccaattttaccgggcgggcgattaccattgattttgtacgcgaagcactacgtgacttattagctctacaagaaaagctggtaactattgataatattcagaaaacagtcgctgaatattacaaaatcaaggttgctgatctgctttccaaacgccgttcacgctccgttgcccgcccaagacagatggcaatggcgctggcaaaagagctgacgaatcacagtttgcctgaaatcggggatgcctttggtggacgtgaccatacaacagttcttcacgcatgtcgtaaaatcgaacagctgcgtgaggaaagtcatgatatcaaagaagatttttctaacttaatcagaacattgtcttcctagcgctatgaaatttatcattgaacgtgagcaattattaaaacccttacagcaggttagcagccccttgggtggccgccctaccctgccaatcttgggcaacttgttgttgcaggtgacggaaagttccctgttgctgacaggcacagatttagaaatggaaatgaaggcacgggttgctctgactcagccgcatgaacagggcgcaacaaccatccccgcacgtaaattttttgatatctggcgagggttgccggacggagcggaaatcagtgttgaactggatggcgatcgcattctggttcgctctggccgcagccgtttttcactgtctaccttgcctgcttcagattttcctaatcttgatgactggcagagcgaagtcgaattttctctgccacaggcaacactgaaacgtctgattgaatccacccagttttcaatggcacatcaggatgtccgctattacttaaacggcatgctgtttgaaaccgaagaggaagaactgcgtaccgttgcaacagacggccaccgtctggcagtttgctctatgaatatcggccagaacctgccttcccattcggtgatcgttccccgtaaaggcgtcattgaattgatgcggctgctcgatggcggcgatagcctgctgcaattgcagattggcagcaataacattcgcgcgcatgtcggtgatttcatcttcacatcaaagctcgtggacgggcgctttcctgattaccgccgcgtactgcccaaaaacccagataaaacgctggaagcaaactgtgacgtgcttaagcaggcattttcacgggcggcgattttatccaacgaaaaattccgtggtgttcgtatctatttaagcgaaaaccaactcagaattaccgcaaacaacccggaacaggaagaagcggaagagattgtcgatgtcagctaccaaggcactgaaatggaaattggcttcaatgtcagctatgtgctggatgtcctgaatgcattgaaatgcgagcaggtaagtctcttgctgacagatgccacctccagtgtgaaaatagagaattcagccagtcaggccgcgacttatgtcgtgatgcctatgcgcctgtaaccacattgactcattgttatgattctctcgcgtttgctgatccgcgattttcgtaatatcgcggatgccgatctgactttggcaaccggttttaattttctggttgggccaaatggcagtggtaaaacaagtatactggaagccatttatacattgggccatgggcgggcttttcgcagcattcaggcgggaagggtgatccgccacgattgtgaagaattcattcttcatgggcggctggaacagcaattccacgaacggatcttggcggtagggctgagtaaaaatcgtctgggtgacagcaaagtcaggatcgatggcagtgacgggcataaaattgccgaactggcgaaaatgctgccgatgcaacttatcacgccagaaggttttacgctgctaaacgggggtcctaaataccgccgcgcttttattgactggggctgctttcacaatgagccgcgtttttttactgcctgggtcaacctgaaaaggctgctcaaacagcgaaatgcggcgttgcggcaagtaacccgctatggccaaatccaacactgggatcgcgaacttgcaccgctagcgactgaaataagccaatggcgggctgaatacattgcaggtattgctgaagatatcgagaaaacctgcaaacaatttttacctgaattcaccctcagcatcagcttccagcagggctgggacaaagagagtgaatatgcagaactgctcgcgcggcaattcgagcgcgacagaacgttaacctacacagcttccggcccccataaagccgatctacggatcagggtggacggcacaccagtagaagatatgctctcccgtggtcagttgaaattactgatgtgcgcgttgaggttagcgcagggtgaatatttcacccgacagagcgggcaaaaatgcctgtatctgcttgatgattttgcttctgaactggatgccggccgtcgtcaactgttagccgagcgtctaaaatctacgcaagctcaggtatttgtcagtgcaatcacgcctgggcaagttacagacatgattgatgtaaatagcaggatgtttcgcgtagaacatggcaaaatcgaggttcaaccacaggattaagatgagcgagaaacgttgatgtcgaatacatatgactcctcaagtatcaaggtattaaaagggctggatgccgtccgtaaacgtccaggcatgtatatcggtgataccgatgatggtacaggcctgcaccacatggtcttcgaggttgttgacaacgctatcgacgaagccctcgcaggtcattgtgacaaaatacttgtcaccatccatacagataactctgtttctgttcaggatgatggccgcggtattcctaccggcatacacgaagaagaaggtgtttcagcagcggaagtcatcatgaccgtgctgcatgcggggggtaaattcgatgacaactcctataaggtttccggtggtctgcatggtgtaggggtttctgttgttaacgccttatctgaaaaactggaactaattatccgtcgggacggcaaagtccacgaacaaacctaccagcatggggttccacaggcgccgttgaaaacggtcggagatactgagcagactgggacaactgtccgtttctggccaagtatggatacgttcaagctcaacaccgaattcgaatatgatattctggcgaaacgcctgcgtgagctgtcattcctgaactccggcgtttccatccgtttagtcgacaaacgcactaatgcagaagaccatttccattatgaaggtggtatcaaggcgtttgttgaattcctgagccgcaataaaacgcctattcaccccaatgtcttctatttttccacggaaaaagacggtatcggcgtggaaatttccatgcaatggaatgacggttttcaggaaaacatttactgtttcaccaacaacattcctcagcgcgatgggggagcccatttggttggtttccgtgccgcgatgactcgtaccctcaacagctacatggataaagagggttacaacaaaaaatccaaaattaatgccacaggtgatgatgcccgcgaaggcttgattgcggttatttctgtcaaagtccctgatccgaaattctcttcccagactaaagacaagctggtttcttctgaagtgaagactgcggttgaaacccagatgaatgagaagctggtagaatacctgctggaaaacccgaacgatgccaaaacggtcgtcggcaaaatcattgatgccgctcgtgcccgtgaagcagcgcgtaaagcccgtgaaatgacccgccgcaaaggcgcactggatctggcaggtctgccgggcaaactggctgactgtcaggagcgtgatcctgctctgtccgaactctatctggtggaaggtgattctgcgggagggtcagcaaaacaggggcgcaaccgtaaaaatcaggcgattctgcccctgaaaggtaagatcctgaacgttgaaaaagcgcgttttgacaagatgttgtcttcacaggaagtcgcaacgttaatcaccgcactgggctgcggtattggccgtgatgaatacaacccggacaaactgcgttatcacagcattatcatcatgaccgacgccgatgttgatggttcccatatccgtaccctgctgctgacgttcttttaccgccagatgcctgagatcattgaacgtggctatgtctatatcgcccagccacctctgtacaaagtgaaaaaaggcaaacaagagcaatacatcaaagatgacgatgccatggaagcataccagatgtcgattgcactggatggcgcatctctctacaccaatcagtacgcaccagcactgaaaggcgaagcgttggaaaaactggtcactgagttcaatgccagtaacaaaatcattaaacgcatggaacgcctgtatccgcaagctttactgaataatctgatttaccacccgacattgaccgaagatgccttgaacgatcaggcaaaagtggaagaatgggtgagtacgctggctattagtctaaatgataaagagcagaatggcagcacttacagttatcaaatccacgagaaccgtgagcgtcagatttatgagccggttctgtgtatccgtacacatggcgttgataccaactacaatctggatttcgatttcatccacgggggcgaataccgccgcatcaccaagctgggagaattgattggcaacctgattgaagaaggtgcatacattgaacgtggcgaacgccgtcagttagtcagtaattttgaacaggcattagaatggctgactaaagagtcccgccgtggcctttccatccagcgttataaaggtctgggagaaatgaaccctgatcaattgtgggaaaccaccatgaacccagaaacccgccgtatgatgcgtgtaacagtgaaggatgctattgctaccgacctactgtttacgactctgatgggagatgcggttgaacctcgccgtgcatttatcgaagagaatgcactgaaagcggcaaatattgatatctaataaaacaaaatattatacccaatgagtatgaccacattccaatcgggaatgtggtcattaaactcagataggcttcttcctgccaaagttatctccagctattaccatcgcccttcaaaaattatactggacaaaaaagatattccatttacactatagaaatagctatttatacgataaaccattccataaatacataataataagtaataataacccagattactattcacttcatataaactcatcctttacaatctgaaggggtttttatcatgctaaaaataacaaattcttttgatggttatattcataaaacatcaacaagcagtctatcaagatcaaaatccttcaatactcttccacctgataacatattaagtataaatataaacagaaacaatccaagattaattaatgaatttatccctgtggtcagagaaaccaataaagaaaaatgaatgaatgaatgaaattaataatattcataatactattataaaagatagatggttttctcatattgaaaacattaataaccaaaacaagaccatacagaaaatcagagagagaaagtcattatgggatatgagatgccatacaacaaatagaatgcttttgaaaattaaatataaattatctgaacccaatatggaatatgacgaaacatgcacttactttattctttacattgacatagccccccatcggagctatgttatttaaaggctataatagttcaaataaattcaataaattaatttataaaaagagtacagcatgacagtttacaagtgaaggaatttaattatgctaaaacgaaacaactcctttaaggattatatatcaaagattcaatccgaatctttatctcgctcaaaatctttccattcattaccacctgataatattttgaaagcaaacgttaattacaacaatcccagattgattaatggatatattcctacagtcagagaaaccagcctagaagagataattaatgctgttaagcatatttacaaatcaattaaggaagacagatggactagtcatattaaaaatgtgactgaaagaaaaaatgaaatattccaaaaaaatcaaaaaacacgtgaagatgcatgggatatgagatgctgtatgacagataatcttttagaaaaactacagggaattttaaccattttattaaaaaatggttactttaaaactcatgcttattttgtgtgttacattaatacacaaccaatcggagtcatgttattaaaaaagtataactctttatatagcagaggaacagcatactatcctgaggttaattttattatcaatcatccaggcatccagaattgcgcctatttattgatggaaaaagcagtaaatacttcctataaaataggttatcaagggaaattaaaattgacacttgcaacaggtgaactctcttcaaaagtttatcaaaagatggggtttactcatattaaaggggatgagaatatgaaaatggaattaaacccaaatggaaacagtgtctggtatctaagccccagttatggcggttatttttttacagggatccgccgagattaatgatgatacaaattattcaatgcaaactctaaccgccaatttattggttgaattggcggtttattttcacgaacctaataacaattccgttcttgctacaacaaaatacgcaacatccggcgcaacggctcagccgctccccatagaagctgatcacccacggtaaaagcggataggtattccggccccatattcagtttacgcaaacgacccaccggcgtattcaatgtgccagtcaccgcagcgggtgtcagctctcgcattgtcagttcacgatcattcggaatgacacgaacccaatcattatgggaagccaacagcgtctcaatttcatggatcggaatatcttttttcaatttcagggtgaatgcctgactatggcaacgcaatgccccgatgcggacacataagccatcaattggtattacattgctgcccgtgtttaagatcttgttagtttccgcctgacctttccactcttcgcgactctgcccattttccaattgcttatcaatccacgggatcaagcttcccgccagaggtacgccaaattgatctgtcggcaatgcaccactgcgggtaaaatccgtgacacgtttttcaatatccaagattgcggaagccggatcttgcaactcatctgcaacttgattatgcagcattcccatttgcaccagcagttcacgcatatggcgggcaccactaccagaagctgcctgatagcttgataccgatgcccactcgatcagatcattggcaaataatccgcccaatgacatcaacatcaagctaacggtacagttcccgccagcaaaggttttgatgcctttattcaggctgttttgaatatgttgatggttaatcggatcgagaataatggtagcatcatcactcatacgcagggaagatgcggcatcaatccaatatccctgccagccggttgctttcagcttgggataaatttcattggtataatccccgccctgacagctaatgatgatatccaacgcacttagtgccccaatatcaaaagcatcctgtaatacacctgattttcctgcaaattccggggcagaaagcccgtgttgggaagtcgtgaaaaaaaccggatttatttcatcaaaatcccgctcttccaacatccgctgtaccaatactgagccgaccatgccacgccagccgataaaacctacatttttcatcatgcttaccctatcttgaaagatgtttatcagacacactgatatcattaaagctgacaaaatatggcgaaaggtgcaagtaaatttatgtcctacagtactatcatttgagcagcaatgcgtttgccgtttttaaaccatatcgcggtgggttcacaaatgtcagacactcattctccagcaggaattggtactccaagttttggggatcttaaaaaaggtaagggtgttaaaagactacagaaaaaatgtaggtttctgatcaccgtttctttttattcatacctgaactgctttaagacgcggattagttttacaaatgacatatacacggccacggagacgaacaatcttacaatcaggatgtcgttgctttgctgttttcaatgaactcaatacctgcaaaatcctttttatttgttgcccaaaaatgagtggctcagtgtggcgccagttgcttgcccacgggctttaaatccctagggtttatcgggctgctcacactgtgccaaatctaatcatgtttacatggtaatcaattttcaagatacaacggcttacggcggatttagctaaaactacatccatctaagtgctgaatcttctaccggctgtttttccaatacctctttatcctttttataatcatgtgaaacataccaattcgggctgcgcccctgacgaggaagaccttcatcacctcgcctcacataacccgattgtagctcgccaaaaatgttttcgtgtttcaacatttcatccggctgagcataagctgtcacagatttagcacctcgacgatccatctctttcaataatcggcaaacataatctgcggatagatccactttcaatgtccaagaactgctgatatagccaaacagataggcaaaattcggaatatcctgtatcaacgttcccttgtagagcatacgattattgccctgtagtttttgctcatcaatagaaatttcaattccaccaagagggagtaatttcagaccagtagcagaaacgatgatatccgccggcagctccttaccagattgcagtaaaattccattttcagtaaagcgtttaacctggtcggtcacaatagaggatttgccttctttcagtgactttaaaaaattaccattggggatcacacacaaccgttcatcccaaggcatgtactttggtgtaaggtgattcatattaaaacttggcccaacccttttgcgggctgacgacaataaaaacgatttcaacaacgtaggtaaatatcggctggttttataaagtaaacggtgaataaagatattacgatttcggctaaatgagtaaacccagcgttttggcataaatttacttaaaaactcagcgattttatctgttccgggtacagacaaataataactgggggagcgctgtagcatagtgacatgttcggcaatatttgccattgttggaactaacgtggctgctgtcgctccactaccaataacaacaacccgtttccctttatagtctagtccttcaggccaatgctggggatgaataacgggccctttgaaatcctcaataccggggaattcaggtagatacgcttcatcatagttgtaataacccgtcgccgcgaccagataattacaggtaaaggttcgagtttctccactcgcctcctcaacagcggtaatgctccattggttagtcgtgccagaccagtccgcattagtaatttttaacccaaactgaatttttttatcaattccatactcttttgccgttttattgacataatttttaattgactcgccatcggcaaaaacactggtttcagaccaaggccggaatttataaccaaaagtcatcatatctgaatctgaacggatgcccggataacgaaataaatcccaagtccctccgatagcatgacggcgctctaaaataatcacctttttatcgggacattctcttgttaaatgacatgccataccaataccagcaaccccggctcccatgatcaaaacatcatactggttactcataattgtctctcctacaaggttctcttttaataaaataagtctccctcaataaagacatattattttttattcaataggacaaccatttgtatttatgagataggagtatcatggttagagacagggaattattgctaccgatcagacgcatggctaaagcaacctgaatatgaccagtaaaatgagaactgtttttgaaatacattttctctccgagatactgtactaaacttttttaattcaattcattacatcaacagaatcaaaatcaccattaactaacagaacgcggatatagtttttcataatatccatccaacgattcactgctcatcttgcaaagatgcataaaattaggcgttttaataatcaaaatagaacagaataacaatatcaatgacatgccaagcagaatgctgttaacacttagaaactggatactgtaagtagaaaataacattcccaatggaatgggaataatgcacagagataaaaatacagattccatggagtgcctttgtgaagaaggcgttgccgtcatcctgatagatgttgtgtttatgttataaataacaacgccaatacctgcaatcaacatggatatattgatatgaatatttgactgcgatatggatacgccgaaaatacccagtgaaactaaaatagttccagtcaatgatgcataacctttaccgagtatctgattgaaaaattttactaaaacgctactccctaagaacattcccgcaccaaagaaaaactcagctatccccaagtcaaatgcacctagtttcatcgtatcgatgatcaaaaaaggaataaagtaagaaactaatgggacgatgacaaaattaaaaatacccgaaattgcacctaaccttaattctgtagggttgttctttaagatctttaaacttacctttgatgtatccgcttttttttctgatggcatcatagaaacccaaagaaaacctaagaaagagatgacgacactgcaaaatacaatgacgagtatatgcccatatgcaagataactaattaatattccagagatagccgggcctgatacaacgttcagtgaactgaccaaccctctagccctgaaagcaagatcggtgtttgtattatgcaatattcggctgatgatactgtttccaatcggttgggtcagtatagagaacagagatgtgatgataaaaaatattccccagtaaaagtagtttttactttcaataaagtacaggctggagataataagtaagcttaaaatacagaatgaaatcaaatagaatttagttgaaaacttgtcaccatataaaccgaaagcaagcaaagtaagcacctgcaatgcccacgatataaaaagaaaatagcctaactcaacgactaatccgagttgattaagcataacccatgtaaacaacattcctattgttttaatggagatagtgaataaaacatcactgacttggtatataacaaaattagtgacactatattttttcatcaaactcattatcaaattttccctttacttcattgaagcctgttactgcatttatgattttaattaatcctaaaaagtagaatttttaatcaaaatccttccagtaaaataaacatttactaagtttaacaaactaaaaaaatattagataaaaaatgataaaataatgagttataaaatttaaaacacaaatatcttttaaagacataacagcagatagataattatgctatcatagatggatttaattataaagataaatattttattttcatattatgatgtaaattaggtaaagtacaaaaatacataaaataaaaataactgcaaaagaaataactactaccaatatatctgtaaaaataataaataacgtaacaaataaaactaaaattaccattgcactaacaataatccagaaagactcttcgggacactctaaaaataaatcttttaaccagccgtaattaaactttttttatttttattcgaaaccatttatttactccaaattaatataattaactaaattaataatattaattgcattaattattttactaataaggataacatcttttaataggataatacaaggcggattaatatttatagcatcggcaattaatttacttgttagcctcagttttaaagatgattcttctaagaatatgagtattcataaaagaaattctcttgtaatgctgatgagtaattaaccacatttttactgttgcaaggggaagatgatttaaatattacctgaatattttggccactataaagcgctatacacagcacattgagcatcacaatcttaatcggagatatctagtaaggctacacagggagtcacccactcatcattagacagtggcaaaatacttaataaccttttcctttctctccaatcaggtaaatagccgtccatataagtcataaatcgctcattatgtttgcgctctaaaagatgcactagttcatgaaccaaaataaattccagacactccagtggtttttttgccaattctaagtttagccagatactgccagaaacagtattacagctaccccatttggttttcatttttttgatgccccatgacgaaggcatcacaccaataatgggttgccagtgcattaacagcttttctattcgttcttttaaagctgctcgataataatctgaaagtacctgtgcttttttctcaaatggagcaccataaggaacataaagataaatcttttctccactggtcttaacttgttgcttaccgacatgctcaacaatatttaaacgatgccgccttccccaaaggtagtggcattcgccattaaccatctcacgttctgactggcgtggctggcgtgcgaaatcctgctgctgttttttaatccaggggatgcggctgatcaccgccattcgaatggcggtatcactcatatgcatcggtgctgatatccgtacaagtccatcaggaggcaatacgctgatatgcaggttctttatcgctttgcgattgagctgcatatctattttgccaatcgtcaactgtgccatcagcggtagtctctctgcgctttagcaagttccattatcttatcaatatccactttatattcggcagtttcgtcacgaagtgcattcgcgatttcacgttctttaaatctgtcatttacccaatctgcttttttcgtatcacgtattgttttgtcaatgcagattgccagatccgtattctgatcgaaattatcataaaacgcccgtttaggaggggtatcaatatcaggtggataagcggcagtgttctgattcgggcgaacaacttttttagcgagatcacggattttttccagatactcctgatagtttagtgcattttgacgacgtaaagcgatcaactcatccagcaaaacagacatatgttcgtaatatctcgggttaacagggttctcatcaacaatcgttttacgtacgttattttctattgtttctgccatcgcctcgggatctttacgtattccctcaggtaaatcctctcccactgccgcacctttctgaataataagttccaaaagaccaatttcttcaaaatctatgagaacttcactgtcgtccgcccggatatacatatctataagactacgcatcgccggttcgtaacgtttcatttcaaccttatctttgctggcgagtttaatctcgtcacgtactttttcataatgagcgacttctgcacggattttctccatctgtgcaggagaatatccagcaatggtcatttcattggcaatatttgcgaaagcacgcaacagctttgctacacactgatatagtgccaaacgtaacgcttctttttcagacagcaattcaggatcagctcccgattcacagcaaaaatagtgaatataatctatcgtgttacgtggagctttaacgggttcacataacgctctaaccatctccaatgccgcatccagatttaatctggcttgttccagacgatttttcaacagcccatcgatatccttcttgtcgtatccgtcaaatacctctttggtataatcggatatcgctttattcagggaacggaacaaatctttataatcaataatatagccatattctttgtcatctccatccagacggttaactcggcaaatggcctggaataaattatggtcagacatgtgtttatcaatataaagataagtcgcggaaggcgcatcaaaacctgtcagcaatttatctaccacgataagtaaacgcatttgtcctggctcatcaataaattgctgttttactttcgtttcaaactcttcaacccggttagcaactttatcttctggttgttcaaaataatcagccagcattttacgataagttttatatttagctagctgctctgtcaggccttctcccgtttcttctcctttaatacttgcagagtctggcttatagctggtgataattgctactttcccagcaagatctgtttggctgaacaaatcgtaaacggtacaagcttgatgaatgctggagcaaaccaacatggcatttcctcgtccatccatcaggcgtggacgtttcatcatatccagcctgatgtccataacgatcatttccaaacgagatttactggaaagaaccttctgcattgttccccatttctgcttcaactgggttttgcccaaacgggacaacccttgtgtattagcttcaaaccattcatcgattcttttttgcgaagtcagatactgatcaatatcacgggcttcataacgcaaatccagtattacaccatcagaaacagcttcatcgaacttatatgtatgaataaaactaccaaatacttcaatggattttttcttgtcttttttcattaaaggtgtaccggtaaaaccaataaacacggcttccgctaatatagatttcatcgcatcatgcaatttaccggattgagtccggtgacattcatcaacaaatacaaacagatcacctttcgctctgaaatcactcggcaatgattttttgagttctttgatgtattcatccgttgctgcatcgtcttctgcttcagaccgatgaccaaatttatgtactaaagaacaaatcagccacggatttggccgattaagattgaaaatcagatctgcaccacttttagtgcgataaatattttcttctaccccagtaaaaactttttcgatctgtgcatccaattcagtgcggtcggtgacaatcaacacgcggctatttggcacattttcccgtatccattttgccagccaaaccatagtcaggctttttcctgaaccttgtgtatgccaaataatgccaccttcgcgttggagaatacgtttttttgcagcctcaacaccaaagaattgattatgacgacaagctttcttaacacctgcatcaaacacaataaaatcgtgaattaattgtagaaaacgtggtttgctgcaaattcggctgaggtgaaaatccaaacgataggggtaagggttatcaatcctttctttccattccagataatatttttcaggtgtaccaatagtaccgtagctcaatccttgtgtgtcattccctgccatcaccagttgcatggtgctgaaaaagtcacggatgaactcttttttctggttatccagattctgacgaataccttctgaaacggagacacttgaacgcttcagttcgataattcccaaagcaatgccatttacatacaggacgatatccggacgttttttattttctcctttaatggagacttcttcagcaatggcaaaatcattggcttctgggttgtgccagtcaatcaaccaaatagtctgatgctgctcacccacatcttctttttctttaatgccataacgcaacaaattatagacatttttgttggcatgatagagcttattcccatcgcccagcgcggcggtattaatcaactgacgcaacacacggccaatcaatgtgccactgattccccgcttttttaaccatgcagtcagtatatctacgtcaatattcttattgtctctgtcctgtaaatttcccagatagcggtaacctaattccgtctggaaaaatttgacaatgcgatcttgagttacgcgttcgcgctggcctacggtgctcattcctttcttaccttaacgttggttattccgattcagttaattttcttatatcagacgagttttaccagtgagtagctcttgcatcataccttgtttaatttgacgagtttttcccagtctctgtttaagtgcttgaatttctgtatccatatccaagaggattgtggcgatggtggtttgttcttcaatatttggagctatgaagttaaagttaacaaaatctttttggtataagtgcgtaattgtcgaaccagcggtaatacctttcataaattcattaaatatctttgatgtaagaatataaaacagatacctaggatggaaggcattatttttaggtcgtataacaaatactccactatttaatgttgaaggaagcctaagaaactctacgtaacccacctttcctattgttccatctttcgtaataagaacatcatcttcttttaattgtatgtttgagtcttgtttataacgccattcactaacataccagcaatcttcccatttaactgtgcctgcatcaaaattcgttccagtaaccagataatactcaccagtctctaaatactctttagttgttaacgcttgccaccctatgcgtgcttttagtacagcatctttaccaatagaaattggattccaatcctctggtatttcccttaattcgcttcgcttgtatccttttttcgaaccatcttcacgaaaagcaaactgcggcaggcgagtacggcctgttagtaactgttgcatggttgcaattttgatggcttgttttttggctagcagtttttccagctcactgattaggccatcgacatcagataagatgttggcaatagtagtttgttcttcataacaaaaaggtaaagcaactaaaaactctcttacgccttcagtcgttaaatttgtaaatacgcccccatgtgtagctgaattattaaatttctcacgctgagtcgaaaaaaagtgataaagataatcgatagatatattttttgatacttttgttagagctaagaaaccatcgtgtatacatgcatcaatagctaatattgaaggtataccgacattacctgaacacactaatgtcagagttccccttagacatggcctacttaatttagcaccggcttcggtaagcgaatcgacgataggagtaacaaactttccatctcgtgtaacatcttcaaccataagacgaggaatctttccatcgtaatagcgtttgtcaccttttggtcttgggctggctcctcttataacattagcaagttcaccaatgcttttaaccacccaagcctcaggtatcactccagcttccgtttgcttatatccaataggcaaagtattccctaccgattcagccaaatatttagaattgccctctgctatctgattcattgttataatacccattccaaacccatagccttcagattatctgccactttgctactcaaactatccaccgatttactaattgttggcagcgattcggcatagcgttcttccaattctctgacacggtttgtcaattgttgagttacacgctcaatctcagcctgaatattagcttccaatgttgctagccatttcttatccaccaccaacgttttgatctcatcatcagtaagttttgagtattgcttaagtaccgataaatccagcgcttcctgatattttttcagctcttttttagcgtctatttcagcgtcaaatagctcttttgcctgtttcagtactgttttttcttcattgtcggttgccagtttcaggcgagcagtaatacttgctttggtcactttatctttgtcattcagggcatcattcagcaggccatcatcgccgctgttttcttcgatatagttttctagcgcttgtgttgcattatccgcatcaatttgtaattgatcgatttttacctgctgccctgcaaagtaattctggataatcaatgccggaggaataatttcagctttatacttagttttcttgatcacaaaatccggtgtttctttcagtttttcagcttgttttactaccagctcacgtacctttttacccgctgcccaatcatcttgtaccagcacataaacatcatcctgcatcgtctctgcccaataatccatcaggatctggtaaacatcgtacttactcagtagaggcactgactcatagttaatcaataaatatccactaatgtcattaagtaactcttttggattatcgctacgatgaatttcttttagtgcagcggattgacaccatgcggcaaacggttttaggctttgttccgcaaaagttttaaattcagtatggttgagaatagtatctttgacctgattggcttccaccaagctgtggctgtatccttcgcgctccgttgcaaataatgtagagcgaatgccggggaaaacattccagtatttatccagcacatcaatatcacggttaggaatccccccttgcagatgagcgctgagatcgtgcaaatcttccggttcactactgtcgatataacgagggatattgaggttgtagtcgttcgctacaatctctttgaattcaactgttcggctaaaacgtggcaatgttttctgttgagtaaaaacttcaacgattttatagatatcctgactacgcaagcggtttttattaccgtcttttataaaatcacggcttgcgtcaatcataaaaatatcacgcccacgggttactttcccttctgcatcaaaatcagcagaaatggcatcctgcttatctagcacaataatacaggccggaatacctgtgccataaaacaggtttgccggaagaccaataatacctctaatgtaaccctgctttatcaggttttcacgaatcagggattcagcattaccacgaaacaatacaccgtgaggcaagattacagcccctttacctgtacttttcaggctcttgaggatgtgcaataaaaaggcataatcaccgtttttctctggtggaattccccaaccaaaacgaccaaattcatcttctctcgggttaataccactggtccagtttttattagaaaaaggaggatttgctacggcgaaatcaaaagttttaagctgtcctttatcatctttaaatacaggagaggcaatggtgttaccctgctgaatactatgaacatcagattcatgaccatgcagaatcatattcatttttgccagtgatgaagtagtcacatccatctcctgaccaaagatacttaacccacgcggtgcttcatcactcgctttaagaagcagagaaccggaaccacaggtcgggtcgtatacagaagcatcacgcggagttttatcgtttattcctataatctttgccagaactaacgaaacttccgcaggagtataaaactgtccttttgatttgccagattcagttgcgaagtggcgcatcagatattcgtaggcatcacccatcaaatcatcgccaccagcataattattggagagatccaacccttcaaaaataccgactaatttggaaaggcggtcaatcatctctttgcctttaccaagcttttcttcatcgttaaagttggcaacatcaaacatggttcccaacccgttttcatcagctaatttgcggataatcttattgatttcatcgccaatgtcttttttgcccttcagggcaaccatatcatcaaaaccagcaccttcaggaataacaataatgccgtaacgatcattcttgtacttatcggacacatacttcataaacagcatggtcagcacgtagtctttgtactggctggcatccataccgccacgcagctcatcgcagctagcccacaatgaggaatagagttcgttctttttgattgccatgaggaggtctttacttcttctgtcaggttaatgattgtataacacaataattataatcggttgtgtaatgtactttgagatattattcactgatgtttaaaatgacactgtctaactacggtttcatctactccttccacaacgcattcatcggcaccgcatacgtatttggtacttggcttatcggtaagcagttattccctgtataaagcattattccgccttgccaatcatcgccagatagtgaggccaacttagctaaaccagccccgtctttaggttgaatgctggcggcttttttcacttcaacaccccaaacttttttcccatcttcaatcaccaaatcaacttcaacttggtctttatctctgtagtgagaaaaaaatagttcatgttcgatccaacccgattggcaaatcagttgctgcaccacgaaactttctaatactgcgccgaaatcactactaaaatcataccaatcattggtacgtaatttagtcaaaacacacgctaaaccggaatcgattatgtggatcttcggtgttttcaacaatctcttagcatggtttttatgccacgcaggtaaacgacggactaaaaataaacgctccaatatagtgatgtatttatcaacagtgtctctctggagtcctaaatctttcgataacccactaatattcagtaagttccctgtacgaagcgcgagaattttgataagacgaagcagttcttcttcgtcgcggattgctgcaatatctttgacatctcgttgaataatggcattaagatactgtttatgccactgacgagctctcgcctctgttcgggtgttgggttctgggtaaccaccttgtactacagcatccgctattccctctagttgagcttgttctcccttaatggatggtgaaatacgattggatagcaatttttcaagtagcgtcacagatgaatactgtttttcttgttcagacaagggttgtagataagtcacttcaacacgtccagccaatgactcctgaactcccggcagtaataacaagttggcagagcctgtaagaatgaaacgccctgatgttctattagtatcaactactgcttttaatgcaggcaaaatttccggtactctctgtacttcatcaagtgtcactcgctcaggtaatccttgaacaaaccctaagggatcgctttttgcagcattcaatagcgtactatcatcaaaagtaatatacgctctccccgactctaactcttttaccagtgtggtttttcctacctgacgaggccccaataaacacaccactggtgtatctgttaacgcctctttaagcttgggagctataagcctaggatatcgtttgttattcaatgtgattatacccattaactattatattaaggatgatggcaaccgactatttgctggttattgtagcgactatttgatggttttgcatccgtctgtttgtatttttaatatccgactaattgctgttttaaaatgcaataattattaaaaaatatcatattagaatttgattaatatatatatttttttacaaattatatcattcaaaaattaaacaaaattatacatccatcctataaatcttcacaaaaaaccataaaaaaatccggtcagcgtttgcataaccggatttaagagacgttttcagttttaatgtacgcagccactaacagcgtactatatcggcattactccaccgtcaccgatttcgccaagttacgtggctgatcaacatcagttcccttgatcaaggcaacgtggtaagacaacaattgcagtggaacggtatagaagatcggcgcgatcagatcttccacgtgtggcagggagatgatcttcatgttttcgctgttggtaaaacctgcatcctgatcagcgaacacatatagctggccgccacgggcgcggacttcttcgatgttagatttcagtttttccagcagttcattgtttggtgcaacaatgatcactggcatatccgcatcgatcaatgccaacgggccatgtttcaattcaccggcagcataggcttccgcgtgaatgtaagagatctctttcagtttcagtgcgccttcaaccgcgatcgggtattgatcgccacgtccaaggaacagggcatgatgtttctcagagaaatcttctgccagtgcttcaatgactttgtctttcgacaacatgctttcaatgcggcttggcaatgcttgcagtgcgtggacaacatcttgttctaatgctgcgtcagcacctttcaggcgccccatgtaagccaccagcatcaataatacggtcagctgggtggtaaatgctttggtagatgcaacgccgatttctgctcctgctttggtcatcagggcaaagtctgattcacgtaccagagaggaaccggcaacgttacagatgaccagcgaagtcagatagcccagttctttggataaacgcagtgcagccaaagtatcagccgtttcaccagactgagacaaggtgatcagcaaacttcccttacgacgtgctggcttgcggtaacggaattcagaggcgatttccacatcacagggaatacctgccaaagattcaaaccagtagcgtgaaaccatgcccgcattgtaagacgtaccgcaggcaacgatttgaatgtgttcaacctgagacagtaattcttcagcattggcacccagttctgacagatctacctgaccatgacttaaacgcccttccagcgtgctcttaattgccatcggttgttcgtagatctctttttgcatgtagtgacggtaaatacctttgtcacctgcatcatactgaacgttggattcaatctgctcacgctcaacggctgcacctgtgacatcaaagatgcgaacggtacgacgggtgatttcaacgatgtcaccctcttccagatagataaagcggcgagtcaccggtaatagcgccagttgatcagatgcgaggaagttttcaccaacgccaaggccaatcaccagcgggctgcctgaacgagcggccaccagcacgtcaggatgacggctgtccataattacggtgccataagcgccacgcaattgtgggatcacacgctgaaccacttccaacaacgaaccaccctgtttctgttcccagtgaacaagatgggcgatggtttcggtatctgtatcagaaaagaaggtataaccgcgctcttttaataattcacgcagttcttcatagttttcaataatgccgttatgtacaaccgcaatatgttcagaaacatgaggatgggcattgagctcattcggctcaccatgcgtcgcccaacgagtatgagcgatccccgtaccaccagtgacaggctgtttacctgcttcatcagccagcatctgtactttgccgacttcacgcagacgggtcataccgttttcactgtcaaccacagccaaaccggctgagtcataaccacggtattccaggcgacgaagaccttcgatcagtatttctgcaatatcacgttgtgctactgcaccaacaattccacacatgtgttttattcctaaaaacagggctaataaaagccccttttatgtcgccaacctgattgtgttccggctttgccggtccccgagctttgtagaagtggggattatttttatgaatatctattttttattttttcttaacaggacgttgccagccctgaatatgagtttgtttcacgcggctgatgaccagttcattttcagctacgtcttttgttactgtggtgcctgcgccaatggtcacacctttagctactgtgactggtgcaacaagctgggtatcggaacccacaaacacatcatcaccgatgatggttttaaatttattggcaccatcgtaattacaagtgatcgttcccgcaccaatattcacattattgccgatttcagaatcgcccagatacgtcaggtgacccgccttggaacctttaccaagggaggtttttttcatttccacaaaattgccaacgtgtgctttttccgccagtttagaccccggacgtaaacgagcaaaaggcccaaccgtacattcggcagcaatttcagaatcttcgatcacagtataagggctgatgacagtgccatcaccgatggcgcaatttttcaaaatgcagcccgatccaatatgtacgttatttcccaatgcaacatgaccttcgataatgacattggtatcgataaccacatcacggccatgttctaatgtaccgcgaagatcgaaccgtgcaggatccagtagcattacacctgccagcaataatttttctgcttgctctgattggtaaatacgttccagtgcggaaagctgaaggcgattgttaaccccttccatctcacttaaacggctcgggtgaacggctttgatttgacgcccttctttgtgggccagagcaataatatcggtaatgtagtattcaccctgagcattgttgttatccagctgggataaccaacgtttcaaatcaccgccatttgccaccaaaatacccgtgttgatttcgttgattttacgctgctcgtcagttgcatctttctgttcgataatcccggccacttcgccattttcacgaatgatacggccatatccggcaggattattcaaaatagcagtcaataagccaataccgccttcaggtttgatttccaccagacgctctaatgtgtcttgagcgatcaaaggaacatcaccatagagcatcagaatgtcttcatcatctgcaaaatatggcgctgcctgctgcattgcatgaccagttccaagctgttccgcctgtagtacccaattaaggttttgattggagagagtctgcttcatcagatcaccaccatgcccatagaccagatgaacattttgggtacccaacgccattgcggtgtcaataacatgctgaaccatcggtttaccggccagcgagtgcagaaccttggggagagcagaatacatgcgcgtgcctttgccagcggcaaggatcacaacactttttgcgctatttgcactaatagacataataaacctgacagctccaattttaagtatgaaagtaaacctgtttgcaaaataaattgctacatatttcgcaatgcaaaaaagccagttagctttcaccaactggctttttatcttactgcctatattacatccgttgttttgtcagttcgattacacgaagttttgcaatcgctttcgacaattcagcagatgcctgagcataatcaacatcgccgtgagaattacggacgtgttcttcagcctcacgcttcgcttcaagcgccttggcttcgtccaaatccttaccacggatcgctgtatcggccagtacgataacgccgtttggctgaacttcaagaactccaccggacaggtagataaattcttcttcaccaaactgcttaacaatacgtatcatgcccggttttatggcagtaagcagtggtgtgtgctgaggataaatacccagctcaccttcactgccagtcacctgaattttttgtaccagcccttcaaacaatcgtttttcagcgctgactacgttcaggaagaacgtcattgcagccatatcaacctcccgtcagccgtattacatcttcttcgctttttctacagcttcgtcgatggtaccaaccatgtagaacgcctgttctggcaggtggtcataatcaccctccaggatgcccttaaagccacgaatggtttctttcagagagacgaacttacctggtgagccagtgaagacttctgcaacgaagaatggctgagacaagaagcgctggatcttacgggcacgtgccacaaccagtttatcttcttcagacagttcatccatacccagaatcgcgatgatgtctttcagttcctgataacgctgcaggatagactgtacaccacgcgccacatcatagtgctcctgaccaacaaccagtgggtcaagctgacgactggttgaatccagtgggtcaaccgccgggtaaatacccagtgaagcaatctgacggctcaatacgacggttgcatccaagtgagcaaaggtggtcgctggtgatgggtcagtcaagtcatctgcagggacgtaaaccgcctgtacggaagtgatggagcccgttttggttgaagtgatacgttcctgaagaacgcccatctcttccgccagtgtcggctgataacctaccgcagatggcatacgacccaacagtgcagatacttctgttcctgccagggtataacggtaaatgttatcgacgaacaacagaacgtcacggccttcatcacggaatttctcagccatagtcagacccgtcagtgctacacgcagacggtttcctggtggctcgttcatctgaccatataccagagatactttatccagtacgtttgaatcggtcatttcatgatagaagtcgttaccttcacgggtacgttcacccacaccggcaaatacagagtaaccggagtgttcgatagcgatgttacggatcagttccatcatgttaacggttttacctacacccgcaccaccgaacagaccaactttaccacccttagcaaatgggcagatcaagtccataaccttgataccggtttccagcagttcctgagagctggacaattcttcatagcttggtgctgtacggtgaatcgaccagcgctcttcttcgccaatctcacctttcatgtcgattggatcacccaatacgttcatgatacggcccagtgtcgctttacccaccggaacttcaattgggtgccctaaatcaatcgcgtccaaaccacggcgcagaccatcagaggtacccattgcgatacagcgaacgataccaccgcccagctgctgctgaacttccagcaccagtttttcttcactgtttttaacctcaagagcattgtatacctttggtacgctgtcctgagggaattcgacgtccaccacggcgccgattacctggataatctttccagtagccatcttgaatcctctacgtaattcgtaaacctagctgttaaaccgcagaagcacccgaaacgatttcggtgagttcctgagtgatgctggcctgacgagccttgttgtaaaccaactgcaactctttgatcaggttgccaccgttatcggtcgcggctttcatcgctaccattcgtgcggcctgttcactagccaggttttcaacgacgccctgataaacttgtgattctatatagcggcgcagcagggtatccaacaacgccttaggatcaggttcatacagataatcccaggacttcttcttcaatgtttcatcgtctccggctggcagaggcaataactgagtaattgtcggaacctgagacattgtattgatgaaccggtttgtcactatatacaatttatccagacgccctgcgtcatatgcttgcatcatgacgttgactggcccgatcagctcggacaatgatgggttatctcccatccctgttacttgggcaacaatgttgcctccaacagaagaaaagaaagaaaccgctttcgacccaacaagtgctaaatcaacttgaacgcctttatcagaccagtctttcatttctatcagcaattttttgaacaagttaatgttcaaaccgccacataaaccacgatctgtcgaaacaaccaagtacccaacacgcttaacttcgcgctcgtcaaggtatggatgtctgtattccagattacctaacgcaaggtgtccaatcacactgcgaatggtttctgcataaggacgactggccgccatgcgatcctgcgttttacgcattttggacgcggcgaccatctccatcgctttagtgattttttgcgtgttctgcacactggcgattttggtacgtatctcttttgcgccggccatatctgcttctccgaattcaaccagacggcccaagtttaatcaaactgggccgaatagtgttaccaggactgagtcgccttgaaggaatccaacagagctgtcagcttcgcttcgatctctccgttgtagtcaccagactggtcaatctctttgagaagatcagaatgttcacggttagcataagctaacagcgcagattcgaaactgaccactttcgcgatttcgacatcttccagatagccacgttcagctgcaaacagagacagagcctgctgtgcaacggacattggctgatactgtttctgtttcaacagctcagtgactttctgaccatgatccaactgcttgcgagttgcatcatccagatcagaagcaaactgtgagaatgcagctaattcacggtactgagccagagctgtacggataccaccagacagtttcttgattatcttagtctgagcagcaccacctacacgggatacggagatccctgggttaaccgccggacggatacctgcgttgaacagagcagattcaaggaagatctgaccatcggtaatggagataacgtttgttggtacgaacgcagaaacgtcaccagcctgagtttcaatgattggtaatgcagtcagagaacccgttttacctttcacttcgccgttggtgaatttttccacataatcagcgttaacacgcgctgcacgctccagcagacgggagtgcagatagaaaacgtcaccagggaatgcttcacgtccaggtggacgacgcagcaacagagaaacctgacggtaagcaacagcctgtttagacaggtcatcgtaaacaatcagagcatcttcgccgcgatcacggaagtattcacccatcgcacagccagaataaggtgccagatattgcagggccgcagattcagaagcggatgcaacaacgacaatcgtattagccagagcgttgtgctcttccagtttacgaactacgttggaaatggtagatgctttctgaccaattgcaacatagatacatttgataccagaatcacgttggttgatgatcgcatcaatagccagagcggttttacccgtctgacggtcaccgataaccagctcacgctgaccacggccaattgggatcatggcatcaacggatttgtaacctgtctggacaggctggtcaacggattgacggtcgataacccccggagcaataacttcaacaggagagaaaccatcattctcaagagcgcctttgccatcgattggctcacccagtgtgttaacaacacgaccgagcagaccacgaccaacaggtacttccagaatgcggccagtacatttgactttcatgccttcggccaggtcagcatacggacccatcacaaccgcacccacagagtcgcgctccaggttcagtgcaattgcgtaacggttgccaggcagagaaatcatttcaccctgcatgacatcggctaaaccgtggatacgaatgataccgtcgttaacggaaacaatcgtaccttcgttgtgagcttcgctcacgacattgaactgagcaatacgctgtttgatcagttcgctgatttcggtggaattcagttgcatatgctccagtccccttaagactgcaagacgtctgttaaacgatccagacggccgcgaatgctgccatcgatcaccatatcacctgcgcggataaccacaccggcgataacagacttgtcaattttgcaattcagcttcactttgcgtgacagacgtttttccatcgccgcagaaattttagcctgctgctgctcattcaattcagacgcagaaatcacttcaacattgatggttgattcaagtgacgcacgcaattgggtaaattgctggaagacttctggcagtaccagcaagcgaccattttctgccattacacgaataaagttctgagcatgctcatctacctgctcaccacaaagggtgatgaaggtattggctaacgtttccggtgccaatgaaccggaaagcagctcaccaacctgctcattgcgagtaacctcagcaacgaacgccagcatgttctgccaatgttcgagagattggtgctctacagcaaagtcaaaagctgctttggcgtaggggcgagctaccgtagcaaattcagacatgcccctccctccttacagttcagcgaccagtttatcaacgatgtcgctgttagcagcttcatccacggaacgttcgatgattttctcggcacctgcgatagccagcatcgcaacctgtttacgtaactcttcacgagcgcgtttgcgttcagcgtcaatttcagcctgggcctgcgctacaatcttgttacgttccagctcagcttctgttttggcatcatcaataatctgggctttttgtttattagcctgctcaatgatagcttgcgcatcagctttcgcttttttcagttggtcggtcgcattggcttgcgctaagtccaggttctttttagcacgttctgctgaagccaaaccgtcagtaatttctttctgacgcttttcaatggccgccataattggtggccatacatacttcatgcagaacaaaacaaacaggacaaacgcgatggcctggccgaggattgttgcgttaatattcaaagcacaatacctctatttcaattaatgaattggcttaatcttaagttctgctacttactgaccgccgacagcgaacatcataaataagcccaggcccacagcgatcatagggatggcgtcaaccagacccataacgataaagaactgtgtacgcagcagaggaatcagatcaggctgacgagcagcgccttccaaaaatttacctccgaggatgccgataccgatcgcagcaccaatagcagccagacccatcagaatagcggcagccatgtacagcagatccatattcaggttttccatgacagtctccagtttgtttcagttaaaacacgattattgattgatagaaattaatgttcttcagatgccatcgatagataaacaaccgtcagaaccatgaagataaaggcttgtaacgtgataatcagtatgtggaaaatcgcccatggcaggctgagtaaccactgtgaccaaaacggtaaaagagccgtaataagaataaagatcaattcgccagcatacatattaccaaacagtcgcagagcgagtgatataggtttagatagtaagctgaccccttccagaattaagttaattggaataaacagtgggtgattgaaaggctgtaatgtcagctccttcgcaaaaccacgaattcctttcatcttaatgctatagaacaggatgagaacaaagacaccgagcgccatcgacagagtgacactgacatctgctgttggaacaatacgcagagcaggcaggccgaaatagcgttcaccgatcaaaggaattaaatcgattggcagcaagtccaatgcgttcattaataacacccagacgaacacagtcaaagccaggggagctatcactttgctcttaccgtgatacatatcacgaacagtgttatcaacgaaaccgaaaaccatttctaccgcagtctggagcttacccggtacgccatcggtagcgcgaaccgcaactctccggaatacaaacagaaacaatattcctaatatgacggagaaaaaaagcgagtcaatgttcaacgtccagaacgtcgtctcataaccactagcgtggggattgaccaactcaaaggtacgcaagtctaactgaaggtgcttcaggtgatgacttatgtactcctgcgaagttaaaacttctcctgatgcagacatgatgctttttacccttttattgttaaaaatgctaaccgttcattacggcaggtgcgatgatctgcacaatcagcaccgctaaataggctacaccaagtggtgcaaatgccgccttaaacactcccaaggcaactatcagcacagctatcgtaatgacaactttagccacttcgccaatagcgaagaaccatgcaatgcgtactggtacatcttcttcttttgctttttggaagcgagttagcagcataaaaatggcatttggcagccagcacgccagcccaccggcaaaagcagaagcgccccattcgatacttctggtacaaaaagccacactgagaataataaaagtcattaactgcaaaagtaacagtttcagtgcaattctaccgctgtaaagggatacagacatgacttttgttttctcccgaagtacaccatcacatatcaggctttgctgaatgctgtataaaactgtctttgtttaagagtgtcaagtgacaaaaacgtgcaaattatacgggcagccaaaatgaattcaatccataagtagcgaaaaagtgaataattatttaaatttctaactttgatggtagattgctcacaaataccatttaatattctgcaacgatcaatggtatgactgaaaaattaaacgtgatgtatatcacatttaaccagaatcattagttatatttatcattaaatctgtgataaaaatcatttatttttttcaattaaaatcaactaattaatattacagtcataaagatttatctaatatatcaccaaaaaatgttaaatgtttattttgttatctttctctaaaatttatttataaaggaaattgataacctttttcaaaaagaaagtttataccaaaataaaatgaaggttatttttatgtgatctggcagtaaataaagttaaaacagccaaaagtaataattagtaacgtcagtaacattataaatgtggttaacgtcactaattatttaggtttttattgacaaacagcaaagttagtttgacttaagtacgaccaaatgacgctccccacccaactcaggaacctgcagagaaaccaccgtatcaagcgttactcctgaaggcagttgggtcaactcattttccggcagcacgcctttcagggcataaaagcggccttctgctggtttaggaagatgacgacaccatgacagcatgtcttgcagcgaagcgaatgcacggctgatcaccccatcaaaagggggttcagggataaattcttcaacccgactctgcacaggatcaatgtttttcaaacccaattcatgctgaacttgacgtaagaagcgaactcgttttcctaaactgtccagcagagtgaaatgagaatctggccgtacaattgccaacgggatgcccggcaaaccaggccctgttcccacatcaataaatcgcgttccgtgaagaaaaggattaacgactatgctgtccatgatatgccgaaccagcatttgttcgggatcacgaacagatgtcaggttataagccttgttccatttgttaagcatatcaacgtaagcgataagctgttgtttttgttctagcgataacacaatgtctgttttcaccagcagcgattccagtttgttaagcaaaacttcgtcctcttaggcgctacgacgtaataaaccttgttttttcaaccataccagcaaaatggaaatggctgctggagtaataccagaaatacgcgaggcctgaccaattgaacttggtttatggtcattcagttttgcaataacttcattggaaagtccgttgacttgtttgtaatccagatcgagtggcaaggcggcattttcattacgtaattgtttttcgatctcttcttgctgacgggcgatatagccttcgtacttcacttgaatttcaacttgatctgctgcttgaggttctgtcagccccggagtaaaacgtggcagtgatgtcagcagttcataattcatttcagggcgacgcagtaaatcctcaccattggcttcttttgacagtggtgctttcagcatttggttgatttcatccaagctatcggaatgcgggtgtacccagatatttcgtaagcgctggcgttcctgttcaatcatctcaactttgcggcaatagtgctcccaacgttgatcatcaaccaagcccaattcccggcctttttctgttaaacggagatcagcattgtcttcacgtaacatcaagcgatattctgcgcgcgacgtaaacatgcggtaaggctcttttgtacccaatgtgcataagtcatcaaccaatacgccgatataggcttgatcacggcgagggaaccagccgttttcatctgcggcataacgtgcggcatttaaacctgccagcaatccttgtgctgctgcttcttcgtatcctgtagtgccgttgatttgaccagcaaagaacagaccattgataaatttgctttccagtgtctgttttaaatcacgtggatcaaaaaagtcgtattcgatcgcataaccaggacgaacgatacgggcgttttccatacccttcatggagtgaacgatctgcatctgcacgtcaaatggcaggctggttgaaataccgttcggatagatttcgttactggtgaggccttctggttcaaggaagatttgatgagcgttgcgatccgcaaaacgcatgactttgtcttcgatggaagggcagtaacgtggtccgatcccttcgatgatccccgcatacatcgggctacgatccaaattattacggatcacttcatgggttttttcattggtatgtgtgatatagcaagggatctgtcgtgggtgttgatctacgttgcccatgaatgagaatacgggtgtcgggttatcacccaactgttgctcaagctggctgaaatcaatggttcgtgcatcaatgcggggaggtgttcccgttttcaggcgagctactcgtaaaggcaattcacgcaggcgatgggataatgcgatcgcaggaggatctccggcacgtccaccactgtagttttccagcccaatgtgaatttttccatcaagaaaggtgccaacagttagtacaactgattttgctttaaattttaaccccatacgtgtaacaacgcctgttatggtgttgttttcaacgatgagatcttcaaccgactgttggaagatcatcaaattagattggttttccaatgcggttcttacagcctgtcggtacagtactcgatctgcctgtgctcgtgttgcccgaactgctggacctttgctggcattcagtgttctgaattgaataccggcctgatcggttgcttgagccattaggccaccaagtgcatcgatctcttttaccagatgccctttaccgattccaccaatggctggattacatgacatctggcccaaagtatcaatattgtgagtcagtaataaggtttgacgtcccatacgtgcggcagccattgctgcttcggtaccggcgtgaccaccgccgataatgatgacgtcaaagtgttctggataaaacatgtgcgaaccttcagttgtgagaatgcttgatctgcattagggagaggattctactcaagtttggacattagaccaaataagtttgatcgttgctaattaaaagaagatctttttatttaaagatctttttattagatctgttattaggatcgcgatcatctgtggataagtgatttttccatagaaagatcatgatgctgtaaaggatcatttactgtgaatgatccgtgatccaagtcagtataagctgggatctaaatcagtagttatacacagaagctaaattgaaactcggttattaaatggataactacgggttaacccctgcttttcagataagttatccacaattgatcgttatatttttaatcggatcagagtaactttgcccattctttaacccaatcttcagcgggatcctcggggatttcatacttctggatgtctatttccaatcgatccccgatcctttttgctccgcgatctttcaataggtgctcaaatgatttgattgcaccacagaatatgtcatattctgaactgccaataccgaccgctccaaatgtcacgttacttagatctggctgttgttgtgcgatcgtgtctgccagaggctgaagattttcgggtaagtcccctgctccatgcgttgatgtgaccacaagccatagcccaccaaggcgcagatcatctaatgaaggaccatgaaggacctcagttgaaaacccgtgattttctaagatctccgccatatgttcggcaacatattcagaacttcccattgtgctgccgctgattaaggttattgtgctcattatgatccctgttaaattaaagaacggctattgtacgctgtgagtctactgggatctacctgtggataatatggttataaaccatttcctgtttcaaggcttgattgttcttatgattgggttttgcagggagatcagggtttctgttgactgtatttcatcgattgtctggatcttgttgataagtacatcttgaagcgattcgatggagcggcacataactttagtgaaaatgctgtaatgccctgtggtgtaatagacttcaaccacttcatcaagcatgtcgagttttttcaatgcggccggatagtctttggcgctttttaaaatgatgccgataaagcaacacacatcaaaccccagttgtttggcactgatatcaacacgagtacctgtaatgatccctgcctgcttcattttttccacacgaacgtgaattgtacccgggctgacagcgaattttttggctaattctgcataaggtgtccgtgcgttatccattaaagcgtgaagaatgtcacggtctaaattatcgatctgataaatttctgccattttcaacccctatttttgaataatattcagttttatggtgtaaaaattattgtttataaatattactcgatatttttattatcagatattgaatttatacctcattctgttgcttaatctatatcaacaggacatagggtcactaaaaattttgagagcagcgccatgaaaacatcctttattgaaaaacagcagcagattagttttgtgaaatcatacttttcccgtctgctagagaagcaactcggtttaatcgaagttcagggacccattctgagccgtcttggtgatggtactcaggacaacttgtctggccatgaaaaagcggtacaggtaaaagttaaaacattgccagatgcaacgtttgaggtggttcattctctagctaaatggaagcgcaagacattaggtcgctttggttttcaagctgaacaaggattgtatacccacatgaaggctctgcgtcctgatgaggatcgcctgactcctatccactctgtctttgttgatcagtgggattgggaaaaagtgatgggtgaaggtcaccgctcactcggttatttaaaacagacagtaggtaaaatctacgaagcgataaaagaaacacaaaaagcagtaagtaaggaatttggtctggcaccgttcctgccagatcaaattcactttcttcacagtgaagagcttctgaaacgttaccctgatctggatgctaaaagtcgtgagcgtgaggccgccaaagagtttggtgcgattttcttgatgggaattggcggtaagttgtctgatggtcaggcacatgatgttcgtgcaccggattatgacgactggacaacgccaaacagcgatggcctcttcggcctgaacggtgacattattgtctggaaccccgtattgcaagatgcttttgaaatttcgtcaatgggtatccgtgttgatgcagaagcactgcaacgtcagctcgagctaacttgtgatgaagatcgactgcaatatgactggcatcaggccttggtcaaaggagatatgccacaatccatcggtggaggcattggtcaatcacgtttggtgatgctgctgctgcaaatggcgcatattggtcaggttcagtgtggtgtctggtcacccgaaattatcgaatctgttgaaggtgtactgtaaggattgactgcgaagggatctgagagtagtgactcagtgtcgccatcttcgcagtaaacggcttgtaactccggtatcaaagtgccagatatgatcgaatatctgcatgataccgggctttccataatgggacagggaaactgcatggaagcggtgttgttggcgttgttgcaggttttgtatctgatggattagaacgtctggtaaccgctgggcaatgaaatctgaaataacaacagcgtcggcatctttccagatactttcttgcattttctcaatgatggcattcaggcagaatgccagatcggttcctcctttgaaagtttgccccaaaaaatgtaccgcctgtgttagcccatcttgtgatgttaagtcatagtgaatgagttctgtggaaaataatatgatgtgacagtgacgattatctgccagagcaatacgcatcagtgccagacaaaatgcctttgcacaatgctcattgaacccgcccattgatccggaagtatccacgcacacaataaatggtcctcggggctgttctgcatgatcatggtgagtcatcggcttcaatatgtttcttggctgccagttgtccccttgtagccggtagatcagtaattttttatctaccaaccgccgataaaattcgtactccagctcttcaattcccagcatggccagttctgtgggtaaaagtctctggatatcgtcaccttgttggataccgctgacttgctctggcacggtatctggtattcgctctatttgggtgaatggttcaagggtgttgctatcttcaggaattgatttagccgcttggctgcggccgagtaattgtgccagtttttccagttcaggctgctgtttgagaaattgagcatattgggtgaataatgcggtattgtgcgacgtcaggtgaagtcggcctttgctcatgtcccataatcgccctgcggcgcgatcattttcatcgaatatcggatcgagattgccactgagatctaatcgcttttggatctctgccaataattgttctttttcctgttccagcaattgcttgtgaaaggttgttacttgtaggatcaggctggtacgccagtgttgaataaacaggatttgtcctgcgtgagtgtgttcagataacgcttctcgcaatgtgtgggcgtcatgggtaaaaggagatttgatctgttcaagcttatctgcgagatcagggagttgttgataaaattttgtcgtattcgctgttagtaattgctggtataactgaaattcttcagctagggaggcaggaatgagtgtatcttttattctttgttgtagtgtttgctgccatgcaggtacatctttcaataatgcgcgcttgaacctagggtatttttcaaaaaaaatggtcaattgaggggcacttaacagtgctaaaatgatctcctcgatcagttcaccttcattgatcgagagtaaaagatcgagcgttgtcagagttaacatgtcattacctcatttttgatctcaattgtttcaacttttcgatcaattgcagaaaactttgttcaatgttggcaatccaatgttcttcaataaataaacaaggttgatgctgaccgaacaattggcgctgatgctggatggcatcactaatagatatcagcttttcattccactcgttatttgttttttctgttgttagttgctttgcttccgcttggcagagaatggctctgttacggctcatatccagcacttccaattgatgtttttcgttgatctcggccgaaattttcagtggaaaaccaatgccatttaagcgagcaagcaattctccattgctatttttgagcacgttttccagtactttactatctatttcaatgaaattaacttcaatatcatgcagatgtaatgcgggatacagaaatagaatcagtttttcatcattgatagtcttgggaagtgagtagtggatcttgcggccgaaaagtgatgaattcgtggttaattgtaagggatggaggtgagtttcatctcggctggtttgtatccattgttggtatactccatccattttctgtagcaggaaactctgttgataggcttgttctgtcagcaaatcatgaaggaattgcggcagaagctttaaggcattcaggtcgtgccacaggcagtctttcaatagcaccaaatctaacggagatatggcatttttcccactgaagaatgcactggcctgcaataagcggatggcttttttccagcggcgatctgaaacgtgagggagattttcagaggcattcagtagctggcgtagctgataaatcagctcgaaaatgtagtctggcagggagacgtgtttaatcttacattgccattgatgaaattcctcatctgtgatttggaaatgggtaggtacaggattgtcattttcattgtttcgatcagtcagtaaggcacgaaaattcttcttttcctgaatattgttcagccagattcggatcaacatacgatcgtagagggcttccaggctgctatcagcatcgggcagctcgttggatgccgtgaccagtaaccgcatcggcaggttttcttcttggttgccatttctaaatttcttttcattaattgcggtcagcagagtattcaaaatagcggggcctgctttccagatttcatccagaaaaacaatttccgcttctggcaaatagccttctgtcaggcgctgataacggccttcatctttgagtgcttgaatggaaagtgggccgaagatctcttctggtgtggaaaagcgtgtcatcaagtactcaaaagcgtgagcattttgaaacgaaaattttaaccggcgtgcgatcaggctcttcgcgatccccggtggtcccaggagaaaaacactctctccacataaggcggccagaagacagagacggatggtttgccgtctttcatataatccgatttctaggtactgacttaactgggatattttctcgaccaattgcatcttatttacaccatggttcgaatagttaccttcatttatttatagataaaattcaatctatgcaaagattttggtgattatttattgattcccagtagtgtgtttgaaaaatcgattcagtataacttattcaataagttatacttttttatttattaccctgtttattaaacgttttaatcatgatcacattttcatatcaagcatgttgtctttgatatagggatttatatgatggcggtttagcgaaacgtttcgctttcgctagggagttaataaaaaatgaaaaaaggcgttttattgcattctgatatttctgccgttatttctcgtttgggccacactgatcagatcacgatcagtgatgcggggctacctatcccgttgtccactcagcgaattgatttagcgttaacccagggaatacccgatttgatgtctgtgtttgatgtggttgtgcaggaagtgcaggttgaagcggccattttggctacggagatgattgatcacaaccctcagatacatgaacaaatcatcaagcgcattgctgaactcgaaacaaaacagggaaatgcaatcgcgatagagtatgtgaatcataacattctgaaagagaagacagaaaagagcaaagcgattatccgtactggggaatgttctccttatgccaatatcctcctttgttcaggcgtaactttctgagggtatgatggagccattgctggagttaaaagagattgataaggctttccctggggtaaaggcgttgtcgggtgcggcccttcgcgtttatcccggaaaagttatggcgctggttggcgaaaatggtgccggtaagtccacgatgatgaaagtcttgaccggcatctataccaaagatgccggttcaattcattatcttgggaaaaatgtggttttctccgaccctaaatcttcccaagaagctgggattggcattattcatcaagaattaaatcttatcccccaactgacgatcgcagaaaatatttttcttggacgtgagttcgtcaataaactgggtatcatcaattggcaaaaaatgtatgaagaggccgataatctgctgaagcgtttgaatattcgttatagcagccgtcgactggtttctgaattgtccattggcgatcagcaaatggtggaaattgccaaggtgctgagtttccaatccaaagtcattataatggatgagccaacggatgccttgaccgataccgaaactgaatcgctgtttcatgttatacgggagctgaaagctcaagattgcggcattgtctacatttcccatcgcctgaaagaaatctttgaaatttgtgatgacgtgacggtatttcgtgatgggcaatttattggtgaacagccggttgctgctctacaagaagatacgttgatcgaaatgatggtgggacgcaagctggaagatcaatacccgcgtctggatcttccgcgtgggggaaaacgactggagattgaaaatctgtctggatcagggatcaaaaatgtcagcttctctctgtttggtggcgagattctgggaatatccggtttaatgggagctggtcgtactgaattgatgaagatgatctacggagcattgccgaaaaccaaaggcaggatcttgctggatggaaaatctctgactattcgcaacccacaggatgggctggctaacggcattgtctatatttcggaagatcgtaaacgtgatggcttggtgttgggaatgtcggtcaaagaaaatatgtccctcacagcgttacgttatttcagtcaaaaaccctatcgtttgaatcattccgcagaacaaaaaaccgtaactgacttcatcaaattattcaatatcaaaactccctcaatggaacaatcgattggcttgctttctggcggtaaccagcaaaaagtggcgattgctcgtggtctgatgactcgcccgaaggtattgattctggttgagccaacccgaggagtggatgtcggtgcgaagaaagagatctatcagttgatcaatcagttcaaaaaagaaggtttgagcattattttggtctcgtctgagatgccggaagtcatgggaatgagtgatcgtattctggtgatgcatgaaggtggcataagtggtgagttcagtgcggataatgcctctcaggaagcgctgatggtcgctgctgtcggcaaacaatacggtgcagttgaaaggtaatgatcaaggataagagatatgaattttaacacagcagcaacctccagatattggctcacgaaagcctggttgatggagcagaagtcactgattgcactattgattctgattgttgtcgtttccttcttcagccccaattttttcacactgaataacctgtttaatatcctccagcaaacttctgttaacgctatcatggcggtgggaatgacgttggtgatcctgacttcgggcattgatttatccgtcggatctctattggcactgacgggagcggtggcggcatctatggtcggtacggatgtcaacgcactggtggcagttgctgcggcactggcattgggggcagcgattggcgcatgtactggtgttattgttgctaagggtaaagtccaggcgtttatcgctacattagtgatgatgctgttattgcgtggtgttacccgtgtttataccgatggcagtcccatcaataccggattcagtgataatgccgatctgtttggctggtttggtattggccgtccattaggagtgccagcaccagtctggatcatgctgctggtttttgctactgcctggtacattctccatcacactcgccttggccgttacatctacgctttaggcggaaatgaatctgcaacacgtttatcaggtattaacgttgataaaataaaaataatcgtttattccctatgtggtctattggcagcgctggccagtattatcgaagtagcccggctatcttctgcccaacctatggccggaagtggttatgagctggatgctattgcagccgtggtgctggggggaaccagtctggctggcgggaaagggcggattgtcggtacgctgattggtgcgctgattttaggctttttgaacaatggattgaacttattaggtatttcttccaactaccagatgatcgtcaaggcagttgtgattttactggcggtcttggttgataacaaaagtagtaaataacctcaccctacaggaaaaaacagcatgaaaatgaataagctggcaaccattctatccgccgtagttttgagtgcaaccatgagtgccaatgcattggcgaaggatagcattgcattggttatttcaacattgaacaaccccttctttgtcacgatgaaagacagcgcacagaaagaggctgataaactcggatataacctgatagtgcttgattctcaggataatccggcaaaagagttggctaacgtacaggatttgactgttcgtggtacgaaattgatgctgattaacccaacagattcagacgccgttggtaatgcggtcatcatggcaaacaaggcgaatattccggttatcacccttgaccgtgcggcgaataaaggaaacgttgtcagccatattgcttctgacaatcgtttgggaggcaaaatggccggtgattttatcgctgaaaaattgggtaacaatgccaaaatcattcaattggaaggtatctctggtacttctggtgcacgtgaacgtagtgaaggtttttctcaggccgccaaaagccatcaattcaatatgctagccagccagcctgctgactttgaccgcacaaaagggctgaatgtcatgcagaacctgctgacagcccatccatcagtacaagccgtttttgcccaaaatgatgaaatggcactcggtgcgctgcgcgcgttgcagacagccaataaaaaggatgtgctggttgtcggatttgacggaactgacgatggtgtcaaggcggtacggagcggtaaattaagtgcaacgattgcacagcgacctgatcagattggcatcattggcgtccagacagcggacaaggtgctgaaaggtgaaaaagttgacgctactatcccggttgaattggaattagttatcaaaaaataatcagtattaccatgcagccatcagttttgatggctgcatcatcactgaacaggaataaatgtaatgagtatggcaaaacttgccgtgatgggcagcattaatgcagatcacatcttgaacctcgaatcttttcctcagcctggggaaaccgtgatgggaaaacagtatcaggttgcatttgggggaaagggagctaatcaggcggttgctgcaggtcgctgtggtgctgacattacatttattgcttgtgttggccaagatgatattggcgagcgtgtccgtcaacaattggtgaaagataatatcaatacctcggcaatcggagttattgaaggtgaaacaacgggtgtagcactgatttttgtgaatcagcaaggggaaaacgtcattggcattagcgcaggagcgaatggcgcactcacatctgaatatttccaccatcatgagcaggtggtcaaagaggctgatgtgttgttgttacagctcgaaacaccgttggaaactgtacagctggccgctgaaacggccagaaaacataacactaaagttatcttgaaccctgcgccagcacagaaactctctgaacaattgctttctttggtcgatattatcactcctaatgaaacagaagcggaatacttaactgggatcgctgtaaaagataatgtaggagcagaaaaagccgctcaggacttgcataaaaaaggtattgaaatcgttattatcacattgggcagccgtggcgtatggctgagtgaaaatggtaagcaaggtaaaattgttcctggatttaaagttaaggcaatcgatacgattgcggcgggcgatacatttaatggcgcactggtaacgggattattggaggggaaaggaatcgtatcggcaattcgttttgcccatgctgcggcagctattgctgtgacacgtcagggagcgcagccagctgttccgtggcgacgtgagattgatgcatttctggctgaacaggactaaccgtggctactatgaaggacgttgcccgtcttgcgggtgtatctacatcaacggtctcttatgtaattaacgataaccgttatgtcagtgagagagtgaaaaagaaagtcaatgcggctattgatgagttgaactatgcgccttccgctttggccagaagtctgaaaatcaagaaaaccaaaaccatcggtatgctggtcacaaccagtaataacccgttttatgctgaaattgtcaggggagttgaacggaattgttacgagcgtggatacagcttaattctgtgtaataccgaaggtgacgtgacgcggttgatccgcagtatggaaacactgttgcaaaaacgtgttgatggattgttaatcatgtgttctgaaaatgcgattctacccaatgactttctgctccgatatccacttataccgatggtaacaatggattggtcgcctttttatgtatccagtgatgtcatcaaagataactctctattggggggcgaattagccacaagttatctgattagccgaggttttcgtaaaatagcctgtatcgctggcccacaggataagacgccagcccgtcagcgtctggctggatatcgaaaagcaatgaaagatgcccagttagagatcccggaaggatatgaaatccacagtgattttgaatttgctggtggattgtcatcaatggaacagctactccaattatctaaacctcctgaggcggtatttgcaggaaatgacgccatggctattggggcttatcaagccttacatagagcgggtttttctgttcccgatgatatctccgtgattggatatgatgacatttcgatggcgccttacatgaccccaccactgaccaccattcatcaacccaaagatgaattgggtaagctggctattgatactctgctctatagaatgggcaatccggaaagtgagccaaaacaattaattttgaagccaaaactgattgagcggaattctgtagccagacgctgaaagcattactttttgatcaaattccggccatcttctttcttcaataacaggaaaacaaaagaagaggctagagtaatcacgcctatcgtaataaaggtatagtggaagtgatccactgttgaaccgtattccgctgattcgtaaaaccgaaggattgcagcactgactgttactcctaaactgatagataactgttgagtaaccgccaataggctattgcccgcactggcattgttattattcaaatcaccaagggtaatggtattcattgatgtaaattgcgtggacattgccattcctaaaacaaatagaggaatgatcaaaaagacgagtgatatctccggtgtctgtagtgaaaactgtgcaatcatcacaccaatgatcaccgtaacccaaatgagcgtgtttcgatatccaaattgagtcagtaatttggtgacaaaagatttagcgagaattgcgccaatggcgtttggtgccatcattatcccggcaataaccgccgaataaccaaaacccacttgtagcattaacggaataagaaatgagagggatcctgtacttaagcgagtggcaatattgctggtgataccaactgaaaaggtacgtgtttggaacaactggaggtcgatgagtggatttgggtgcctttttgcatgaaaaatatatcctgacagcataatgatactacccgccataaccgcaacgggaacatagttaggtagagtattattaccaaataaatcaaagctgaccgaaagcatcaccagtcctacactaaatagcatgaatcccagaaaatcaaagaagcatttaggcatggtaaagttgggcatgtgctttttggcataaataatacccagtaggccgataggaatattgatgatgaagatccaatgccaagttgcataagttactaacagtccgccgagcatggggcctaaaattgggccaagcaaacctggcatagtcacaaaattcaaaacgggcaacaattcgctgcgaggatatgcccgcagtaatgccaaacgggcaacaggcatcatcatggcaccaccgatcccttgaatgacgcgggcagctaccaaaaaagagaaactgctggataacgcacaggcgagtgaacctaaagaaaaaagggaaacggcataaatgaatatccgttgtgtgccgaatctatcagccaaccaaccactgaccgggattaacattgccaccgttaaggtataactaacaatggctggctgcattgccagaggatgatgattaagacttttagcaattgccggcaatgcggtattaaggatggttgcatccagggattgcataaaaaaagctatcgcagcaatccagggcagtcccgacatactgcgtgcagatttgaccattagatatcctgttatattttaataatcgatgattacttactgggtatttttttccatttgtttttgttctcttaactgcatggatgtcacatgctccttctatttaacacattatactactgtatagatttaaccattgttgtcgataacaccaatatctgatcgaaaagagagcgtaaatgccagttttgttaaaaaaaacacgaacggaaagaaa

SEQ ID NO: 14981 - DNA, 227109 bp, Xenorhabdus bovienii
  Genomic contig Name=Xb4151_4152.C440
atttcaacctcaatataaagggactgggctatctgaataacatcccgccatgtcagcactgccagcggaacgttcctgagctgtgtgatcaatgcgctgaacggaccaggtgataacccggtttatgtgcgttttgatatcaccgtggtcggcaaggaagcgaccagtctggtcggccgttgccagaaggcggtagatgaggataaaaaagtgttgctgggctttaccttaagcaatccctcgactgatatctttaccctgaaacgcggagaccatgccggtgaacagcgcgtcagcctgaaagcccgtctgattaaggttgactggattaaaatcggtcaggagaaagtgtatcaggccgaacaatccgactcgatgccgcctcagaacggcatcacgcaaaaagaatatgcagagaactctttctgatattccgctgagctgccctgaacgttcagggcaggtctttattaatgaccaaaaataaaaggatatcgtgatgaatgctgcaccgattgggtttctggccctgcaatattgccataaacaactgccgttaatcgttttgcgccgccgtgcggggttttatatcggcacgatggatgaaggcattccctgctctcgtgagtcagtggagtattttgcccgacgtgaacaggcggagtttgccctgaaacagggacaatggacacaacgtcagtcagtttaaccgataaggaaatgggtatgtcttcacgtggaatcaacaaagtaattttagtgggttatctggggcaggatccggaaatccgttacctacccgccgggggtaccgtggcaatgctttcaatggccacctcagataactggcgggataaacaaaccggtgaaatacgggagaaaaccgaatggcaccgggtcgttatcttcggcaaattagccgacattgcggcggagtatttgcagaaaggggcacaggtctatattgaaggccagctgaaaacccgcaaatggcaggataaccagggccaggatcgctactcaacggaagtggtggtgaatgtgaatgggtcgatgcagatgctggggaaccgtaatgagccaaagcgtatggcacctcaacaggttgaaaataagccgatacagaagcaatcctctcaaccagttagcagagaaagaaaggagattcctgtagtacaaacctctgttttaccaaaaaaggaagaagtagattggaatgaggaaattcctttttgagttacttgaaggttatattaactttgagttttgttatgttaattagacttttatgccccataatggggcaattatgattttcacttggttcttgttaatttttatttatattttcaattgtttttactgggattagtttataataaggttttttattctgacattttaactttgaaacttcccatgaattttctgtttttataaaagctctatattcgtcattctcaaggctcatgtaacgagtcgtgtttccttccggcagtatcatatatttttcatggcaaaaaaaagtacttctagtctccattggaatagtaacatctattatagtgttaattgctttatgaatgtttatattgaaaaggatgtaaatgataaaccaagataagagtactggtattgctattggtgcgctactgtaatgtatttcttttgttttttttcttgtgaatgattttgctttttcaaaaaacattaataatacaggagataaccctataaatatagaatatattatcattatggaaatgattgttagccctatagtggttggctttgaaagtgttgattcataacttatatcaaatatttccgcaacagtatttcttgagtgagaataaaataaatagcttaataaaatccatattattttaaatgtggttaacaaaacagagctaaaattatcattttttctgtttatggaattagacgtgaaagttagtatagatatacataagcacagaagaaataatatgaaagttgctattgtatctgtttgtgagctggaattttcaatgaatgtaaaaataaaacaagatgtcaaaaaaaataaagatgataacatcgaaaggatgatgcttatagtataacttgatatttttgttttgagttttatctttggtaatggacctatttttctatggaatactattattgcagtgataaatatcattccaatccaaataatgaagggtattgcaggtgattttatataaaaaaatagacaggagattgaaatgtaaaagcataatatatgataaatataaacatattttgaaggtgatatggttttatgtgacatattttctccatgaacaaaataaactgtcataaacgcagtcaggtatagcgagtatgctttccataaaatggaatatattatgaattttaactaactagtaaaaaatcaatttaccatattcttttgtttgaaagtagtaagttttatatcagtcatattgaagagcccagttgtcctcattaattacttgtagtactggctgcttcttttgatgaataccttgataaattaactcaaactgattactaattcgtcccacaatatcgctgacatagtgttatgttaataaattgacaattgtatattttagaagtatacttcaggagcagtttgtggcggtaggagggccccacgtaaaaaacagaaacctccaaacagaagtacagtggcggtaggagagccccacgtgaaaaatagatatctccaaacagaactaactgccagaaaaaacccctgaattggggttttttttgatctacataaaagtgatcaggatgaaattaagaaaattagatcaagctttttatgatgataatactcatctcatacaagcgcttgataatgaagatggaaagtggatatcaggtaaaacccgcggacatggtattgttgtagtcaatatcaacaaattaactttcgctatcccacttagaacttcgattaaacataacgcagcatatattacgcaaaaatccaaccaaaaaggtgtaaaaggaaaaggactggattactcgaaagctttattaatcatcaatcaaaagtatatttctgatgaaatatttttgatcccagcagaacaacataaaaacatccaagggaaagaatttttcattacgagaaaatttgagaagtatgtagaaaaatatattaaggccgctaaaaacagggacagacatgttcttaatagtctggaatatcgttttactacgcttcaaaattaccataatcagttagatgtgtgagtgtattataagcaatttattattgtgttgagctttatttaaacagcatcagtaattcaaataattcaatttacttgtaaaacttactcgttcgattattgaattagataacgtaattcgttaaagtagaaaagctatcggcaaaatccgatagtcaaggaatctcacccttgctaagagtaacccactggtaggaattttctgccagtgtgcctgctatcgcaccttctatggcggttcaggcaggggaggcttcggcctcgccggaaggttactcccggttgtgagatccctgtcttgaatcgccaccattcaataatcaaaagaaggggaagcaggtatgactatgactcacactcagaaagactggcacccagccgaaattatttgcgcattacgcaagcgtggtacaacactcgccgccgtctcccgcgaagccggattaagctcttcaactctcgccaacaccctgtcccgcgcctggccaaaaggggaatggatcattgcaaattatctcgatgttcatccctctgaaatctggccgagccgttattttgaccaatatggtcagttgattgagcgtaccgtgcgtaaaacggtttcagcagaatcttcagatcaataagcggtaacgtttttatttcctaaaaggcagtttcagttgttgattgaataaatcctgttatttcctgcacattggcgctttgattgccgggcaggaataacaggaatgagaataaccgtattaatgggtgtattggtcactatcctgacgggttgcaatgcctcgtcaaagcaaccgtcatctcaatgtgctcccgaaaaagccatttcaacaacgcagctcacgcgcaatattcagcccgtctcacccgatatttatcaacaaacatcggaagtcgtccgccacggtcgttataccctggtaagtaccgatccaacagcagcacagcgtgatccactttcccaattgattgaggttcatatcccggcgtctcagcatctcacggtagccgatgccctgcgtgacgtattgcgccagtcgggttatcggttatgtacgcctgaaaaaaccaatgacattttatatcgccagccgttgccgtcggtacatacgcagtcaggttccgtccggctgcgcacggcgttgcagtttatggccggtccggcctggcaactggaggtggatgaggtccagcgtgtggtgtgtcaccatttacggccgggttatcagcttccacaacctcggcagggaaagcagccatgagattgcatcaaatcggtctggtaacgtggatagtgctcatcagcccaacatgggcagccacaccgtcacccttaacgtcgcagcaggcacatacggtggaaagccaaaagcaaacattgagaatacaggccgggcaatggggattgaacgcggatgaatatcagcgctatcagcaattattgaatgggccaagggggatccagtcgccggggcttgacccgttgacaaccctggggattgaagcggaaagtgaggctgaccgccgccgttatgccgaacagtgggtcaaagcggaatttgtccgcactgaaaaagaactgcgttttcaacgggaagtggatgctgcatggcaacggttatttccggatgtgttgccggtcaatatggcgaaatccggtgaggcaaaggggcgtttggcgttgtttgtcaaaatcaacgattgcccgccgtgtgatgcccgtttagctgaagttctggcgttaatgcaaccggttgacatttatctggtcgacagcaagggcaatgacgacacattacggcaatgggccaaaaaacaccgaatccctgttgagcgagtgcgcaatcggcaagtcaccctgaatcatgatgcagggtactggttcaggtttgggcagggtgttatgccggtcttattgcggcaggaagagcagggatggcatatcacgttatgataatgaaagggttgcgcgtattccccattatcgggatgctctggttcaatacctgccatgcggagctgaatgtcattgccgatttaggcggcaaagatgcctcgcctttttatgaaagcattaatgctgagcaacgcgatgagcctgtgtcatcggtgcaaaattcctcacccgaaatggcaggtgaagcggcgatgttgcctgtcaaaacaccggaactgacgccgggaaaagtggcaagcagaccactgcaactgccgggaattggcgcactgtttctgattggggatgatccggactcgcgccagtggttaagccagaatgcggccaccttgacgaaactgcatgctgtgggtctggtcgtcaatgtcagtgaaatagcgggcttgcagtcactgcgtgcatcagcgccgggtttattgttgtcaccggctgccggcaccgagctggctcgtcgattgcaactgcaacattatccggtgttgatcacggaaactcaactttcccaacagttgtcaccatgagccgccgttatgtggttgaagccctgctgcgtcctgccgtcgagctgaatacggcgctggtctccgccgttgccgcgtttgtctgtatcagggcaccctgggccatcgcactggcaccttccgtcagctatgtgatggccggtggttttactgtattagcgatgatacgcacatggcagggtattcaggtcatccgttatcgcagaaacctgcgccgcctgccacgttatcagatgagcaccaggcacattcctgtcagtcaccggcagttgtttctgggcaggggatttcgctggcagcagaagcatacccagcgtttacaggatacccgccgaccggaggtcgagagattcgtacaaccgtcccggatatatcagtttgcccgcgcactggagcgtcgaactgaataccgctggccaacattatcggcgttgttacgtcaggattcgccatttaatcccgtacgcccgctgcctccggtgggcggtaatcctgctatccacggtattgagccacaggaggccgatgtttttatggatctgcgcgagcgggtcgggcatacgctggtgatgggtaccactcgggtggggaaaacccggctggctgaactgcttatcacgcaggatatccggcgcggtgaagtggtgattgtgtttgatcccaaaggggatgctgacctgttaagacgcatctgggcagaagcacaccgggccggtcgcggtaatgaattgctcctctttcatctgggctggccggagatttcggcgcgttataacgccgtcgggcggtttggccgggtatccgaagtggcttcccgtctggccggacagctcagcggcgaaggcaacagcgccgcgttccgtgaatttgcctggcggtttgtcaatattgtcgcccgtgctttggtggctctggggcaccggccggattaccagctcatcacccgctacgtcaataatatcagcgaactgtatcagcgctatgccacccgaatgatggaggaaagacaaccggatctgctggcgcaaatcaatcattccctcagcaaactgaaagaaaaagacattccgcgcaatatgcaggggcaacccgatgccctccggctctgggcgatggaaatgacgctgagttctgacgcaggcaagcaactctatgacccgattctggatggtctgcgttctgccgtgcgttatgaccgtacctattttgataaaattgtcgcgtccttattgccgctgctggaaaaactgaccacaggcaaaattgccgaactgttatcgccggattacctcaatatgacggatctacggcccatctttgactgggagcaggtgatccgcaaaaacgggattgtttatatcggtctggatgcactgtctgacagtgatgtggcctcagccgtgggcaacagtatgtttgcggatctggtcagtgtcgccgggcagatttacaaatatgggatgaatgccggattgccggttcgccatgacgggaaactggcgattaatctgcattgtgatgaattcaatgaactgatgggtgatgaatttattccgctgatcaacaaaggtggcggcgcggggatgcaggtcacggcgtatacccagacctcttctgatatcgaagcccgtatcggcagtccggccaaaaccgcgcaggtggtgggtaacttcaataccctgatgatgctgcgggtgcgggataaccggacggcagaactgctcaccagccagcttcctgaagtggaaatctacagcaagacgctggtatcgggacattcagatattgctgatgtggaacagggtcaggattttacctcttccacgcaggacagggtaggcaccgtcaaaacaccactgattactcccgccgaaatgattaacctgccaaaagggcaggcattcgcgttactggaaggcgggcaattgtggaaaatccgcatgcctttgccaacgggggatgaggatgatgccctgatgccggccagtttgcagcacattgccgaacagatgcgcaggcactaccgcaccagtgaaaactggtgggaagagaagggatagtttccggtcatggctcagtcagaaaatcagtcccgcccatcttcccaaccgccccgcaagcatggcctgttgtatcgtctgttatgggaatgcccgtggcagctcattggctttgtggtgatgtcctggctattcagcctgttactggaatatctcggtatggcttttttctggccggaacagggtgccgctcacagtcagactatgatgaaggcagagcttaattatctctcctcggaatttacccgaagtctgttattgacagaaccttcacaaaccgttttggcatggctggcacaggtttatcagtggctgtttgtggacagtggttttatgaactgggttcaagggcagaggcaatatcagctccataacaacaatgattttatgcgtgaattcaatacggtattacatggcatatcggcgcatttgcaagaatattggctggccacggtatttatcacgatggtgacgctgatccggctggggatcctgctgttatccgtgcccctgtttgtaatggtggtgttagtggcactggttgacgggctgggacgacgggatttgcggcgctacggagccgggtatgaatccagttttgtctatcaccatgccaagcgagggataaaaccggcctgcacggttccctgtgtactgtatttatcgtggccggaggtggtgtatcccacggtaatcttgttgcctgcggcgatagtgctgggcatagcgattgtgataacaacatccatgtttaagaaatatatttagacgctggatgctgatgtgcaaaacgttttttgttttgcacaccagcgccagcagacaagccgctcagcggcgcgtcagtctttcaaactaatgccgatacgttgacggcacattcaccacctgcgtcatccattcaaacccgtcacacgctttacaaatacggttatcctgcttcgggtcaaaatggtagtgatgatgcgagatatcttcacaataccccacaaacggctgatcgatacgatgcagctgaatagccgccgcctgctctttggcagcagggaaaaacgcgccgccgacttcggcaaacaattcggtatcatcctgttgtgcgccacagtgttcgcaatggtttatccagtgctgccggcgcagccgttggctgacggctttgcgcagagtgtgatgaaagccgggcagtacgctacgcacgagagagggaatatcagcgatataaaacaaaaatgccgggctgtcctgctcggtataatcaacttctgtgccgggttcatcgccgttatccgcttccagcagttggtgcccggctggcagcataaacgcggtcaccgtggtgtgttcatgacagtgcgggcaggtcgtccgggtctgggcgagataccagtattcagcgtgcacattgtagaacggcaaccagttcataaacggcgtcgggtcaacactgttatcgatataccagatttgggcggcggcatcccagtgtgcacccagcttccgtgcctgctcgtattcatcatcggggacgtttaaatcaatccgcagcatgtgttttccttcattcttaaatcgttaaccaaataaattagtcagactatttagctaattttcaccaaagcataaagagtttattgctgatctgacctaaaaaaccccgcatcctcggcttcctgaaatccatgatgaggtgcgtgttgatgcgtggtgacttttctttgtcccgttctgtctgtctgctggggttgactgtgctgtgtatgccgcttgcgcaggcggccgagaaagacgaactggcgagtgcaaaaaatctgattgagcaggtgcagatggcgctggagcgtgcaaacctcgccgaaaagcaggctgacaccccaacccgccctcgctatgactttgattacctccgtatcaaagcggatctcaacaccatcaaagccggtatcgatcactatctgaccccttcccgcgcccggcagcaggcgtcaggcacgctatccggtcattaccgtcaggaacatccgcaatgacggaggcacaacgcactgcctttaccgtggcctcggggcattttgatatcacttttctgtatctggtctgcgtcggatttttcctggccaccctgtttctctgggcggcctgggccgcagtggatgtctggcacggctgggcgaatgaaaaaatacgtaaccagaccatcagccagtttgccctgcgaaccgccctcttactggtggtcgcggtctggatgtttgccagctgatgcaacgaacataatgaacaaggaatggattgaacatgaagccaatttttaccgtttgccgtcgtatcagtatgcacctgataaccagaataagtacctttcttttgctgtcgggtctttcctgtcaatcagcccgggccgatttgccggctatcgaaccgccaaaaagtggcggcgggggcggattactgggacaggtgaaaggctatgcgcaggatggcattgtgattggcgggctgatcctttcggccgtcgcgttctttaaggtcgcgtcggcggcggttgaaaccttctccgaagtgcgggacggcaaagccacctggacacaattcggttctatcatcgtagtcggtgtggtgctgttggttgcggtgatttggctgctggcgaaatcggccggcattattttttaaggtgcaatttatgcagacgatccctttcctgcctgatcgcttaaatgccgaaccgatcgtattccggggattcaccacaccggaaatggggctggccgctttgctggggctggtgttcgggctgatggtgagccttccttttatcccgttagccggctgggtcatgataccgacgggtatgctgttcatgcccttgttattgattagttttggtgggcgctggctcgcgcagcttaagcgcggcaaaccggaaaattatctctggctgacgctggaagagaaaaaacgccggctgggtatcggtgatcaggcattgattattgcggctcagggctggtcgttgcgccgaagcaggctgactcatcgtaacgggagcctgcgatgagccggtttcgtcatgcgctgaaaaaccgtgaccagcatatcctgaccctgcggcttgcctgcggggtgctggtactggtcttgctgatcacgctcacgggctggatggcctcaccgcgcaatcttactatccataatccgccggacttacgcagcggcagcacccgcccgtggtgggaagtccctgcgccgagtgtctacagttttgccttttatcttttccagcaactgaatgcctggccgaaaaacggggcacaggactacccggccaaaattgcggccttatcgtcttatctgaccctcgcctgtcaggattttttgcaggcggatgctaaaacccgggccgacagtggtgaactgctcgaccgggtgcgggtggtgtatgaaattcccggccggggctacggggcgaaaagtgtaacggtgcgtaaccgggataactgggtggtgcggctggatttggtggccgatgagtattatcacgccgagccggtcaaacgggcgctggtgcgctatcccctgaaagtggtgcgctgggagggcgatgcggagcgtaatccttttgggctggcactggattgttacgacgggatgccacagcgactggaagcgatgccgcaacctttggaagagaaaaagggggtgttccaatgaaaagacatccatcttgcttttctgcctgtttttggccgggactggtcagccttttgttgttcagcctaggggcaaaggctgatgaactgatgaaatgggaacgcattccgttaccggtgacgctgaaagtgtgtcaggagcgaattatttttgctgaccggaatgtccgtgttggtttgtccccgtcactcagcgataaattgcgggtgcagagcgcaggcggcgcggtttacctgaaagccagtcatgccttttcgccaacccgcctgcaattgcaggacagtgaaaacggcgaaattatcttactggatatcaccgctaccaaaacggggtcaacggaacccgtccgcattctttatccggatgaaaaaagttctgccccaaaagagggtgcacagcttcagagaaaatcagtaccttcggctcccgtgcctgtggtattaacccgctatgccgcgcagcagctgtatgccccgctgcgtaccgttgagccagttacgggtatccatccggtcagtctgcatttacccgtatccatcacgacactctatccttcagaaccgattgcggtttccccgctggctggctggggcgtgcaaaattacgcggtggtagccctgaaactgcgtaatacggtcaaacgcaacatcacgctcgacccacgggccttgcaggggaaatttgtctcggcgacgttccagcatcgctggctgggtgaagccgggacaccggaagacacgacggtgctgtatcttgtgacgacaggacagccggagaacgcttttctgcctgagccgatagcggtgaagccgggaggccgcgatgcaggttaaatccaacagtctggtgaaaattctggtgccggtggtgctgatggttggcggatttatcggcatcaaaagttgcagttcaaccgacactgccccgcccgctacgccgcaaaataatgccctggccaccctgtcaccggaggagctacaggcgctgggtgtcggcggtgatacgccggaagataccttgcgtacgctggtgggaacactcaataaagtgcggtcagagcagcaacgcttaggtcagcagaatgccgatatcctgaaagaaaatgaccagttaaaaaatcagcgtcaggatgtcgccggtcagatagacgcggcggtggcagctatccggcaggacgatgaacagcgccggcgtgaattacaggatgaacagcagggattgctggcacagattgatttactgacggaacgcttaaattcagcgcctttgtctgcgccggacagtccgataccgcctgggtcgggaagtattccgtattctgccaatgcaggcacagggcagaatgaacttatctggatagcacccgccgatgaaaagcccgcagacatacaaacccccggcagtggaaaagccacggcacaattcccgacctcatttttaagtgaacagtcagccgccgggcaaaataagccccaaagcccatcacttcaaaacccatcaaaggaagaaaatgaaaagccggtctataccctgcctgaaaatgccacgttagtcggtagtcaggccatgacggcgttattaggtcgggtgccagttaatggcacagtcaccgacccctatccgttcaaaatccttatcggcaaagataacctgacggccaacggcattgaactgccggaggtggaaggggcggtggtatccggctctgccagtggtgactggacgctttcctgtgtgcgcggtcaggttaattccatcacggttgtttttcaggatggcacggtgcgtaccctgccgggcagcgggcaaaacaacaataccagcgcgaacggcatcggctggctgtccgatgaaaacggcattccctgtatcagcggtgagcgcaaatccaacgccgccacctatctgccgaccctgtttgcgctctcggccatgaattcggctggcgatgccctgagtgaaagtcagcgtactgctcagaccagcggcacaggcggtatcaccacggcgttaacgggcaatgccggacaggccgcattaggcaaagcgatgtcaggtggcatgaatgacctgagcgaatggctcagacagcgctacagccagacatttgatgcggtttacgtcccgcccggtgcccggttagtggtgcatatcacacaacgcctggcaattgattacgaagtgaaaggacgtaaggtgcgctacggcgtgagtgagaccgccgaacgtgataatcaggaagcattagattaatggaaaagatcccttctcagtggatattcagtgcgggttccccgtattgcctgcaagtgccggtgacgtcactggctgaacccacacgggtgcagctttactggcgtgcggtgcgtaaaaaagagtgtcggttgtatctctcaaccgacagagaatgtcagccgttgagtgacggtgattttactgtcttccgcctgacggaaacccagtggcaggcagtggtggacggtaaaatcagcatggcgcctgaacagtgggtgcctttgccttttaccttatcagagctggcggtacacccggaatttgccacgtttaccgtccttggcaccccggaggccgccgtatgcggaaaataaaatattattggctgttggggttggcagggctattagtcggatgtaccacttcgaaagacgccttactccctgccggaaagcagacagtactggcaatgtggcaggggaataaggcaggtcatgccaccgaatcggcaagggaaacactgcgccgttctttaactgtatctgaacggctcagggctctggaagaaccttatcattacagccgttcagccgcgcaggaaatcagccagcagtttccccgcttacccaatcccgatatggtgatgtatatcttcccccatctggttgccggcaacacgccgataccgggctacagcacggtatttccgttttacagccaagtacagtatgccctgccgggtgaacgcacggaggcactgtaatggaaaaactcaaggcactgaaccgccccggcaagctgcgtgaagcggatgaagccgccatttatcaggccaatccttctattattgattacctgccctgggtggaatatctggaaaaagaacaatgcctgctgctggatgacgggatttccgttggcgcggtctatcagattgaatccattgccaccgaaggccgtcccgctgagcggttgactgaaatccgggatcaactggaagatgcgatccaggacagtctggaagaagatgatatttcgccgtgggtggtgcagtttttttgtcaggatgacgatgatcctgctgactatctcaacaccttgcggggctatgtgaaaccctgggcacagggaacactgtttactgacgcctttctgacggaatcagagtatcacctgaacagcattgcccggcctgacgggatatttcaggacagcttaatcaccgggcaaccgtggcggggccagcaacgccagacccgtatggtggtttaccggtggcttccgcccacgcgaaaatcccgccatgacagccaaactttatcggctgttgccgcccttaatcaggtttgcgagcggctggtctcatcactggcttctgccggtgtgattgcccgccgacaacatggcgggcagatccaccgttggttgctgcgtcattttaatccggcgccggactgggggatggcaaaagccgatttttaccgtaccgtcagttatgaagcccctatacaatcggatctccccgtcagtaatgactttgccgaaagcctgtggttcaccccgccggtgtctgatcccgacgcgggcgtctggtggtttgacgggttaccgcataaagcggtgctggttgagcgtctgcgccgtccgccggaaccggggacactgacaggcgaagtgaaacggggcgacaatatcaatgccctgatggacatgatgccggcagggacggtggtttcgctgaccattgtggcgcaggcacaggacaggctggaagaggattttacccggctgacgaaaaatgcggtgggagaaaatactgaatcgctgcgcgtccggcaggatgtgcaggaagtgaaagaacttctggggcggcggcataaattgtaccgcagtgcgctggcctttctggtgaggggcaaggatctggatgatataaaccaccgggtgcatcaattatcctccaccctgctgacagccggattacagcccgtccggccggaattcagtgtgtcaccgctgaatgcctacttacgggcactgccgatgtgctttaacccgcagaaagacaaaaaacacgggtacagccgcctgacctgggtacagcatctggccgggttattgccggtgacaggccgttcgaccggcaccgggcatccggggttcagtttttttaaccggggcggcgctccattgaccttcgatccgatgaacaaacaggatcgcacccagaatgcccacttattgctgtttggcccgacaggcgcaggcaaatccgccaccctgtgtgccgcgcttatccagttaatggcgatacaccgaccgcgcttgtttattgtcgaagccggtaacagttttggcctgctggccgattactacgaaagcctggggctgaccgtcaataaaatcggcatcaggccgggctgtggggtcagtctggccctgtttgccgatgcccatcagctgttgcaactgagtccccggcaattgcgcattaatgaagccgatatccccgataccgatgaacaacaagaagatgagggggatgaacagcgcgatatcctgggcgaaatggaaattgccgcccgactgatgatcaccggtggtgagaaaagagaagaagaacgcctgacccgctctgatcgcggtttaattcgtgaggccattatgatggcggcgcagaccagctttaacgagaaacgccagatggtggcctcggatttacagaatgccctttatgccatcgcccgtaatcaccggcaggatgaacacggccagccgttaatcaccgctcaccgacgggcacgggcagatgaaatggccagcgccatgtcgatgtttacgcaggggttcgagggtgaactgtttaaccgtcccggtacgccgtggccggaagtggatgtcaccctgattgatttgggcacactggcacgggagaactactcggcgcaaatggcactggcgatggtctcgctgattaacaaagtcaataacctggctgaacgggatcaatatcaggatcgcgaactgcaactggtgattgatgaagggcatatcaccaccaccaatccactgttatcaccctatatgactaaagtggtcaaaatgtggcgtaaactgggggcctggctgtggctcgccacccaaaacctggcggattaccccgatactgctgaaaagatgctgaatatggctgaatggtggctgtgtctgaccatgccacccgatgaggtggagcaaatcgcccgctttaagaagctgaccgaagagcagaaagcggtgctgctctctgccagtaaattaccccgttgttataccgaaggcgtggtgctggcaaagaaaatcgaagccttattccgggttgtacccccgagcctgtatctggcgctgggcatgacagaaaaagaagaaaaagccgaacggcgggcattgatgcgggaacatcagtgcagtgaactggaagccgctgttttggtggccagaaaaatggatatcgcacggggattaaaggttgattccggttctgtatgaacaaacaagtcattgattatattttgttatggaatgtatctaatgccttcatttttcactaccttgtttagggaacctctaaaaactctcaatacaaaaaataaggtcaatgttgcactcatcaataaatgaccttattgtgtatgactttttcttgctttttcaggggaaaaaataaactcatcgctttttcatcacataccgaaattaaaaggcatgaaggccggattttccaaaataaaccaaacgttgcaaatcataacaagtggccttcagaatcatcgcaaaattggctcgcagccggcctaccgttcggatgagtttgtcacccatctgggagaatgaaccaaagatatgttctacccgtgcccgggttttcgctattttcttatttcgttttttctgacaggctgataatggtttctttcgtaacgcttttctctgaatatgaacacgatagccctgttccttcagtgcgtgttcacgcatctggctggcataccctttatccgcataaatgtcccggcttgtatttgaccgttccaaaacggcttcaaaaaactggctatcatatgcggaggcggttcctgtcgcgatgttgcgaatcactttatattttgtatcgacattaatggtaagtttatagccaaaataacttttaccgtgctttttcgtccaggttgccgcggtatctttctggcatcgttttttttcgtccagttatcaggggttttaccctgacgaatttgttcattctcttctttcttattgtgttgcttaggaaccggaatcaacgtggcatcaatgagttggccacctcgaggaatgaatccctgtgccgaaagctgatgcttcgcttcttcaaacaatgccctggccccttcctgcccatccgtttttcgaaataccaaatcgtgttacggtctggaatattaatgacatcggtcaagcgacaaaaacgttgccagctcattcggtcaagcagttgatattccatcttttcatcagaaagattatggaaatgtttcaggataatgatgcgaaccatcacctcagtcgggaatggcgggcgtccgcctttgggagaaataatccgtggcgcgacacggtctacgtgtgtcagccagtgccgagaaatcaacatatttatcaagaacaagcagcggatcacctaattcatcgatttttcgacggtgatattcggatgccagcttgtctttttttaaagcagaacgaggcggtatcatgacggcgctaccttgcagagatgtgctgtgtctacattttactcaattttgtggctgtgaaaagtttttggaggttccctgtagttgccaagttcaacatattaaatacacaacctgaatttgaagatagccatgggcgtaccgtcagacgacgcggatgggttctaccgctgacaccagaaacaaaacacttaggctcctggccagatattcaggctcttctggtcacttcttattttcgttattatttaagttgttgtcaggattctcctgcctttcagttagcaggcattcggaaacattgggctattgaaaatagcttacactggggactggatgtcacttttcgggaagatgattcacggatgagagagcagatcgccacaagaatatttgcccaattacgtaaaatggcgctcaatatcgttaaacgggataccaacagtaagttgagtttgagtgcccgaaggaaatcagccgggtgaaataatggctacatggaagcgcggttatttaatcaattttagcctaccaaaatttcatgcgtaacccctgaggacagaactcgtttcgatgctgcgtaaagggcaatactcataacccgaagatatgacattgtcaccggcagagatgttttatcgattggctgaataaaaagcaaaccaactccacattgacccagactttctctgttaatgcaacagaaccatattacctgacctcaccttaatgcgacagaaccctctgaagatacttaaataattattagaaaattttattttatatgggtaactatcataaatagttattaaaataataaaaaatgaaatttccatttaaattaaattaaattaaattaaattaaattatttataggaataactatgtaattagtctggaaaaataagagtgtaattcaccacataatgatgaaaaaattccaaatttatgacggtatgtcgccgttttcgtgaaagcataataaccttgaaaaaaggcaatttaatgatatcacctgatgttatccctcacgttcattaaatagtataattaatacggtatcgtgattaacctcaattccccgctccgccctcatttcctcgagattgcgcaggctcagggcgtaggccggcattgggccatgatatcgacaggataatggaggcgtttaaacgtgtttcggatcagggacatcgttctggatttgctcaaaaaacagaggcgcttacccgatgttccgctaatgcgacaaaaccgacagatcttactctttccggtccatatttgccttgagcaaaaataggcgaagtcgtaagagattaaactgttaatttattgtattatcacaaataattggagagttattatgcgttcagctccatcttcggactctttatctgccagggaaaaacaagccaatttacctaaatttaatccggccacgtttgataagtacgcagaactctatgaaagaatgacttcttggccttatcgtcaggaattagagcttccaacgttagcaaaattacttggagatctctccagtttaaatgttctggatttcgggtgtgggcctggcgtaatttcacgttggctgaatgagcggggcgcaaaacgcattgtcggctatgatatttccgaaggcatgcttaattatgcccgccggcgtgaggaaaaagaccagcgcggaattcactatatttcaaagattaatgaagattataacgtatatttcgatatagtccttgctgtttatgtgatgccttatgcggctaactacgcggacttaatggcgatgagccaaaccatggtcagggtattaaaaccaggggggcgcctgctcacactccctatccaccctgatttcaattcagatcccgaatattatcgcccctttggctttcgtctgattgaagagcagccgcgcacggacggtagcgcccttcggcttcatatctgccagccaccttacgatatcaatatacaggcctactattggtcgcgtccgacactggaaaatacgctacaacaggtcggttttcagacggtaaactggaaatcgttgaatgtgccggtcaataccctgatcccgaatctttcatcctacgttcaatgcccgcatgccgccattcttgaatgtatcaggggggatgcatgttaatcaatgttggccagtccgccttctcccctttagtttccgacattgagtatatcgaccggcatgagtgggatgcgttggtttccgataatgacttttttcacagtcacggctggttaggtggactggattacgccttgggcaagggagacgtctttacactgtacggcaatgcgggattgttaggcggttgcgcactctggggtggcgaagatcagtccgggctgttctatctgccagactacttccccggattggacggtccttggcaataccccttcttgtggggcggagcccgccgttccacgcacaatgaaatcccctgcgtgcaggggagctgccggggtgaaacattgtcgaccatggctgaaatgcttgcccagttggccgggacccggggatattacgcaacgattatgccttttatgccgctgcatcaggccctcgaggttgcccgttactatccccatgctcgggtattgatgcattcaggggaagcgaccctatcggtaccggccggggggcttgattcgcaattacaacaattatgctcccaccacagggtaagagccaacgcggaactggctgcctttgcccgcttaggaaaccgggtggaatggtgccgactggacgattatctactggaggcggcggcagaacttattgctaataaccggggaaaatacggtagccatcaaggtattgactggatgcagcgcatatttgatggacaaaaaaaatcctcagtcatcaacaccgcggtggctgctgtagccaaacgcgatgagcagatcctgggggtaaccatcttctaccgttttggtgaaacccttcatgcccgttattacggttcgaattatcagatagacgataacgacttccgttatttcgtgctgaactattactcctcattagattacgcggcgaaaaacgggatccgtgaatgccggctgtccatctccgcccttagagccaaaacgcggcgtggtgcaaaaatagagccgctcgccgcgctgttgctgttcgaaaatgccgtccctctatcaataagtgaatgtgaagactataaccgccttttttaccaacattaccaacaacaattcggcacacacctgacccacgactgggcgttgcttgattgaaggagaacctgatgctgcatctgatgtatttactgaaaccgacacaaaaagcccatttggatatgaccgcattttggcattgggtggaaaaacgtgacgaatggttctaccgtacactagaaatgactggagaacgccgttggtatgtccgcactattggtgataacgtccattgtctggaacattacgttacatttgccgacgaagccgcgtggggacagtaccgcagggcggtgtcaaaactctgcaaagatcccgaatgggaaaaaatccgcaccgagcaatctctgtggtgggaaatccttgattcaagtttgttgaacgacgcaccttttatcgtcaatcccaggagataacatgaatctaatacaacgcagcctttatttgctcaacaacgcgcgctttttcacccttgccagtcggcacgctgacaatatgccctgggctgctacggtcaattatgtgccattatttgaaccgttgcggctggtgtggtattcgatgaggatcgccagacattccgaaaatattttctaccatgcagaggtcagcggttcgctgttttgtcatgatatgcaggcaactgcaccgccagggctggacggtgcacagtttaccggctgtgcacgggaaataccccagtgcgaatgcgaatgtatccatcaggattattaccgactcaattttcccgaagcacgggaacgtgcccgctggcagttgccgctgcacgagttttatggtgatggtgcgcgacgcttttatgaactccgtatcaatgactggtggctgctggatattgatggctggctgaaaaccaaagaagacaggcgggttcccgtccctcttgcccaattgattgtaccaaaacaggataatgagtctatcttacccagcgttacccaatgaaccaggcggttatctgatagggaaaagttgggtgatgtgactttttccgtatctgaaatgtttagttaacgtcagttctgcttaagtgttgtgctttgataaattcggacactttggtaaaggaatagaatgactttaactaaggtgtctttatgaaacgaaaatcaccccaaaaatttaccgataactttaaaagagaaacggtcaatatgattgttgaacagggccatacggtcccataggcggctgaaatcttaggtattccaacaaaactcctgtagacgtggcggaaacactatgttgagaaatctaaacccggttctttaatctcagatgagcgacaggagttgttgctgcttcgtaaagaaaacaaacaattgaaaatggaaaaggcgatcttaaaaaaggcgagtgccttctttgcgaaagaactgctgtaaggtgtgggttcattaaagaacagacagagccatttcccattcgccaattatgtcgagtgatgaaggtcagtcgttcaacgttttatgcctggcaggcaaaacccgttcggttactttctgatgaacaacgagaatgacaccgaaaggcaacggcgctatttaaagaaaaccgggaaagcttatgttaccggatgctggcggaaaaattacgcaaagaaggccttactctcagtgattatcgcacccgaaagttaatgaaacagttcggattatacgtcaggcagcgtaaaaactatcgggctccgcgcaaaggtaaagcaatatcaacagcctgtaatctactcaaccggaactttaatccgctggcgccgaatgaagtttggacgggagagatataatctatttaaagacccctgagggttagttacatctggcgatagtgatggatttgtcttctcaccggatagtgggatgggatatgtcaacggagacagatacgacactgatcagtcaggtgttgatgaaagcgtatcactgacgctagccgtcaaaaggttgtgtttttcatcgtgatagagggagccaatacaccagccaacaataccgggacctactcagcagttatgacatgagaacggatcagggggatgtcggggtctgttgggataacgccgttattgaacgtttttttggcagtttaaaacacgattggctattcaaaacacataatgaaaacccgtcggagatgaaaaaagatgtcctggattatctgcattattacaatttaacacgcttacacacggccaataattatttaacgcccgtggaatatgaaatgaccttcaaaaaagtatccggtttttcttgagcagaacactctctggccaatacgttttccgaaacaccaaatggtgttacggtctggaatattaatggtatcggtcaagcgacaaaaacgttgccagcttgtctttttttaaagcagagcgaggcgggatcatagcggcgttaccttgcagaaatgtattttgtctgtaatttactcaatttggtcgctgtgaaaaatttttggaggttccctttataatatcaaaaattgagatgagtgcctaaatgagagaccatcaatcaaatcgaggaaaaaagaaactctaccgtcgggtaaatacaacaacacatcatgtttatcatcatggtggtgaataccgatgggaacgtaccaaacaaaaattgatcagggaagatatgccgcacttccttcccatgaaaagtaaacacagacggggcttggattatacaccgttgtttatgtttctattgagtaaagttggtgaacaatgggatgtgatctatagtgaagccattcagagattagatcgggtagatcctgtattttggatagtcgctctacatgaaaatgatcaacgggattatattcgctgcggtgaatcaagttattataacgggctgtttgtcgataaatccggttttttaagaaaggtcaatccccacttatccgcaaaggatattcctgttctgtgtcaatgttgtactcatacctttaatggggttcagataagccgctaatgcttgtaatttctccgataaaaaaaagaattaaacgcagtatttgagtcctgttttcggcatgttaccgctttcactatcaatgaaaagagtaacatgccagtgcaccccaaaagtcatttttttctgctcagtaaagcaaagtcctttgttaccagcctattgtgcctgtcacttagtcttaatggttatgcagattcagaacctaacaatcggaacgatactacaatccagcttgcggagatcacctcccaatgggggcaactgacccgctcacactcgtccggtgaagccgcaaaaacactggcagctcagcagttctcgtccgcagtgacatcaacactgactccgtggcttaaccaatacggcaatgcccgctttaccttacctttcgacagccgtttttcgttaaaaggcatttcatttgattggttgttaccctggtataacgttacttctagcacggccttcagccagttcggggtaaaaaccgatcacagacagacgacaacctcggtgggtttcggttatcgctatctaaccgataactggttatggggtgctaatgcgttctgggatgcactatggccggagcagtatcaccgttacggtatcgggacagaagcctggcatgataacgtcaaactctctgccaacctttaccagcgcttatccggctggaaaacatcccggcaagtcagcgattatgatgcacgccccgccaatggctgggatatccgggtagaaggcggattacctgcgttgccgcactggggcgggcaggtgatgtttgaacaatactacggacagcaagtgggtttattcggtgacaacaaacgtcagcacaatccttacagcctgacggccgggctgacatacacgccagtgccgttagttacattgggcgcggatgtccggcagggaaaacaggatcaccgggataaccgttttacgctggcactcaattatcagctgggcgtcccgctggcacaacagctcgatcccaacgcagtcgcgccgttacgcagcctgacattcagacggacagattttgtcaaccggaatcataatatggtgctggactaccgcaagcagacactgataacactggattttcccgctcagcttaaaggcgatgcaggcaaaatcatcacttttacgccacgaattacctccaaatatctgctggcgcgtttagaactccgggctgatgaattacagcaagccggcggcagaattgttcatcagacgcctgataaaatcatgctgcttttgccgaaagccatcgataaagtgatccggctttccggcattgccattgataaacatggcaatcgttcccggccatcggaaaccaccctttttatccagccgacggaaatccatgtgcaggttaccgcaaaccgggcgcaggcaagggcggacggtcaggacagtgtgatgtataccgtgatggtgaaagatcgtgacggtaagcctgttcccgatcaaacggtgagctggtcaagtgacaaaggcaaactttcacaaaccacacagaaaactgatgcacaggggctggcggcagtgttgctgagcagtcatcatcacggggagcatagcgtacaggtctcggttggtgataatgtcactgtggctttgccggtgcacttcagcgcggtattgaagcctgttatcaccacagacaaaacgcaggccagagcggatggtaaagatgccgtgacgtttaccgttaccgtaaaggatgctgctggtatccccgttcctcaccagtccgttaagtggcaaaccagccggggcaaattcctgaccttgccgtcaacaaccaataagcacgggcaggccactgccgcattagtcagtttgccctccggtatcgcagaggtgtcggtgatggcgggtgaagagacgttcacggcttcaccggttgaatttttacccgcactcacccacacgttgacctgtgacaaaagtacggccattgccgatggacaggacagtgcgctttgcacaattgacgtgcgtgatgcggctgaccagccgatggtggggagggaaatcgtgtggtcaacagatcatggccagattggcgatgaacaggttatcaccgacagcaggggaaaagcccgggcacgggttatcagccggaaagccggtgtcgcccgtgtccgcgctgacatgtcaggtaccatcatcacggcgggcggggtcacgtttgagcgtcagttgaaatccgttatcatcgcggataaaacccacgccaacggaaacgggcaggaggctatcgtattgactgcgattgttgaagatatactggggttaccggttgaaaatcaggccgtcatctggcacacggataatggcatcctgtcatcagcagagacccgaaccgactcacagggattgacacaaattcagctgaccagcaccgttgccggtgcgcaccgggtatggatccaggttgatgataagacggtgaccgccccgacgctctggtttgatgatgtgctgacatccaccctgcgtgcagataaaacccgcatgattgccaatggtcaggatagcgtcatattgaccgtgacggtgaaaaacctgaccggacaacccgccgtcggtatccctgtctggtggcgctcggacaacggtcactttacagacgctcagattgaaaccgatgaaaacggtgaagcccgtgcgacactgcgcagccagaaggcaggtacagcttcagtaacaaccattattgatgaccaggaagttatctcgccaacggtggaatttatcccgctattacgtattgccgataccgttgccgttgacagtcagggcggtaatgccaaccagaaagcctttggcacccgggggccttcagttttctggcggggcgcgaaatttcgcattatcatcgccgataatacaggccgggtgaactggcagagtgattctccggcggtcacagtatccggtgatacggtggtcgtacagcaacgccctgacggcgtgagactgacaggtaccgatgaagcagagcagcaggtggtactgaccttaacaagcgatacctggttcgagcgttcaggcataacgaaagatttttattttaatgcaacgcaaatttgccaatcactcggcagccagattgcgcccaaatatgcacttgaacggctttatgaagaatggggaaatttttatcactatgagggctgggtgagggagttttatgtggtctccacggattatctttctgccagttccggttcaatggatgcgcagacaaaatgggcattctgggcagaatcggatagctggatgcgtaatgcctggcatcggctggcgtttgcgtgtggaagctaaggcggttctgtgtttacgtgattttgccaaattgatccatgatgttgctcctttcttttgtcaaagaatagactccgtttgaggtaatggcagagtctatttggcaggtggaatatgcaatgtcattggtttggtctttctatagcaacaggccaaaccagaagataaatattcttctgacgctttatcacatgagtttctcatcctgaatatggatcatattcataaaaacttcgcataaactcacatttttaggcacaatggtgctgatatcatatttttttgggctaaaaagaaagggaaaaagatcccggccattctcaagttttctagttttatcgagcgattcaaagtagttgtagatctccgataccactgttttatgtatttcacttttaactaaatcatctctctgatatgggctttcatagtgtccgtagtacagtttacgaagataaagaatattttcctcttcgttttcatccatgggagacctgattaaagccataatttcatctgtgcgatcttgcttgactccggtaaaaaaatcattaatgcactgttgtaactgaggtgtgcattttccctgtggtttcggtcgttttacttcttcaaacgtgaactgttccgccgacatgttcagcatatccgtcatgatatttttaaattcttccggacactgggtttgtttcacttccgcataaacacagcggccaaaataaccggagttgtgggtgtaattgtattttctgatggtcagaacataggttcccggcgggggttcataccctctgatttcggaggattcataggcaaatttgaagtaaatcccgttttttttgttataaccgatcaggtttctcgcagcagcaaaatcggcgacagtacacccatgatcgcaatagaaggggatttcgccattaatgaaaagaaaccagccttccggaaaggtgatttcgttttggattgagtttctcatgtattgtcttccttttcaaaatttatgattgtaaatcaatttcattgaatataatttaagctaaaaaaacggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccaaaaaaactcactctcttgacctagcatatacctcaagtagaaagagtaagatgatatgtttaggagccttatgtgatgacaattaggagccggaaaatctcggggatctgtccggctttatgttatacagaatgtaagtttatttcatgattgtacttatggtaatttccttttcactctttttctactgcttccaatatcatatccataatctaaacaatagtttttaaaagcctcatcaagtggtactatttttactccacttattttcatttttaaaaatttctctacggcagattcagaaaaaatcaaaaaatcagcaagtaaggtactacgtattgtaaatacatcaatattactagggttgttaataattaatttatgaggcatcaaagaaccagaacgatcttcttctaattcagagttgtttaaatccaaaaaatcgtcattgcctataaaatagagataattcaaatcatccctaattacacttccatctttaattgatgtggctatcaaatttttagatataatctcgcaggtttttaattcattgaaaaaatcaataaatttattggatgcaatatgtccggaaccatgaaaataataattgaaatttagagcgcccacattcctattgcataataaaaacaaactattcggacactctaattctttcatgtaataagggaaagagtaatctgaaccttcataatcccagttttcgttcacttgcttctttgtatcaacaagagcatgaagatatcgtggaattaaagaagacttgtaatcattcattagtacataataattcattaatttagtctcttacatggattagagggaacatcacctgaccaaatcttatttttcatcttcatctggagttttcttatctcgtctcttgcttgacggtcactaaggttaccggcgtcatgtcggcgtttaatttcttctatactctgtcttacctcaccagaatatgtattgtgattactgctatggaatactttcatccccttaccaacatcatcctgcattgcttttttactgccggggatatgaataccattttccacagagttcattcttccgccgataccaatcttatccaagaatttcggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgacccccaaaggctgccaaagaacctttcaactcaactatcgttacaacggtcataaaccgggtatgaaagaaaaaattgtggatatggcaatgaatggctctggcgtgagagacacaggccgtgtattaggtctcggtatcaatacagtgatgcggacattaaaaaactctcgccaaaacaagtaacatcgcgacagatcgcttatgacgatgtcacacttatctgtgaattggatgagcagtggttttttataggcaataaaaaacaacgtccaagaggggtcaaacgtcaataaacactataacgaaatacagttgaattattaattatttggtatttatataaaaataataatcatggacaaacttcaaaacactaagtaaatatagatagtctgtaatgatttcgaatacatcaacgccgtttgcagcgacttcatttcaaacatgcgaagcttttcccaatatttctaaaataataagaggctgattcatggtaaaacacatcgagttttccacgtcaggcgaccctgaggtgatacaatattgcgaatttacccctaccgcccctgctcctgatgaagtacaggttcagaataaagctattgggattaattatattgatacctatatgcgtagtggactatatccaacagcaaatctgcccagtggcctcggaaccgaagccgcaggtattgtgaccaagattggctctggcgtgacatccattaaagtcggtgatcgtgtggcttatgctcaagctacccttggtgcttacagcgaagtacataatgtgcttgaaagcaaattagttgtactaccggacgcaatctcattcgaacaggctgctgcatctcttttaaaaggtttaaccgtttattatctgttctataaaacacataaaattcaagcgggagaaacttttctgttccatgcagcagcgggtggtgtcggattaattgcctgccagtgggcaaaagcattgagcgcaaaattgatcgggactgttggctccgatgaaaaagcagcccttgccaaagcatcgggggcatggcaaaccatcaattacaaccgtgagaatattgtcgagcgcgtcaccgaaatcactggcggagaaaaagtgggggtagtctatgattccgtcggtaaggcgacatggctcaattcgctggattgcctgaaacgacaaggtttgatggtcagtttcggtaatgcttctggaccagtgactgggatagatttaggcattctcaatcagaaaggttctctgtttgtcacccgtcctgcaattaatggttatatcactacccgtgaagaactgaatgaagccagcaaggcgctgtttgatttgattgccagtggcaaaatcaatgtcgatgtggcagagaaccagaagtttccattaagtgaagctgcaaaggcgcatcgcacactagaaagccgcgtcacccacggctccagccttctgattccttaattccacccacaaaaatggcagagcggatcacatccgctcagtcaccatctccagtgctttttccaccaccataatatcagcaccggccttatgggcattctcactcaagtggcggcgccactgacgcgcaccgggaattccctgaaaaattcccaagatatggcgggtgatgtgccccagataggtgccttttgacaattcccgttcgatataaggataaagcgccttaatcgcattaatggtgttcaccaccaatgccgtttcattaaacaactcacgatcaacatgcgccagaatagagggattttggtaggcttcccgtccaatcatcacgccatccacatactgtaagtgctgctttgcttcttcgagtgatttaatgccaccgttaatggaaagagttaattgtgggaaatcttttttcaattggtaaacccgtggataatccaatggtggaatttcacggttttcctttggactcagacccgatagccaagccttacgtgcatggataataaaattatcgcaatcactgtttttcacgactgtatcaatgaaatcacacaagaattcgtaactgtcctgttcatcaatgccgatacgggttttaaccgtgacaggaatatccacaacatcctgcatagccttaatgccgtctgccaccaatttggcttcccccatcaagcaagcaccaaagcggccattttgcacccgatcagaaggacaaccaacgttcaaattgatttcatcgtaacctcgctcctgcgcgatcttagcacactgcgccaacgcctggggttcactgccgcccaactgcaatgccagcggatgctcctcctcgttatacgttaggtaattccctttaccatgaataatggcacccgttgtcaccatctcagtgtaaagcaaagcttccttactcaacagacgatggaagtaacggcaatgacgatcagtccaatctaacatgggggcaacggagaaacgagaagacttgaatttaccagcactcgttgatatggcagtgaattcactatgtttttgtatatgtgtattttcgtgcatttaaggttattttaggctatttttggattattggcaccccatatagaaccccattaatatggggacctgaacaggagagcatcaaagatggcctactatagcatagaaaagcgccctcgcgcagatggcaccacccgctatcgctgcaccgttggcgttaaatctggtggtaaatatatttacagagaaaaccgcacatttgggaagcagtcccacgccaaaacatggggtgctatgcgggttgctgaactggaacaaaacggggttcctacgcaaaacgataccgaagagttgacagttggtgagctgctatataaatacatcaatgacccaaatctaggcgtgaaagcaggaagaactaaaaagtatgtattaaacatgcttctagatagtgatttagcaaaattaaccctaactgaactttcagttagtcacattatcgaatattgcaagcaaaggcattctactggtatcactccctcaaccatcaatcatgatgtcagctatttaacgtcagtattaaaatcagccaagccaatctataacatagattatgtctcaaatcccgcatatgaagcacgccctttgttaattcaaatggggcttataggaaagtctcaacgccgtagcaggaggccagtgcaagatgaaattgacaatctcattgaaggattgcgcaagcgcagtagtcatagagagggaaaaataccctatgaagacattttgaatttctccattcttagctgcatgcgcataggggaggtatgcaaaataagatgggatgatatagatgagaagcaaagatctgtcatagtcagggacaggaaagacccaagaaagaaaacaggtaatcacatgtctgttcctctactgggaaatgcatgggaaatagttcagcggcaaccaaaaacgagtgaatggatatttccctacaattccaaaagtgtaactgtggggtttcagtgcgtccgtaatgctctgggtattcaagatttacgttatcacgatctacgcagggaaggagcaagtcgattatttgaggctggcttttctattgaagaagttgctcaggttactggacaccgatctctcaatgtattgtggcaggtatacacagaactgtacccgcaatcattgcatgataagtttaatagactgatgcagcagaaagagaatgattccacctcgaccatctaaagaaaagcgcgagattgtggaactgcgggaaagaagctactgtcactatagggcagaaatctgccctttagcatatggggtatctgcacaaacaaaaggtattgaggaaatcccaataccctcacccgtgagtataaaaccaaagtaggcattccgtttgaaacggaaggattgaattaaaaggtgaaaaattcccacctttagataacttgttgattttgcttatttccggcatggggcgggaatttaattaaatcaagaggttaaattaaaggggaggattgtcccctttaaactcatagtcttatcagtcagccataggcaaatagattttgttaatgtcccaccaaccattccatgccatcctaatcagaagttctctccagtattgatgaacctttttattgatgttcaccggcggagaagtaacccgccttcatgttttttagcaatgttattgttgattaaatgagggaataaattatgcaagataaaaagcctgatgtgcctgtctcagaagatagcaatctcgttattgttacaacaccggaatatgtcaaagattcaatcaaagaagccattgcagcacacgccacaagccgtaaccatccttatgcaactcaggcagaaccgggatttgtcactttaaataatgaagtcaatagcgatagtgagttaaccgtcgcaacctctaaagcagtaaaaacggcatatgacctcgccaatacagccaatcagaataccaagagtgcaaacgagagcgctgataacgcaaatgataatgccaatactcgcttagcaaaagaccagaacggagccgatattcctaataaggaagaatttgttaaaaacctcggattagagccaaggatggaaggattggctttacctgttggcgtccccgttccttggccaacagagagcccacctgaaggctggttgatatgcaacggtgattcatttgataaagtaagatatccaaaacttgctattgcttatccatctggaaaattacctgatttaagatctgagtttattcgcggtgcagatgcaggacgtggaattgatccaactattaatgtgttatccgcaaagcccagccaaatccaatcacacacacatgattatcgtgaccgatattatagcgagaacagtggctctattgatggtgctacaaactgggagtggcaacctgatgggtataacaattccctaggttcaggtagaacggataatgacaataacacatttctgtattataacggcacgaccagcagcactggtggaactgaaacacaccctcgctatatcgcatttttatacatagtaagagccgcttaaggcgatgcatatacaactcataccaacccgcaccttcctgcgggtttattgccatgcttcggcttttcatctcaaatcccacaccaagcccacccaccagtttaccgcccacaatttccccaatccacccaactacccgctaatctcccctattggctatttattgacggctgacgtgacgccgtactcctgctgaggatcagatgccaatacctgtttctggttccagatagaatcctccggcatctggacgcggacgtctaatcgggtgccggctggtaaatcacagggttcatcatccgtgtaataagccggctcatccactgacttcatgcgcctgttctgtaatcgggcaggcatatgcgcgttctgtctgtgtgtgactttgatttcaatagccccatccggcagcactttatcatcaacatacactaactcattgccattgacgtcacggggaacgctgataccgccatgaacaccccatgcaccgtctgagttatagccaaggatgccggatagtttgtagtgaccgaggccgagtctggtgactgtcgccccttcggattcgtcgttagtggtaaaggtgccatcggggtagatttggatgatgggggaggctttcttgagataaccgctaccgtcaaaggtcgtgtttttggtcgtaataaactcaattttatcatcccatttgccatagcgtcttcgcctataatacagggggacggagcctaaatcgccaccaataatgatattgaattcatcatcactgaataaagatactgctatctgtgtatacgaatctgtccatgaaacagatgaattggcattgctgttaaaaaatcctattgttttgattttgttaaacccagataaatattcactggttgcggaaacatatgatttccattttgtccactgattaccactccgataacgactagccaaccctgtatcatccacctgaatttgtgcgatcattcctgtgttatccataccgccaccacgagtcatggccataatgggggcgtattcgttccagaagttttttgcactactgccccctcctgcataccagccagcctcagccaacgtatttgcatccgtaaaggtcttcgctgttgatggcgttgcgcccacaccgaaatcccccactttcaacgttcccgctaaacccaggtttttcacaaactccggcttattcggaatatctgccccgttctgctccttaaccagtttcccttccaccgccgtctgcaatgcccggatggagtccagcgtgactttctgcccgttcggcatctccacttcgaccttgccgctttcactcatccaccggtccatgttttgcaggaacaagatgatataggcgttaatggcgcatatatgccggacaccatcggaaaccgtatcgggaacggtggttgagataacatagtttgcattatcaaggttgaccgagggtgcaaaggccagcaccagttccgtgtctgaattcaccgaccggatgacattctgaatcaccgtattaccggattgaatggagataatctggcctgcggcaatgccgttaatattggatttccattgggtgcccgttccccggacaatagccgagcctgacacgatatttgttgtgccgtctgagtagatcataataatttcctgaaaataggatgcaaaaaaaacgcagttacgcggttcggttaatcgtagagcgtgcaatcaatataagggctggtcaggttccatgttcgttcactgataatccagttcgtctcaccgtctgccacgcgcgccattagccgggtattgtgtccatcaaacgcagtggaaaatgaagtttcgttatcccgggttcgtgtatcatcgggcgtatcatatttggacagtatccaacccgttttctgcattaatatgccttttttcccttgcaccacagtttctttgctgctgtgggaactgagttccccttcgatactcaaaggccttgtatcgctggtaatgacacattttcctgcttcgtcccagacagcaattccccaatccgggacaggctggggataaaccagagtgaacagataaatctcacacaagatcgaagtctcagtgccactctcgccccgggttatctcaataccccattccgaaccgcccccgaacatgaccccataaggtgcataccagacattgctggtgtgagcacacataaacgccatgcagggttgtttcgtgctgatacccgtttctatccgcttcacgtatctgtcagtccagaccgattcttttctcacaaaagaaaggggggtcgttttgggtgtccaccacggaacaccgttacccgttgttaaaaatgcaccccaatccatatatcacctcacgcagtgtagtaagcaatcagccatccctcaacggcgtcgtcgttgccatccgaaatgatgatttgattatcctttaccaaaaattgacgttttttatctacctggtatccccggtcagtacaaagaaagacataagaaagccgcaatccttcattcatcggctcccgggggacagtgagcgcacctgtcgtctgcccgctctccagcttcataaagccagcataaagaaaggggcgaatgccggtattacgctgccgcccctgttcatcccagaccccaaacccgtaatcactcatcgtcgaaattgtcctatatagcccatggccgcccgaacccgtccgctggggtcatagcaggctatcgccccgtttgcccaacgcaatcccgcccgaacccgcatgtcgttaaattcaaaagcgccggtcgccgcattaatcaaaaagcccgcctgatactgcacgtaatttttagatctgatggcatcagacaggatagcctcccgcattaaggcctgatcaataaacgcctgccgaataaaaagctgcccgttcttagccgccataaagggttccatcttgccgctggccggattgaaccagacgaagttgttagcgttaaagccgatattggtatgcacttcgccattcttcacctcagcccctatcaccatcccggctttatagagctggcctttgtacttcaccccggcttcaatctctttgagggcatagccgttaccgtcaatatcaaagaccactgtcgcctttgtctttacagccgccgcattctccccgacatcggcctgcaccttttccatcttctccgcaaaggcttcccggtcggtcacctgcgtggttttgacttccagtatttcggctcgcatattgccgtttacttgcaactgtcgctgaacaactgcccctgtcaatgcggcgttctccatgatggcttcggagttaaagtccatttgagactgcaaccgttgtcctgctttgttggaaagaaattccttaccggctgcatcaatgatccagttcgtatccgaagacgactccccacgaatgaacgccgtccacggggattgattgccggatttatccaccagacgcgcacggaaataaaatgcaacgcctgccgccagcccctgcatcgtgtgcattcgctggggatagggaatatcggccagcaacagtaaaccctcaccgtcattcgtcctgctgtactggatttcagttttcagtgtgtcgtcggtctggggcgcaaaaccccagtcaatctggataccgaagatgatcggggttgttctgaaccccagcggtgccggagggttgccctccttgccttttaaacgggtttccggtgcattcgcccagagactggatatctcagcggcattgatcgcccgtactctcgcctgatagcgtccggcgtagatattgggcacttcaaagccctgcgtcgaggtgcggggtgcggatatccagttgccattatcccgtcgccattcagcttcatacgcgatcgcactctcggctgcatcccaagtgactctcagtgtcgtgatggcaatcccctgattgaccaccgaataactgctgataccgacatttttcggcggcggctgaactccgggcggaataacggaaatggggcgcacgtctattcgggtgccggtgtcgatatggtcatatttatcagggttatgctcaatggcggtgatatcgaatgacacgccgtcctcaccctctttaatgccggtcaccctgaattgctggacagccaaatccgaggcatcaatcgcccagacattttcagtggcgggtagctcggagtattccgtggttactgtgattgtctgcccattgacagcctgaatcgtgcgcccttccgctttgccagacggcaggttcaggattaaccgctcaccgaccttcgcagacgataccctgtcgagggtaatattgcgcccgtccaccgcactgatacggccacccagcacacggccggaaaacatttcatccgccaccccgataatatagccgggcaaggggagctttccatccaatcccaccgcaaacgacaccatccggtcatattcattggtgtgcagtacccatttcccgcgccgtatcgcctcactctggcgggtacagccaatcgcggtgatatcggcctgtttaaccccgaatcggcgtatcaggcggttttcgaagacgggttctatggcatcctgatagccgttctgtggatctgaccagctcaccattgcggtagagtaatgagttttctcgctggcactggcataggtaaacttaccgtcacggacattggcacgggtatagatataatccatatcgcgcggcatatcggccagcgcattcatgttgttgtttgcccagaaggtcatgccccgaaagataccggcaatgtcacgcaaaactgtccatgcgtcctcttgtgactggatatacacattgcaggtaaatctcggctcctgaccgcccttaccatcaggcacaggctgatcacaatactgggcgatacggtacaaatcccattttgccagcgcgaggttttcagctttcacccgtgcgccgatactgaaccggtcattaatcatcaggtcatacagtacccacgccggattatctgtccatgcccatttaaatgacccgtcccagacaccggaataatggcggctctcagggtcatagttggccggaacgcggataatgcgcatcttcggctcacaggatatctggggaatgttgcggaactgtttggcatcaaactgaacaaagagtaaggcggtttcggggtagctcagtttggcgtcaatcacctcggtgatcgcctctaccaccatcgtgtcaaatatgcggacgctggtctgtttgggggtcaggcgacgaatgcgaaccatccaacccgtcatcgctttcggtaaatcaatgcggtgtgaccttgggtatttggttgtcgtcttaccatcggcagctgtcttcaaaacttcctgatacgccccgccatcggtcgccacatctatcgcgtagtcaatgacatagccgaccgtatccccattgtcttctttctgttcctgtaatggcccccacaaaagccggatgcgaaccgccgacaattgggtattggtcacagatcgcacccatgactcaactaactccgtgccaaccgtaatatcattctctacggcaggcatccccttaatgtaatcctgatggggcgtaccggggcgaaattcccattttaatcctgtaaagtttgcctgaccatcaggaccaataatcggcgtgttatccacaaagatattggtgccgtccagaccccctgcaaactccccttcaccgagtgccagtaagattttggcgtaagaggtcgattgtaacgaatccggcgactcgaccggagtgcgtggactttcaccgccgcccttactgccctgaataagatgattagccatatttcacccataaaaaaagccgccgcagcgaccggttaagactattgacgtctattgctgatcttcggcatagatacccgccgagataatggcaccgcctattctgcgtctgccgtacccaatgggaaccggatttccctgtgcgatggagttgactggcccaccaaacgcataactgggtttattgtcgggatcttcccgtcgagccagtccgcccggcatcggtgataacatctggactacgccccccagcatcatggagaccccggacatcacgagcggaaccccatacggcgttgcccatgcaaataccccggccaccaccatcactgcaccgagaatagtctggaagatacccgcctttttgctgccaatgatcaccggtacaatccgaatgtcgccctcaccggataattccagttcatcacggctgatattgcgttttccgatgaatacggcaaaagtcagcccgcgctctttagcggttaacagaaacttttcgaagccgtcaataatgacagacagcgccctgatagcctctatgggggatgagactgccagcttatactctcgtccgaattggggtatcagcacgccagaaagccgtattgttcgtagtgtattcatgaatttactccataaaaaaaccctccgaagagggttgatattaaagaatacctgatatctattttagcctttctttataaacattcagaaaagacattctctgattttcatttaattcagacgataacctgttaatctcggattgaaacgctttcctagccgaaaatatagataaatttttagtttcaatttcttccatgaatttcttatatagctttgccatcttctcaacatttgaatgattaacgtacccacttttggacaccacatcactagattgtaatttttttaattcattcaaataaaatgaactaatatctgagtttcctttatcaccagataacaattcattttgtacttttaattcttgtagtatttttttctggatatccagtaattcattggctctggttgcataccgcattataaaaaaactgatagtgaatcctattaatgcactaattactaatataaacaaaattcctgcaagtgaaagtcccggatcgtaatgactgtacatacaccctctcaatttgtcctatttgcataataatgagtgtaatcatttagaaacgaaaaccaagctatttcattttatataacgtaaaatgatgaccgttctctcttgccaatatccactgtaagacactcggttgctaagctgcccatacatatggtggatcatcagcccatcaccgatatacactccggcgtggttaggttcgttggcctgtacctgcatgatgatcacatcacccatctgcaagtcaccactgcattcgatgaagcctgctgaaacatagttcttcatatacaagttttcgccacgctcccaccagccatttgagcgctcaaaatcagggagttcaatattgcgttccagccgataccaatcacggacaatggcgtaacaatcccagataccatggacgaacgggcgacccagcaagggcttaatcccctcagtcggcataatggtacgaatatcaccctccggccatgagacaataatccacggcacttgtgacaggtcacattgggcaatatctaactggctgggttgtgtcgtggcatcggggtgactgtggacaatggctataatagtgccggcatcctcagcctcagcgtaatcttccgggtgcatactgaactgctctgtcggagacggtgcggtattacggcaacggatatagtgctgtttgcgactattttgaatcaccagaccacagcattcttttggatattctgctttggcatgatccatgatagcttgagtaatatgtgggcgcatagaggctctctgggtaataaaaaacccagctggggctgggctgatttgcttgttcgagatagtgactaagagcgagtctgagatttctgtatgtcttcattttctttcagttttttttctaattgttttgcgtacttctccaaattgtgcatatcacatttcgcttttttgagatatacctctacttcacctttgctgtattgctgtaattcactggcagatttaactggggtagtttttgttctttgaattaattcactcaatcccttttctgaatacttggggcatccttcataccaatactctttctgagccatcgcatatgaagatgaaaataacaacaccgcaaaaacaaaaagtgaacgatatttcataccattatcccatccgcaataagttagattggttatcatatcacctatttatcagcaaataatcaccgccttaacaacgctgaaccggggaagccaccaaacggaagctgattgcctttcccgaagcgcagctcgcatcctgttgacaataatccagagcaggcatctcgtgatggatcatcggttgggttcccgtcctcatcaaaataccgatcaccggtatagttacagggggatttgcgatataacccgcgcatacaccatgtacacagaccatgaatctgacgggtcggtattcgtatcccttgcagatcagccggggaagacaaggcaaaatgaatctctgtattgttttcatgcgtcttactgtcaatatagtagacgtctattttttcctgtgtaggatcggcttctgggttgccatcggcaaaattacgggcatccagataatgcgcaaaggtcatacggatggtgacacgcgcctgcgccatattctgatacgccagacacatggcgctgatagtactatcgagattggccacactgagtgtgggtgaggcggcactgccatcactactaacccccaatccttcaattttgacaggccacggcttatactcctgcccttgccaccagatagatttcatcggtaactgatcagcgctttccagttcatcttctgtgtagggaatagggtgattgtgaaaatacagttctggcccaccaaaggctgagccatcgaccgaaaataacaggactttattccccggctcaaggcgctggagatctgaattgattgtcatagagaaaccttctacggatgataaacgcgggtgaacgtgacggataacgtgaaataagccccactggcctgtatattgaattttccggcctgatacagtcccaactcagatagcgggttacgccacttgaacgagcgccagccctgatgctcccgcagaaaatccataatgggcgctatttctgacaggacacccacaaatgacagcggccaactctcccgctgtgagttgatcccatcgcctgatgtttgcttatacccatcaccgaactgaacggaacgtaccacgggttcaaactcgccagcggcacccactcgtgcgggaaaatcgaatgtttttatcatcttctgcctcctttgatggccacatttaaatcaccgccctgacctaaacttttatgcagtaatgatttgaatcgctgatcgacaaatttcgcaatatcctgacccgctgattcaaatccgctggttgttttcacttcactgttcttctctggatgcactacgatatcaaccttgatggtcgtttgattacccgtgccgcctgctgcacgaacaccgagagcaccatcaggtccccgttttaatggcagaatagcctccggtcccgcctcccccatcaaccccgcgccatgggcaaatttaaataatgtgggattactcacaacctgcccactgtaagcactgagacttggggaggaaagaacaccccctttagcaaaagctttgatattcttgggcagcatcggcacagcctgaccgttcgccagtgttgtttcaccgccacccgtgcccccgaaaaaccccgagaccgccttggtgatcagtgcctgcatcgcaatacgaaccagatcctgaatgatggattgtgccagtgatgccgacagttctttcatggattcagagaaggactttgtgcccatcagcatcccggttaaggcgttccctgtccgctgttctaccacatccagcaggttcatttgcattgcctgaaagtcaccctgagaagcataaagctctttggaagccgcaaactgcgattccttggacttattcgtagccgcagccaccagtgcctcatggcgctctctgctgataagcccattgcgataataggcatcgtacagcgcggtttgctgtgtgagctggttttgtagttgaatgacaggatcaacttccccgaccatatcaaggcggggagccgccagccctttagcctgttccgccagcttttctttaaccgaagtctggtacaacgttttactggctgacaggtattcctgctcggtcagtaaccgggcatcataaatggccttgagttcctgactggcttctttttcctgacgggtcagggcttttgccggggcgtatttctcagccagctctatacgttgcttctggtggttttcggcattgaggttttttaggcgtaacaattcattttgggaaaccagacccgacttaccgacctcaatgagtttcccctgaatttctcgctcactgagaataatgcgctctaagctggttgtatgggcttgctcaatttccttgcgcaattgctgatattgattaagaacctgtttcccttttttatcgcctttatcattgccgcccgctccttctcctgtccatgggttgttgttaccgccttcgggtttagggggagagggaggcggtacgtcaaattttcctacagaaaaggtttgctctccattctttattgcttcttgcatttgctttattgacgcataagtatcttccagcttgctcagtgtttcatttcttcctttaaggagagttttagagcttcggttaaaaagacgaccaaatgcattcttttcatgagacttggcgagattaattttgatattagaatacccccccatcttactttctaactgttttttctcgccctgtagtttctctagtttttccttccagtcatcaatctttagctgaaccttaaccttggaaagcctttgcagctcttcaacagtttcaatcgtggtgtcttttaattgcctcagcccctctctcgtttggacgctgtggttatacagaccatacagggcagagcctgccagtatcgcggcaccgaatgagccgcccagtagggacagtgccccgctggctcccgccgcagcgcccgacatgaggcgggtcgaataggataatttacggttagcctccgccagttgcttttttgccgaggtttccgtaatgattgattccctgattttacggctattggcgatataatccttttgataattaacataaacgccattctgcttattgatcacactttgcgtggccatccattggctttgctgggcggctcgctcacgttctgccctcgcggattcaatcgtgcgcttagcggtttctgcctgctgtttagcggcgtcacgggtggctttttccgtcgctttccatgcgctgacattttcccgtaaccccgcggtcagtttagtcgccataacagggatcagggtatgcagggcaacggtagccaccatattgaagttttctgacaggccattgatggcactcgttgccccctgaatgcccgagcgcaaggggccatctgcactgctccctaccttaaccgccagcccttcaaaggcgctgcttaaaacatccagatcggcactgaggttattggcgcgggttgaggcctgttcatacgcgacctgcgtcccggtcagtgactgttttagctcctccagcttgcctcttcccacgactaattttgacgcggcgctgacattggcgcgcccgaacaatttggccgcctctgccgtggacagcttcttgcttttcaggtgatccagtgccgcccccagtcccaccacagacggcttgagttttttatccgtggatttctccagcgccagtatgacgttacggatagccgtacccgcctctgcgcctttgatccccccggcggccagtatctgaatgacggcattcagctcttcaaaactgactgaggcctgtgccgccattgtgccgccgtttttaatggcctgcgcggtttcattgatttcggatgagccgtatttagcccccgctgccaacacgttgatataacggtcagcctgctctgcggaggcgccaaactggttcaatgataaagccagtgccttggtcgcttccggtaattcgatacctgacgcctgcgccaatatcaccgacttttccgtcgcctgtaccaatgcctcggtgcttttcagcagttccggcttggcggaggccatcagtttcagcgcggtggcaatacgggttgccccaaattccgtggttctgcctaactgctgcgcggcgtcatccagtgtcttcaactgcgcccccgtcgcccccgtaatggcggacagatcagagagcgcctgtccgtatttacgggtcgtattgataatagaccccagcgaaaagcccaccccggacagcagcgccaactgaccgcctacggatttaatcgacttgcccagcgagtggtaagccgactcggccttcttcgcgtcagacttcgccttaccggaaaatttttccgattcccgtccggcgtgacgataggcctccgtaatctgcgacctgaacgagacggcattgaccagcaggccaacggttaacgtcgataaatttgccataatttaacctaataatttcatgaccgcctcacactgcgcctgttcggtatcgcggggaactgggacggaaacaggcagggcttcacccgggcggggtcggtttttcagccggtaatacgcctgccactcattgagcgtagacgcaggcagggacaggatctgataggggtctatctcgccgagctgctctgcgagggtaaacgcaaaatgcagcagcggcgaccgggttagtttttttcggcgtcctccagcgtaccgatggaatgccgtttcaccagattaatcgccgcaataatggtggcgttatcgtgggtatccatcagttcttcggctgtcggtaaatccccggccgggatcggcttacctttgtcatccaccaggcaatccagcacaatctggacattcagtcgggaggcttcacggccattgccggcctcactgagtttttccacggcgtcttccaaatccatcaattcggtagcggtcatacggcgaaggttgacggcggtaccgaaaatctccaccgctttcacatgggcgcgcggggctaacagggcggctttcaggtttttcatgattcacttcctttggtgagggttgtggcgataccccagacgaggttgttttgtttgcccttgaccgtgatttgaatcacttcactggcgggggcgttgatgtcattcatctcccagccggagagcgccagaatcatggtcgccgtgcgcttgttcggcaggccgatgtaaaactggacggtttcgcggcgctgggctgcattcaggaacgccgtaaaatcgacgttttcaggatcatcaatgaaacctaatgatttctcggggccttccggcatgtcggaaataaattgtttgttggtgtccatcagcgtggtgcagtcgataaaaccgccggaaagacccgttgcgcccagcgccttacagttaatcaggaatttcatctgatcaacggtatcgccgggcttgccgaatttcacaatcgtccccgcaggcaggacggcatattcgggtgatgatgttgccatggtgtattactccaatgaaggttattgactgtaaacggacagggcagcgcggatttctgccgcgagcacctttaaaacggcggactggttgtagtccagagcagggcgtataaacggtttagggacttgtttaatcgtccccatttcctgcgctaatgctttcatccggtgagcgttggcggggcctacagtgatcattaccccgcccttgtacttcttggacttggctgaacggatctgaatgctgtcccgcagatgcggccctttggcctttttgtcatacccggcatgggcgaccatgtcttctttcacgatttccatcgcggctttcccggctttacgcagaatttgggtctggaggtcggtttccagtgcctgtaacttgcgccccagttcttcaaggccggaaagatgcgtgctaatcatcgggcacctccgcataagtgataataaagtcacgggtgatacggtaacgtttctgattttcggtcagctcttccatcgcctgatgcagtgtcccgcgtgtcaccgcctgcaccggataattcccgatatgaccatgccggacggattcccatgcgaaacggattttttgctcaatctctgcggctttcgggtaattattcagggtaatgatcccgatctgaaagcgggcttcgaccaatcgcgtggccgccagtccggtattgaatttcgggtcactgatacgctggtaagtgatcccctccctcactgtggacgggagtatcagcggataaacgggcaatagcgttagccgctctaaatcggccttgagttcacgctctatcatgacgcacatcggcctccgtggtgataatggcgcggtcttgccggttacggtcaaccgtacgcacggtaaagagccgcccctgatgctcaaccagccagttggtgtcaatatctgctctcggcctgactgtgaactgctgaacctcaatcacttgttgctgatcggcggtacggattttgcggttggacatcgcctccgcccgtgcccacgtttcgctggcatactcggatgtcacggtttccgtcccataatcatcccgtgtcacaacggggcgaaatagcttaatacgatggcgcagtgaacccgccttcatgatgacctcctacaagggaatataacggtaaggctccagcaaggacttgaaacctgcgggtaaggtctgcgcctcccggttttcataccagtaccccaccgtcagcataatcgccagttccacatcctcggaggccagcagcccgtcgggatccgtgtccggcacaacgtcgtcataaagacggcggttcaggtaattttctgcccgtttgatggccgcacgggcgtaagtgttcagcagactatcttccgcgtcatggtggctgtcgatacggcattgctgtttgagtttttccacggtgggaaaaggcatcttgcctcctgacacctgcgaccttgagatcgcaggcacaaaaatctatggtccccaccttttttgcaacactgatttttgattgatgttggcttgcttaaatctatccggcgtcactatgggcagggatgcccgcgcctcgatgagttccgcacctgataagcctaaaaaaccgcacggcttcagagagccattttttatgtcaggattccatcaggtcgataagccgttcatgtcatcaataatcagtcttcgcaaaaccagattgggaactgctttaattaacgattaacctgccagtcagactggcgtcgtcgttacctttcgaacacagtttgccgtgttgtgattgcccaggctatccgggctaatttgttggccagcgcacaggccacaacatttgagtgttttcgctcaagctgagcctttacccattcagccagccttcctgactgataatcgattctctggataaagactctggcgcactggacaagtaaccgtcgcagatttttgtctccgcgtttacttatccctaaaagcgtatttttgccacccgtgctgtactggcgtggtaccagaccggttgaagcagcaaaatcccggctacagccatactgcttaccatcgcccagctgcgatgataagacgctggcagttatcggacccacgcccggtattgtctgaagacgctgtcctgtttcatcacgtctcagctcctgctccagtgccgtctcaagctcggtgagctgttcgacaagataaagataatgggcatgtaaacgcatcagcaactgtgccagatagggaggaagttcgttctctgccaagacggttgaaagtctttttatcacggcggttccgatcggcatactgatgccaaattccagtaaaaaagcgtgcatctgattagtggttttaaccctgtctctgaccagtgattctctgacccgatgcagggcgcgcatagcttgttgcgcctctgttcgtggttgcacaaatcgcatggagggacgagatgcagcttcgcatatggcttcagcatccacaaaatcgttcttgttgctctttacaaaaggacgaacaaattgtggagaaatcagcttcgcttcgtgaccaaaagcagcgatccggcgagccataaagtgagcaccggcgcaggcttccattacaacagtcgctgatggcgatcccgctaaaaactccatcagtctggcgcgggtaaattttttacgcagcagggcctttcctgatttgtcctgacagtgaacgtggaaagaatgtttgccgagatcaataccaataagcgtaacgttttgcatgatggtcttctcctgaaagaaacaccctgccagcataccgctcacagggtggtggggaccatctcattaaccgcccgaaactatttatccatggtgaaattaggctgtattcgactcttttacaagcggttatataattaagggacacgacctagtttaaccatcggctaaacgctatcgtcccatcagccaaccgtcattagcttagtgaaaagaaccacaagtatcagcaatatctgaataagagtagccatttccaaagtctttttccaatttctgtcgagtagctcggtaacagcggcgattggagaaatgactcgtttgttgcatatgttgaagggattttaggtgcttactctcccaatcataagaaagtccgattccatttttattctcgaattttttgttgtactgccccatctcttcctctcgtttctccgccagcacgttatcctgtgtcagcgtatcaacattccaggatttggattctaaccccgctctttttttcaggtactcctctgaaggtttgttatcagcaggcatttcacttttgtagctaaaatccagtgccaacgcttggctaccgcccattgataaaataaaaaacaagcaataagctcctttgattttcatatattcccctgatgtgactataactaaaaattattatttaatagccattatgagctcaggtcaacaccccgttataggtagttctatgctcaggataaataaccctttacaaacaaaagtaacttcaacatgcttagttcgattttttattaaaataaagtgagattttgatgcattcataccctatttatcatgtcgatgctttcacggaaaaatccttttctggcaaccctgccgctgttgttttgctggataaatggctgacagatgaagcgttgattgccattgccgcagaaattaatctttcagagaccgcctttctggtaggaaatcaattacgttggtttacacctaaagttgaagtgaatttatgtgggcatgggacgctggcaaccgctttcgtcctcatcgaacaccaatcttgccaagataacccgattacgttcacaagcctttccggtgagcttcgtgtatctcatcaagagggtattttcacattggattttgccgctgctgattgtcacgaagaaaaaacgctcgtttctattatgcaggacgctctggggcaaaatatcaacgaagtgttcgcctcacatgatcgctatatttgcgtgatggactctgctgatcaagttctcaatactcaacctgacttcaataaaatcgctgctcttcccttagctgggcttaccattaccgctcccggtgaatcacctgttgattttgtttcacgttattttgctccagcaaaaggtgtcaacgaagatcctgtgacgggttcaacccactgtgttctcacgccattctggggaaaaaggctcaataaatcaacactccatgcacggcaactctccgaacgaggaggcgatatattatgtaaaacagacggcaatcgtgtttatttgactggaaaagcaaaactcttttcccatggacaaatattgcttgaagaccagtgaccttatgattacagaacggttgcggctgtagtattagctcccctgcaaacaggaacaggtgaccaagttaagctactgggtatcagtaaacgcgggaatacgtatctgaggacactgtttattcatggcgccagagtcgcaacattatgcacgaaaacccccgccgctgtgagtaagcgaactgaaaaaacgccgcccggtcagtgttgcgattgtcgggatggcgaataaactgacccgcacggtctgggcactggttcctcatcaacgggaataccaaaaagattacgtcagtatcagaccttattgaagtatttcacaggtaaaattcacttcaactcaatgaaaaaagaggaatgcagaaagattgcagaggcaagagtcgtgatgacaaagaaaggtgaggccgtgacttgctaaacttgaatggtcaccagagcttcaagctcgtccgggaaataaggagcaggtcagcggattatatcgaggcccgcagtatgagatgcaatctaccttcaatgtcacaataacttttgtcttgcaaacgggatgcgttcatatagtgaccatttcattagccacccgcgttaactaatggcatgggatattcctttaaccactcgggggaatgagtaaagaaatattgactttaattttaatcgttgattaattattgagcgccagtggattattgttaggtggagctaatattattaagcttattaatatttcgataataatgttatacgtggagagtattatgaaaaaatatattctttcttgtctgctggcaggcgttacgcttttatcttcaatgcagtcttatgctctggcttgtaatttttttcccccagatagtcaagcatggaaagcttgcacggaagtctgcaaactggtgtttagcccctcaatttgtttaaaataacatcaaataggacggttcattcctgccgtcctactcatgtctcaccaacaccaccccctaacatactcctgcaaccccagtatcatttgctctgaggttctgtttatttaacctcagcttcgtttaagaatagcgatatcattatcccgtaaattcaagctcggtttttttaggttggaatgtataagcaattagacccgccgcaatttccagcaaaaaaccgagctgactgcgatgttttgaatgctctatctgagaaatatttttgagttggtcgatgaccgtttctatcaaaaatcgccgtcttaacattaacctatcccaaagagataacgctttggctttcatgttatagctaaatcatattaatatgatttagctataattgagtgccggtcagcagaataacctctgctgaccataaacaacagctaccattaaccttgcttgcctaccaacagatttgaattaatctctgcgattgacttcgcacctgtcaatgtcattgctactcgcatctctttatcaatcagatccagcagattggaaacaccggcttcccctgctgctgccagtgcataaacaaaagcgcgccccaacaagacactatccgcccccaaagcaagcattctcaccacatctaatccagtacggataccagaatcagtcagaatggtgatgtcattcttgacagcatctgcaatcgcaggcaaagcacgcgccgttgataaaacaccatcaagctggcgtcccccatgattggaaactacaatcccatcagcaccaaaacgcacagcatctttggcatcttctggatcaagaatacctttaagaatcattggccctttccagaaatcgcggatccattccaagtctttccaggatattgacggatcaaaattatttcccaaccagccaatgtaatctttcaacttggttggtataccacggtatgcggaaatattgccgaggtcatgcggtttgcccattagtcccacatcccatgcccattgaggatgagttatcgcttgcaaaatttgtctcatggaagcattcgggccactcatgccagagtgtgcatcacgatagcgcgctccaggaattggcatatcaacggtaaacaccagatttttaactcccgccgcctgcgccctctccagtacattgtgcataaaaccacgatctttcagtacataaagctgaaaccatattggacggtcaatagctgaagccacttcttcaatcgggcataccgatacagtagataaagtaaatggaattccttttttggccgcagcccgtgctgcctgcacttcaccacgacgtgcatacataccggacaaacccacaggagctaacgccacgggcattgccattttttccccaaataaacgggtttccaggttcagttcagacatatttttcaatacacgctggcgcaactcaatgttagataaatcttcggtattacgtttaagggtatgctctgcataagctccgccatcaatatagtgaaacagaaaaggcggtaatttggcctgtgctgctgtccgataatccgttgaagcggaaataatcataatatgtaccttaatgttgagaacttatttgtgcattttctccgcccagcatcatgatgtttaccatcactaatgcaccaaacaatgcaatgaagggcttgaaaacccgtgatcctgtttcacagaacatctattttacctgatagcgattcagctgaaaaagtaggatgcacaacagaacaaccaacaagaataggataattgccagtgcatataatattttgtagctggcagaagctgatgtacccaacacttgttgtaagttaataatcagagatttactgacattaagttcacctaatcatcccaaattcaattgccactggatatcggcattgttcaatagccccttgatcccctaattggtgaatacgggtagttatcaggatcacaattaataacaaggttggcatcatcgccttgataaccttgtggcaaaccgattaaataatcgtcctcgtaaaacacgagattacaaaacaccgaatgagttatttaaaggaataccttctcatttacttcgtccattacggtgttgcgcttaatatgtgaatccaagtttcaatttaaaaatttctttatcattaacatattgtatataaataccatcatgcttaccgatgctattcagttttacgtattgggttaaggtataccagactcatttatttaacgtgatatcaaatttaaaataatcaccgcaccgtgattctttctcaggataatagagatatcccttcaactctcctctctctcgccacattaagcgactactaaatccatcaaaatcgccattatctatgcaccctaacgggcgatcaccacctgctagccccggcaaccatataaacatccagatatagatatatttacaataaatatttatcaatttgtgccaattacaaggttacaacgctttaatcaaaacctacaatatatatcatagcactgacatcatttatttaaaaacaccaataacagtaaaccacaaattaaattaatattaaatcacgacaataaaatacatgtttttatattattctcactattgacggtagtcaaatcttataattaactctcgttttttaaaatacatcattggtcttttatatttaatatcttcacacaccagatgcgccaatgccccagattaaataaaataaactgagacattggcaggattgtatctcttcattctcatcctgaaacgatggtttttaaagcatcatagacaggtaagagacgagtaaaaccctctctatcaagaaagtgcccagcattatcgacattaatgattttggtttgcaatgaattagccagagcatgagaagattgcggagaaacaatataatcgttggaagaaatgattgaaatacgatgttccgtcacttcacgcaagaatgcatagctcaatggttcggctgtaaaaatatttaattttggcaaactctccagcggagaatcaaacccagaaaccaaaatataccctccaattcggtcagccgtagaacttatcgcttctaaatgccgtaataacgtgacacaaccgaggctatgaccaataaaaattgtatcatcatctgcctttggtattacatcagtcaacatcttagcccacatttcaggtatcggtgccaatgactcaggcattgcaggcaccataacctccgcaccttgctcagtaagcacttcttttaaccaagggaaccaatgtgatgaaggtgaggcactatatccatgcacaataataatctttttgccaaaaaataggtcgctactacttatcatttgttgtgtcattgacgttatcctagtgagtaacattcccactgaatgggaataaaattgtctatcccttcccattctattttagcgcctagatttttaggcgctaaaatttaatctatatcttatatttttaattcctcacgtacagccatcaaagaaaatcctaataaattcaaaccattccacgtcaacggattctcaatattggcaaaatcttctgccagcccgataccccaaatacgatcaacaggactcgcttcgaccagtattttatctgccgtattcaataaaaactctgccaaagcgttattttgagaaaattttgccagattaccttcaatcacgattgccaattgatgatcatcccaaatcgattggttaaacccacaaacttcgcgcccatacgcttttgctgcacctgggtttttagcattgataattttttccagtgttgcagaatcattaaataaacgggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgacccgactagagcctgtaactaaaagtattttttcgttcatcattatcctatttagtcgtattatttgacaaaactcatttaaaataaccaaacgcagataaataagaaaacgcgattgctatttagcatataactatacacataccagttctcaaaaaatcgaaaaattatgaaaatgccagattatttcttaattttattatgctgcctgagaatgccgcattgaattctgtatttcatggttataacagtaccatattttcgttttctggttcggtgtgctttccaatattaccccgccgccggcagtggcggcttcgatagagattggaggggaaattgtgaggcggtattttgcggagctttgaagaaggtaatttttaaattggcagataccggagtagaaatacaaaaatgccaccagcgttaactgatggtatggggtattcctttaaccactcaagggaatgggtaaagaaatattgactttagtttcaggtgttgactaattgttgagcatcgctggcttattgttagaaggagctaatattattaggcttattaatctttttataatgacgttacacgtggagagtaatatgaaaaaatatattctttcttgcctactggcaagcgctactcttttagcttcaatgcagacttatgctcattctcccagtgaccctgtatgctttcaaacacctacaggggagcattgcataatgccctttgttccaccacaacccgtaattccagttcccccctatattccaccggcaaattagccaaattgaatatactaataaaactgagtaggacggagcattcctgccgtcctctcatagctcaccgacactgcgtcctaacacactcctgcaaacccagtatcatttgctctgcggtggcaatgtgttttctgctctcatgatcttggctcgctcttctatctcacccatacccgcctctaactgcaatgccaggtaatacatcctgaatagcgactgtgaggatgatgattgattggataccgttgctggataaggcctttcgccagcataagcgcaccgtggatcgtcatcatccagccggcaacggattgtcaccggcagagcagtattatctgttgactgcctaaaaaaccatcaacacaacttttgctaacctgtctacgttaatgcgacagagccacaatcacccaatcgggcgtaaatcaacccacaacaactggctatccgtcaccagtggcttaattgtaccttcccgtatatccggcaaccaccaagccccttgaccaaaagcaagctgaacacagttggcgcccgtcatttcccaacgaccttttaagacataaaggacaccactgtgcgatgtcggtaaaagatgttcatgggatatcaccgaaatttcggaagcccagcaagagcgacgcgtcatgatattaaaacactggacagagccatccaacaattcagcatgcccgtgaatatcaccagaaaaatggaagggtgtcatttttttcaccagttcgtgctcaagaaaacccggactggtcaatctgatcccctttcccttcaataagacaatggagcgttcaatatcaggaaattgccctaatacctcactttcataaattgacgtgaaacaggctcgccaggcgaaatcatcagaaaccggccagcagacaatatcccttgtttcacctgtcccgcctgaccattgcgttctcggtaacgttgcataatcgaaatatttcattttcatgccacctcctaaccactcttaagccctgtgtatactcccgaaagacggttaacgtcgaattgtcaacaccaacattcgcaaataattctgcttacgacaacataaatgtgattgattacccgcattcccttagtagcgtatgacacaagcctgctaaagttttcattgctgaagcctgtacgtcattccatacaaatgacgtattcaggcgaaaggcgtgatcaaactgagcactagtagagaacatgctgcccggagcgatactgatccctttagtcagcgccaattgatacagccggttagcattgaaaggcggttcaaactccagccacaggaaataaccgccacgtgcactgttcactttcaccgaatcaggaaaatattcgctgatagcccgtaaaacctggctttgccgctgttccaactgacgccgcaaccgtcgcagatgattatcatatcccccgtgagccagatattccgcaaccgccaattgtgttggtgcgctggctgaaaccgtgctcatcatctgcaattgctgaatttttcctgcgtgctttcctgctgcaacccagcccacacgatatccgggagcaaggcattttgaaaatgatgaacagtgcatgaaattattttctttatcccatgctttgattggcatcggcggttcttgatcgaaatacagttcgccataaacatcatcttcaatcagagcaatatgactactattcagaatctccaccagccgctgtttattttcggatggcatcgtgttgcacaatggattttggaaacgagacatcaaccagcaggcttttatcgggtatttctgcacgatctcttccagtgcatccaaatcaatacctgtccgcggatcggttttaatcgcgatagctttcaggcgcaggcgttctatggcctgcaacgcaccataaaaagcgggcgattcaatcactacccaatctcccggtgaggtcacggattgtaagctaaaacttaatgattccattgcccccgcagtgatcactatctcctcaggaggaacatgaattccgtgtgcggcataacgacgggagatattacgccgcaacttctcattgccgggcggcaagttctccaaagagctgtgagggacaaagcgacgggcaactgaggccagtattttggataactttggctcattcagtaaggaaggatcaggaaatgccgagccaaaaggcacgattttgggatctttgcacgcctgcaacacatcaaaaatagaggcgctgatctccacactttcgcttaaatgcaggccttttccgcctttcgctgccgcaaattgcgttaaccgggtggccacataatagcccgattgcggacgagccacgatccaaccctgactttccagcaattgataggcttgtagcaccgtcattaagcttaatcctgatgatttcactgattccctcagtgatggcaatttgtcgcccacctgccaaatatcatcctctatttgctggcggatcgcaccagccaactgttcgtaacgtgtcatatagcctgaccttaggtaaagctgttataggtaataaacagataattgtcactattataccctatattcctgtgttttacttatccgcaccttctaacttcatcgccccatatgattcaactaaaataagaggtcactatgtttgggttaagtgcccttgaactcgcaaggatacagtttgccttcacgatttcttttcacattatttttcctgccattacgataggtctggccagttttctagccttattggaagggctatggctaaagacacgcaatacagactacaaaacgttataccacttctggtcgaaaatttttgcagttaatttcggtatgggagtagtttctggtttagtgatggcctatcaattcggtactaactggagttttttctccgactttgccggcagtattacgggtccgttgctagtctatgaagtgttgaccgcgtttttccttgaagccggatttcttggcgtcatgctgttcggctggagccgggttggcgaaaagttgcattttttcgctacttgcatggttgcccttggtacgattatttccacattctggatcttagcctccaacagttggatgcagacaccgcagggccatgaaatcatcaataatcaaatcgttcctgttgactggtttgccgtgattttcaacccctcctttccttatcgtctattgcacatgggaactgcggcgtttctcgcatcagcgttcttcattgcagcttccgctgcgtggcacctgctgaaaggcaatgattcctccgccatgaagaaaatgctgtcaatggcaatgtggctgattctgatcatcgccccgttacaggccatcattggtgattttcatggcttgaataccctgaaatatcagccagccaaagttgccgcgatggaggggcattgggaaaatcgtcccggcgaagccactccgctgatcctcttcggcattccgaatcaggaagcagaagaaacccgctatgccgtcaaaattccttatcttgccagcctgatcctgacacacagtacggataaacaggttccggcattgaaagaatttgcccccgaagatcgccccaatgtctttatggtgttctggtcatttcgtgtcatggtcgggctgggcatattaatgattgtggcgggcgtttggggattattactgcgctataaaaaacggttatatgaaaacagaacatttctccggtttatattcctgatggcaccttcgggtcttatcgccattctggccggttggtttaccacggagattggccgccagccgtgggttgtatatggcttaatgcgtaccaaagatgcggtatcggcacatggcgagatccacatgagcatcagcctgcttattttcttcgtcgtttatgctgccgtctttggtgtcggttacgcctatatgatgaaactgattcgcaaaggccccaacaaggagttagcaaatgggcattgatcttcccctgatttggtttctgatcattatattcagtaccatgatgtacatcgtgatggacggttttgacctcggcatcggcattttatatcccatgatgaaggggcagtcagaccgtgatttaatgatgaattccgttgcgccggtctgggatggcaatgaaacttggctggtgctgggcggcgccgcgctgttcggtgcttttcctttggcttatgcggtgatcttggatgcactggcaatccccctgactatcatgctcttagggctgatattccggggtgtcgcttttgagttccgttttaaagccacaccagaacaccagccaatctgggataaggcgtttatttctggttcaatcatcgccacttttacgcaaggaatggtggttggcgcggtgattgaaggttttccggtcgagaaccgcacctacattggaggggctttcgattggcttgccccattccccttattctgcggttttggtctggttgtcgcttatgcgttgctgggatgtggctggctggtgatgaaaaccgaaggccatctgcaacagcagatgtatcgcattctgcgcccgctgacgctgctgatgctggccgtcatcagtattatcagcctctggactcccattgcacatcaggctattgccgaacgctggttcagcctgcctaatctgttgttcttcatacccgtaccgctgctcgttatagggtcaagctggaagctgctacaagccaatgggaacaccagccattacaccccatttctggcggcattattgctgatatttatgggattcagtggattagggatcagtatctggccaaatgtcatcccgccgatgattaattatcaagaagcagccgccccaccgcaatcactgggctttatgctggtcggcgccctgttcatcatcccaatcatactggtctacaccttttggagttattatgtcttccgaggaaaaatcacccatgaacaaggttatcactgagtccgatcctccccgcccttccctctggaaacggctcggttggctggtcaccatctggcttggcagtgtgctgacactttacgccgtctctgcgctatttcgtgtcttaatgacaacagcgggaatgaaagttaagtgataattaacctattttaattaattgagctaaggtttggatcaggaaaacggaaggattgtttaactgatgaaaactttctctgacagtccaatagcagcaacaggctggttatgtggcacagctattaccatcaatttgtctgtgctgctatttcttgggttgaataccccgcttaccttgcccggaaagctgtgggccatctttgatatcctgagtatcctgtgccttttaagcttgctgtataaagccgatatgatttcactccagatggcatcattttgtaaaataaaacaaagaaagatcactgccttgaaacgggataagcaatacctgcgttttcttatctccatccattctcaacttaatcttaatacttcactctctgataattttcatagggtatttttcaggcttaaccaattcattccctttggcgaagtcaggatcacgctttatcatccaccgcgtaaatatcattttgaatatctccgtagcccctttgacgccaatcttccacggatacaaaaatgggatttatatgaccggcatacttttcacggcatgattcaaatcaagattaatcaaactcagattctgtcttcttatgaacgggatctgatccagtctgttactgatgcgctggcaagacacctgtccctgagaaatactgtgcatcagcaaattcagcagggtcttatcaatgaacgggaaaatatttccagagaattacatgacacagtggcacaatcatttctgtttctgaaaattcagattaacagcctgcatgtgcgccacgataaattctcccgacaggccttaatcgccttgcggatcataaaagaggagataactttagccagtcagcaattaagggaaatgctggccacactgcgggcagaaaaaaatcattatgatctgtatgaatccctgcaatccctgataaaagaattcaatcatcggctgggattccagattgaatttcattatcggctcactcaccagattattcccatcgggcaccgccgtcatttggcgcaaattatccgtgaggctttgaataactgttataaacatgctgacgcgagttggatcagtattcgcatctacccgataggcaaaaagattattacggttatcagtgataatggccacggcatccatcaagaacagattaaggctcagtttggtctcgctattatgcgggaacgggtcactctcatttcagggcaaatgaagatcaaaaaacgcaaaaaaggcggcacagaaattgaaattcaagttccgctacaagatgaacagcgtaatttagaaaaataaaaacgactattcagctctttttttcggtagggaatcatcggcgttgcaccttgttgtttaatatgatttctgaaagcctgactatcgtaccctttgtccgctatcacaaagtccggaggggacgattgttcgactaaactttcagcatgaacaatgtcatgcacttgtcccccggatcattcaaaatgaacaggcaagccgtaattatcgacggccagttgcattaacgcagatagcttattccattggaggtctgttaacatagttcgcggcatgatggtcaggtttggttgttttttggcgaaagtgattataccaaatcatcatgctgtctaataatcccccacaaaacatcaacacgccctagcaagtaatggcggggatttggcgtgttatctggggaatttttctttatgattaatcgatatctgatcaattcattttgtggctggctattgttctcatgttgttggttctgcttatgggtgatcgcctactattttgttaatgattcagaactggccattttgttttttccttttgccctgcgccttggcattgtattacatacgccaaaacattattggccaaccgtttatggtgcagaatggttgctgactatctgtctggcactgttgatggggcagcctcaatggcttaccgtactgactgccagcatagccagcctccctattgtctgggttgccagccgttattatcgtggcagtcaatggcagcggctcgctgtcatggcaatggtgatcacagcaaccggcctcattaatgtcgtggcagtgagtaaccataatccatctttgatcatcgtgtttttggtcagcttaaccggtggtgccatgctggtgcctacatgctatttagtctggcattatctgttccaaagtatctggttgcctctgacagccaacgtcgtgtcgcgtcaaatccagtttcgccttcatcacgttatgctgtatgccctgctatttgtactgaacattctgttacaaattggttttcccaatgaattacgctactttgcaccgttctgtctggctatccccattattttgttggcctttcgttatggctggcagggtgccttactggggacattactgaacagcatcgtattgattgctgcgcgtagtggtgtttcgaatatggaaatcaccgacttactgttatcgctcttggcacaaaccatcacagggataatgcttggcatggcggttcagcgtcagcgtgatcttaatacacagttaaagcgcgaactctatcgtaaccgtagtcttgcaggccaattagttaaagcggaggaatcggtacggcgcgatattgcgcgagaactgcatgatgaaattggccagaacattactgctatccggacgcaggctaatatcattcagcgggtcgaagtgacacctattggctcgaattgtgccaaaactatcgaatcattatcccttaatgtttatgataccaccaaaaggttactcagttgcctgcgtcccaaaatccttgatgatcttggtctgaaagaggcgatcgaacaattgctgcgggatatggaatttgaaaactgcagcatatcagtggaaatccattgggaagctaattctgccgaggtcattgagcaattgagtgacacaacaaaagtcacgttatatcgtatctgtcaggaagccctgaataatgcattaaaatattctcaagcggatcgcattgagttgcatttttctgtcagggcaatgatccgtttattgattaaagacaacggtattggctgtaaggctgaagataacatgaaaggatttggtttacggggtatgcgggaacgtgtacaggcactcggtggacaattctccattcatagcggaaaacgacagaatgactcgacaagcgctggtacggatttatcgatcattttgcccaaactttaagaagtggtcatgacaggtttttctcaatctaaacccatatctcacggcaatctgtccgatgcagaaatccgggatcaataccgttactggcgcttacatattatattgaatctatatgtgggctatgcgctattttattttacccgcaaaagcttcaactatgcgatgcctgccatgatcaccgatcttggtcttgataaaagtgagattggactcatcgggacgttgttttatatcacttatggctgttcgaaatttttttccggcattatttctgatcgctccaacccacgctattttatgggaataggactgattgccacggggatcatcaatatcttgtttgggctgtccagctccattgtcatgtttacctttctttggatattaaatgcctggtttcagggatggggttctccctcatgcgctaagttactcacgacttggtattctcgctcagaacgtggcttctggtggtcggtttggaatacttcacaccatgtgggaagtgcgttgattgcattgatcgtcagtttcttaaccttgcattttagctggcgagaaggatttatcgtgccgggctgtattgggatcctggcaggtatacttttatgttggcgattacgtgataagccggccacgatggggctgccgaccatcggtcagtttcgcaatgatcggttggaaaaggctcaggaaaatcaaggcaaaggcctgacgaccagagaaatcctgagaacctacgttttccgcaacaaatatatctggctgctttcctttagttacgtgctggtatacatcgttcgcaccgtcatcaatgactggggaaacctgtatctgactgagtatcatcattatgatttagtgagtgcaaacgccgtattatcgctctttgaagttgggggatttatgggatcgctggtcgcaggctgggggtcagataaactctttggcggcaatcgtggcccgatgaatctgatattctcgatgggtattttcttgtcagtagcggctttatggttgatgcctgttacggggttggtttttcaatcgcttggcttttttgcaattggattttttgtgtttggcccacaattgctgatcggtatggctgccgcagagtgttcacataaagattctgccggtgctgcgacgggttttgtggggctttttgcttatacaggcgcggccattgcaggctatcctttcgctattatcctggaaaactatcactggtcagggttatttatggccatttccatctgcgccgtcatgatcggtttattattgctgcctttcctgcaagcacagtttcctaaacaaagggcacaaagttaatcgtaaaaagtatgagagcgtcctccactcgttctctgaataaaatcgagtggaggattttttcaatcaaaacctgacagattaagctttcacttcttctctcatgatacggttcaaccacggaaccataaaggtcatgataatggcgacaatcagagtggcaacaccgattttaccgaacacactcatataaattggcagagtttgcagaggatcagttacgcctacgggtgtcgcagtgagtgccgccacatgactcgccaacattgatgccaccgcttgtgacaggaaccacattcccagaatgaagccggtcagataactgggaacaaatgcagccaccattgccagccccagagcgctgatcatcaattcgcctacgctctggaacagataaaccagcacgataaaccacggtgaagtaatgccttgggcgtcagcaaacaaaccggaggcggcggcggtcaggaaacccagagaacacaggaacatgccgaaagtgaattttgccggcatggagaagtctttacctttcgctcccagcttagtgtaaaccaccgctagtattgggctgacgataataatccagaatgggttaaatgcttgaaagctgacgggattgacatcaaaaccaaggatctgatgatgaacgttgttaatggcgaagaagttgagggacattggcatctggttatacaggatgaaaaacaccacagcctgaagcatcagaataaacgccacgaacattttattacggccgactctgttctgcttgaatgcctgccagaagaaaatcagtacgacgatggtggtaatcgcgaacaaggcgatattggcaaccttgatattgtgcagtaaccatgcacagacacccaccatgaccacagagcctatcagaacggcaatcaggccgatgggcttaacaggatgatgatcaggtgcagagccgatattatgtaccatacgacggcaggcgatatataccaacagggcgataatcaggccaataccgcagatattgtaagtaacggtataaccatatttctcagcaatcaccggggcaagggaaagggaaaacagagagccgagattaatggacatataaaacagagtaaatgccccatccagacgagggtcttgtggttgataacatttagccaacaggctggcgggattggccttgaaaagaccattaccgaccgcaacggtgcctaatgcataaaaaatcagttccggtttcatgatagacaagccgatcatgtaatagccgattgccatgacaatcgcacccagaacgatggttcgtttagttccaagtatgtggtcaccaacataaccaccgacagaaatcaggccatacaccagagcggtgaacgcaccaaaggtaataaatgattgttcttctgaaaaacccagttgttgaacgaaataaatggccaaaatgccttgaacgccgtagaaaccaaatcgttcccatagctcaacaaaaaagatcatgaaaaagggttttggttgatcccataaaccgacggatgcggttttactcatagaggtacctctgttaactcttactgggtaatacattcagataaaaatatatttaggcaattgtactattgttaacatatttgtaacttaatgtatcgcacgggttgtgatattgtttatttaatcaggataatcaggataatcgtgaaacgagggagattaatatactgtgatggtatcttctcaacgattgatcacactaactaaaaaattaataccagattgggcggaatattcactaaattaataactaaggtgattaaaaagcggatttaatgcgttaaaatgaagcaatttggtcaattataaaccaaagtgaacttgttatgtataggtaagagttatatacgcaattaacttgaaaatgcaggacttaaagtctgaaaattatccgccagcgggtagtcagttcctgtactttttctggcaaggtggctcgatacggttatatcgttggtggatatcgttgatattgttgtaatttttttgatttgataatattttgaactgcatcaataacaggttcattattatcatcaataaaaaagtgagtaccttcaaaaatgatgacctttttctctttttcaaataaatctaaccaagaatagagttcttgctctgtaactatggcatcattttttccaccaaacacggttaaaggacaggataaagttcctgttccaatataatgatattcttccgaaattttaaaatctgcctttattgcgggtaaaatcagagataataattcggcattgtcgatgacttgtttatcaacccggccaaacgtctgtaatccattgataaaatctttatccggtaacccacttaatggttctctgatagcaggaacctgaggccctttactgcctgaggcaataaattcgagggggagaggtaatgatgcggcgtcaatttttcttattagctcaaaagcgactcggctacctaaactgtgaccaaaaaacagataaggtttatcaagtaagcttttgatattgatatatatgtcttcaacaaggcgactcatgtcatcatgaggtttttctctgatcctgctacctttaccggggggttgtatgactaaaaactcagcgtttgatttgatttttttggcaaagggaacaaaagttgcactgcttcctccggcataagggaaacaaaatattcgtatatcaggattagaaacaatattaagtttaataaaacatgaaggagatttttccatcacaatctggctccgttatcgtttgctataaagttacgtattgaaattaactattttgttaacttctgctttttgtttacggtatgctaccgcccttgggtattatcccaacatttaaacaacaatgtgtttatcagttaaaaataacgagttataacaagtgaaaacaataattaattcttaaaaattagaaccatttgatattagcacattgaaataaaaatcaatggattccttttttattcatttgtacatattaaaatagcctattattaatttttattatgaacattgtatttaattgattgagattatattgttaacaatgtaagtgattaatgtatccgtcattccgcacctcatttctgatttaaaaatcggtcatgtattcaatagttagttactgtaatatgcttccggctttttaaggatgaaggtcgccgcgctacataggtaacccagcaatccacccaacacttacacgacagttggcagccagatatgaaaaaggccacgccggagcgcagccttgaatttgttatccgtgatctaaacagggtgttctcgttcgatggctcagtccgtatacactacagtggttattggtgagacccaaaccaacggaaatttcgttccgcttcctctgactcttcttgtcgttttattatccagtaacaacctgtagtaacaaattccatcacatcaacatggtgtattggagccttaacaggtaaccccgtaaattgagataaatccctagcaaagcctgttcttccggtatagcacgcaaccaaccgaatacttcggatgtgatagagtaaaatgagtggtttgatactttctgccagatcgcttggtgataaagggtgtgcatcaggtaatttctctcggcaaggaaacccggcaatttcagtaccagataaaggatgttctacagagtgtccttgaaaagaagctctgttggggtctccatgtccaaaaatattaagtctggggcctggctggtatttcggtatatccaaaaaataatgatattgtttatcattactgaccacaagcttcacgctatcttttaccgcgtcctgtaagggtaatttataaatatcgttaaaataatgtcgataccatcccataacactctcctttctgacggtatatattttgtaatactgatatccccaaagtacaaaattaccagttttaaagagtgatgtctttaaacattataataacaaaaataaaatggttgttttttgcccatcaaagatcctgtgactggtgtagacatgcgttcccccagaaaacaaaaaaaacgcatcgggcgctgagggatccccagaaatcagcgctaataaatcaaaaccatactttggtagattctggcgaggtatttgagtgttttattaagtacaatttcaaataatattagcggggaatggcgtaagacattctgtgctaatgtcagatgagagataactcttcttgatttaatactatttgcctgataatcaagatataagattgattactttcgccaaaaaacaaccagacctcaccatcatgccgcaagctatgttaacaaatctccattggaattaagctaactgcattgatgcaacactgcggatgggtttatgacaaacctgaacaccgtttgaccttggaaggtattcttgaccggatgagaacgagcattcatttgatgccatttttctatcggtaactgacttatcaacagcacctaaccccgttgatacagctgatccactatctccagtaaatcagcctaacatcggccgtatctgacgtttaatgtttcaatgatcttgctcaatgcggttattgaggtacttattctggcggattttgatggtcttttcctttgatttatcggtattcagcaaggcgagctccccgtggtggggtagggttttacggaaaaaacgcaaacctgactatgacagcgcattggcggcactgaaataattgttttattattaataattattttattattaataatagtcttattttagtgttttaacacagcaacctattgtttttaaatttatatctggcgacgataaaatcacaatgaataattttatcgtcgccaacttattttatataatcccacctaacggttaagaataattaactagtaccaaaatcctcttgtccttttcaattgaaaaacatttttaaatcaaaaaattgtcttcattactacgctagtggccacctgttttacaaccttcctcccttattcacacaatcacattgccaataactaaaaataaacatccgatgtaattttattgcaaaatagttttttatatgaaatattgcatatagattaataccttcttgcaatcaaaataatggctgtctgggttaatcgtaacaatcagtagacaaagtattttgatttgttttctggaccttaacctaaaggctcatgcggtagctttggtctcacaaggagatttcaatggaaaggatcattatagctcactcctcattaggcgatgaatccctgatatttaagtcattgaaaggaagggaaaaattatcaactatttatagttttgaagtggagcttttcagtgaaaagaaggatcttgacatcaaagagttacgaaacaaacccctgtcaatagagataaaaaattctacaaatatttcagaaaaaccccgctttttaagtggaattatccgtgaagccactatttgtgattattatgaccattactactatttatataaggtgattatccagcctgagttgttcattctcactttaaacaaagatttcagaatctggcagaaaaagacggtgcctgaaattatttcagacgttcttaataaatataaaataaagtttaaaaatgaactcaatgcgaaataccagccattagaatattgcacccaatataaagaaactgatttcgattttttaagtcggttaatggaacgtgaaggaatttattactatttccaacacgataagaatgatcacacgcttatattggctgattccccccaatcccattcagccttaccagagcaggcttctattgaatattatccaagccatttttcaccgaaaaacaaagacaaatattatctatacgactggattgtaagttattcaatcaatcccaagctctataccatgagtgactataacttccttaagccaaatgcacagctaaaagaaactcagcagaatccagatccgacagtgccaaaaacagagctgtttgagtggccagggaattataccgaaaatgcgcaaggacaattttatgtccgagtactacaacaatcctataccgcgcaggatctgtatataaaagcgaaaagcgtagaatccggcattgcgccaggctacaccttcacattatcaaaagccctgcgggatggagacaacggcgactatcttattgtcagtgccaattatgagtttcatgaaaatccctatattctgggagacaatgaggttgatgccgacaacataaataaaattatcactgagttcaccgccatccccgctaaagtcaactggcgtgctcctcgcacaacatcatggcccatagcaggtactgaacgagctaccgttgtcggggcaagcggcaaaaccatttggactgatgaacatggcagagtcaaactcaagtttcactgggacagaagcgatataaaagacgataaaagttcctgttggatacgggtatccaacaattgggcgggatcaaagtttggggtaattcaggtgccaagagtgggggaagaagttatcgtcaatttcattaataacaacccagacgaaccattggttgtggggcgcagtttcaaccaaaacaatatgcctccctgggaattacccgcagaagccaccaaaatggggataatgtcacggagtttagagggcggaaaagataatgccagttatttgttgattgatgatgctcaaggaaaagaatccttcgaaatacatgccgagaaagacatgacagtctcagtggaacacgatcaaaccgtttccattgatggggcatctatcacaaagatcaaaaacaaacaacaaactaccgtgaccaatggcaaggaagtcgaagtcaccagtggtggtattcaatataaaattactgacggatataaagcagatatcacgggtgataaatcagaaaaaatcagcagctcttatcagttagaggttggacgcaattttgctaacaacatcagtggaaattacaacctgaatattacggggaataagaaagagtcagtgacaggaaacgccgaaattaaagcaagcaagttgtccttggcatcgagtaccacaatagatattaacggtgcagcaaagatttccataacggcgggactcattctattgggttaatagctcaattaaaaagatttattcggggctttcaatgaaaattatcaaacctctgcgcttaagtctgctacatcgtccttattactggcggcaacatcactatcttggtgtctccattatggctttaactgatatgggtgcctcccctcgcctgcggcctgagcctgaactttggcaacttgcagaggctgaactgaaaaccactaatagcgttgtcgatctcgccatccctaaatcttccgctgaatttcttgcaacgggctatgcctatactcatcaccagcctgataaaaccacgtgttctgcacgtatccagatagagcaattggataagacacttattgtctctggcgatcgtcattggattggcgataagccatccacgccgcaggcatttgaacagatgcggttggattggagccgtgctttcgggggaaaaaattatgaagaaaatccatatgggatcggctttacgccagaactacaggaaaatggcctcgaaactcatcgattacctaatgtagaagaccaaaacagacaacttttgtcaccgcaggatacccctaatcctgcgagtttttgtcccctcgaatttgggtggccgcgccgtttcacccgtatagggaaaaaatatgacaaagagtggctggaaaatgaattccctggtttttcccgtgatatcgactggcgattgtttaatgctgctccccctgatcaatggtgggaacactatcaggcactaccagaaaacgcagcatggcgtatttggaatatgcatcctgaaaaacctatgcaagaaggcaagctgccaccgtggcaggcgcgttgtttcatcaaacggctgcgtgctgacgaagatattttcgaagagattgccatgcgcaatacgacggtgtggtttttccctcatcgggaacagatgatcctgatttggcatggttacacacgcgttaatgaagatgatgcgactgatgttttacacatgctctccgcaatagaactcaatagcgaagcacactcagaaaatgactatcttcaagtacttaaccagcgtacagagaaagaaaaaggcgcattatatgccctgcgagaaaaagacctgatccctgaaagcattattggcccgtggatagatacagagcaatcggagcatggcagtcctttgagggagaatttgcaaaatcgcgagaaacgcctgcgtgaacaacacaaggagcgcatggcgaaatatggaaaagatatcagcacactaataactccctgtattgaacaacccgctaatcccaaagcggatgaattacctgaatttgtagacaaaatagagcaagaagctgcccaaaaatatattgcagccgagcagcaacgggaaaaaattcgcacaatcgctcaagagcaaggtgttaaggtggagcaggtagcgatgcaaaacacccccagagggccacaaaacttccaccaaatacgggatatcttgtaccaacagcaagaaagtcaaaaacaagttgagccaaaatcaatagaacttaacgataaaaaactgacacagattgaacaatccctgcataaaatgtatctggcctctgcacagacacaaccgccagccctgcgcttgaccggggatctgtcacaaattattcgcaagcaagtccagcgtattatgcgggaagggggcgatttccgtgcaatggattttaccggagcagacttatcaggaatggatctacaaggagccaatttttccggtagtttgctggaaagtgtctgtttcaataacagccaattggatggcgcagatttcagtgaagccatgttagccagagccgagatatgccatgcttccctatatggtgcaaaactggataatgccagtctggcacaggcaaaatgtgaacaaagcgatttttcagcggcaagttttaaagaaacacaattgcaggaaacattgctcaaccattgccgatttaatcatgctatcttcacggatctgtttttacaaagaaccttcatcaaacactgtcgtttccaacactcgcaatggcaaggctgcatttttattgagatgatgctacctgctctaaaatttagctatgccagcttaaataaagtttcctttatcaattgcctgctggagaacgccatttttgatcacgctgtactcgacagttgttcatggatagaaaccgaagcagtggcaatccggtttcgatcagccaaactgctaaactgcgtatttaccatgaaaagtgtgcttaatcatgctgatttcagttatgccacattaacggaatgtaatttacgccagacacctttagttcaagcctctttccactctgccacactgaataacagtgattttagcgaagccaactgccaattggctgatatgcagtatttaaataccacccaaagtatatttatcagaacgaattttaagaatgcattgttgaataatgccaacctgatcggcgcttttatgcagaaatgtactttttgtagcactgacttacgcgaagctaatctgttccgcgctgatatgtcccagtccatcatagacgactccaccttgattcatcatgcctatacacaacgtctcaaaaccttacccaaacgtgatcaggacgtgatatgagtatgctgacagttaatgagattatagctaagatcaaacagcgagacgtcattgaacaagtcaatttgcaggggatctcgctggttggacaaaacttatcaggaggcaggttctgggctgtagacttttcaaatgccaacttctcccatgccattcttgaagagtcagtctttactgaatgcttgtttgaagaaacggttttcaattccgtcaggtgtgaaaagaccttgtttgaacagtgtaatatgatacgtgctgtgttcaataaggccacactgagcgccagtgtgttcgaccaatgcgtcttaaaaaaaacacagtttaaagtcacaaaacaaaacagtacccagttttcatcctgccaattgcaatatgctgattttattgaaaatgaatttgatcgcgccacctttatcaactcagtattgcattacgcaatattacgcaatagtcacttttttctggtcaccttttttcgtcaggacttaagaaaaacggatttttatgccagtcagttcatgaaaacccttttttttgaatgtgaccaccgtgatcaagattatcgaaaattgcaatttcaggcctgtcaatttacagataatcaacttgatgcagtgaattttaatcaatccaatttgacccattgcaattttaagggaagctctctgcaagacgcccagctttcgaatgtcaatgcaacccaagcgttattcatcaatgccgatttaacgcgtgcatgctgccataacagtctgtttaatggagctatttttattggcgcttgccttgagcgaaccgattttcggcaaagtcagctacaacaagccatcatgcaaaaagtacgggctgtcaacgcacaatttgtgaattgtgatatgacctatgctgatctctcttatgccaacatgaataacagcgactttcgggcagcacattttatgagaacgctttttcatcgtactcaacaagttggagcattattctctgaccgtcagggcatattggaaaatgatcctgaactgtttgctgctgaagagtggagtacacaacaacgtcaacgtaagatttaagctggagaatcaatatggtgaaatcttcttacgcgctttcttcatcgactcttgttacggaacaacgatatacagaacaaccacagacgaaacaatccagtccattcccatcgcaacaaattgtcggccaagtcgtcaatatctttcaggacggcaaattaatggttaaaaatcaaaattatgggtggcattgtcgacaagcctccagttgcctattggctcctgcaatgggtgacagggtgctacttgtagaagccgatgaacaactctggatactggcgatattagaacgggcagagcaacaagatccggctgtaatcaaggtatcaggcgatttatccattatggctcaggggaatttgaacctgagcagtaacgggttaaatatcaccgccgaaaatggaaattgccatattaatgaaatgcaatacagtggtggatccttgtctgcctgggtctccgtctcgaagataataggcaatcaatttgaatccgtttggcaaactgtaactcagctgagccatcgtctttttcgccatactacgcaaacagaacaagtgcatgcagggcaattagatatgcaggcagaaaactacatgcgactacatgcccaaaataccgtgataaccgcaaaagcaatcaccaaaatagatgctgaacaggtccacattggatgaaagaataaaaaggaaacattatgtttgctaatacccaaggcggtggcatagatctggccatcccagatatctgcctaaccccatgccctctaggtgccccaataccgatggtgtatctcaatattgcacaaggtacgaatggcatttgtgccagcacggtcaatattctctttatgggaagtccagcccataacatggcgacaatgattgccatgacgaatggagataatctgggggtggatttgggcgttgcgtccgggacggtgatgggaccctcccgccatacgcttggagccaatagcgtcttgattaagggatcaccggcaacccggctatcaagccctaccctacagaattcaaccaattcggtaggatcacgtgccgtccccagccagacaaaggtcgatatttcaggggcatgatctcccctgcatcttgtaaagatgggggaaattcatggtcaatataaaaaatgccagccacacaactccaccttgcagtgataagacattctcccgcgagataattgggcataaattcgcgaacagatgtcgattaaatttcaagtgtgcaatgatggtaatactgtttcttcacgtactcgtatttaatttaataatatttaacatcttcgtattaacagggtgttcatcatccgagcagaaaaaatcgcccccttatcaattgatttttcgtgccacaaataatgtgaatgactcagctccgctgaaaatacacgttattttgttgaaatcgacttcagagtttatgtctgctgattttttttcactgcaaggtcatgctcaggctgtactgggtaataaattgattaattctgagcaactttttttactgccttttcagcacaaatatttcttgttggaaaaaaacataccagaagccaattctatcggcatttttgctgaatataagcaattggatgggaaaaaatggcgtatcgcattaccggttcccattcctgagcctcccgctttctataaattttggacatcaccgccagacacattagatatatgcattcaagtcaccgccaatggcctaaatttcatcgataaatgcaattaacgttatgccgtaagagaaggaactatatgagcagatcagaaaaagttatctggacagaaggcatgttcttacgccctcaccactttcaacaggccgaaaactatctggagacttatgtccgcgattggggtatggctcaaaggccatattactggggctttttaacgttaaagttagatcaatcattactcgaacagggcaaggtcatggttgcatcagccagtggaatttttcctgacgggacaccctttaattttaccgaggcgcacgcccctgttccattacaacttgcagaaaatcaaactggagaaaatgtcgtattggcactgccgatctttcgcggaggaagggaagagatcatttttcaggaaagaaaagactctatggcacgttttgtcagcgttgacgccgaggtcaatgattttaatgccatgtcagtcggaagtaccaccgtgcaatttggcagaatgcgcctgcggctgatgttggaatcagatctgactccggaatggacgtcactcagtattgtgcatgttatcagtagaacccgtgataataaattgctccttgattcacgcttcattccgcccttactcaactgccatgcacatccacaacttgtcagttttattaatgatttacagggattactggagcaacgccgccaacagacaagccagtgtttgttacaattggggcaacaaaatagttcggaaatcatgtattttcttttcttgtcattagtcaatcgttatagcggccaagtgagccatacccggaatattcccttactgcatccagaacggttattcagtgaatggctgcaatttgccaccgaactggcaagtttttcccaatcacgaataccagaagataaacttccgatttatgaccatgacaatttgcaagtctgtttcaaccacctcatgtttttattacgccaagggttatccattattctggaagaacacgctctccagttgcctttgactgagtattctcatgggctgaatgtggcgaccttaactgacgccaatatgctaaatacattcagctttgtattggccgtttatgccgatacgccgaaagaaacactcatctcccgttttccggcacagatgaaaattgcccctgttggccgcatacgtgaactggttcagttacagttacccggtatcccgatcagtgcaatgccatccgttcccagacaaattccctggcattccggttgcctctattttgagttagaaaaagagggtgaactctggagccagatggcaaaatccggtggttttgcgttacatctggcaggtgaatttccgggtctgcacatggaattttgggctgttagaaatcagtccaaaagttgacgcctcaacaatcagaatcaaaagaacagaggtcactacgcctatgactccaaacactcccaacaggcatacggagctttctggcgacatttgggataatccattagtcactgccgctaaccctctattaaatagcattcctcagatccgccatgataccgagtccccggatccaaccgttctacggcgaaaactgatcgatgaaattcgccactttgaactgaaatgccaatatgccaaattgccttatgaagtcattatcggtgcacgttactgtctgtgcaccacattggatgaagcggcagcactgactccgtggggcgttcgcagtgtctggtccggcagtggattgctggtcacgtttcacaacgaaacgtggggaggggaaaaacttttccagttattagcgacgttatcccaaagtccccaaaaaaatctgttgttgttagaactcattaacttttgtctccagcttgggtttgaagggcgttatcgtgtcatggataatgggcgaacccagttggaaaccttgaaacagcgcctgttccagttaatttattccgttcgtggcaattatccgcctgaattatcaccagcattgcaaaaaatcgtcgcgccaaatagcccctgccaatcttccttccctgtttggtcctttatcgctatgacctgtcttattgcatgtattctgtatatcggactgaattggcagttggataatataaccagcccaatattgacgaaaatatatcaagtcaatttgcccaatatgtccgttgatgatcacgtttcttctttcctgccgccggtcttaaatttacaggatatgctcagacgtgaaagtgctgcgggattattaaatgtaacgaatttagcggatagaagtatcgtcacattaagaggcgatggtttgttcaatacgggttccactcaaattaaaaacaatgaacttcccgtcatcaaacatattgctgagacaataaacaacatcaagggggaaattttagttattggttataccgatgatgttcccattaatagctccggcttctcatccaattatgccttatcactcgccagagccaaatcagtaaaaagggaattcgaaaaatatctggatcaccctgaacgggtaagaacagaaggaagaggagaaagtgatcccctatttccaaacgatacgcccagtcatcgagctaaaaacagacgggttgaaatcgttctgttaatttcccctacacatcagacaacgtgagaatacggaaatatgttgagcgccattgttgctatttttaccagccgattaatgtggagtttcctcggcatcaccgccatctcttccattatctggtttattggtcccatgacttctatcggtaataccatacctcttggatcaagtacggtacgaataattatcattgccatattatattttgtctggctctttatccagttagcgtctcacttatatcaggtttggctgaataaaaaactttctgccccattaaacagaggcaatgacgagggtgaacaagtacgaaattcacaatattcccctttatcagaacacttttctgatgccttacgactactgaaaaatgcctatttttatggttcagagatccaatataagccaaaatggaaaccttttttcgatcgtcgatatcggtatcagttaccttggtatgtcctgattggcccccccaattcagggaaaacaacccttctggcaaattctggtttgcactttccattatccgatcatttcgaaacgctttcctcaaacgagataaaagaaaccgataattgtcactggtggttcaccaatcaggctgtcttactggatacacccggacgatataccactcaggatacacggcacgaacaagatgcccgtgaatggaaatgttttgtcaatttgctgaaaaaatatcgcacacgccagcccctaaatggcgtcattcttaccattagcgtagcggatttattaaacccctcaaagaaagtacgtgatcaacacgcttatttattacgcaggcgattgtcagaattacaggctcagttcaagatccaatttccaatctatgtcatcattaccaagattgatttactgaaaggatttggggcttattttgcccattttgacaaaacacagcgcgatcaaatctggggattcaatttcccgtggaacaaaacaggctgggatctgaaggacatttttgcacagcaatatgggttgttgcagacacgattaaatgcagagctatcccatattttattgcacctgaatgatcttcagcaatgtgctgaaagttacctgtttccgcaagaatttgccgcactgcaacccttaattgctcagcatcttgaaattgcattcgctaaatcagggtttgatattccttattcaccacgtgggctttatttcactagcagcgtacaggaagagcctattcatcaaggatattttctgaaaactctgctggaaacgctctttcaggaagcggggcttgccggtcaaaatcgttggtgggtgtacagaaaccgtctattaaaagggctggggtatattattctggctgcgatcatggggttaatcatcaccttgttttttagcagttatggcaacaataaaaattacctgacagaagttcaaaataaaattttccctattctgagccaaagtgcagcattaaaaaagatcagcaacgacatcgatatttatgccttactgcctattttgaataaagtggcggatttgggaaaaagtaaatatttttctcctgatgctcccccttggtcataccaaatgggcttgtatcatggtgaacagatcaatgatgccagtttgactctgtacacgaaaacattacaaaccttattgctaccgcaagtcgcacggttaataacgtctcaattgcaccaaaccaacagcgataatatatataacacttacaatacgttgaaagcgtatcaaatgttatgtcagccccaacattatgacggtaagttcttacatcgttgggtgatgcaatatttgcaggctcatttaccccccactatttcaccgacacaattacaccaaattgaggggcatctgcgccaattattggaatatcagatcgttactttcccttatgtttgtgataacccactgataaaacaaaaacagattttacttagcaagatcccactagcacaactcgtttatatccatttaaaacaggaactatcggataaccccaatttatcgccagtcggcttaacaacgcttgctggcccagaagccggattggttttctcacgcatcaacggtacaccgattacccttaatatagcggggatgtttactccggcggggtatcaaatggggataggtaacaatctcactaccctcatcgataagttatacagtcaaaatgcatggatactgggccagtatgcagaaatatcaaccccaagagagcttaccctcttagtacgacaattttatctccatgattatcttgaacaatgggataaatttctgttcgacatccgtctaaacaatattgacagcctggagcagcgttctaatatagcccagtttctggcttcaaatgcttctcccatgcgcaatctgctcattaatatcagtaagaatgtcaatctggatgaaaggttaagcgataaccattttgataaaaaaatcggtgagttggtcagccgtaaagcagattcattgacaaaagtcgtacctaatccattcatgtcaggagataacctccccaccccggaacaagaattgagaaaacattttgcccaaattactgcattggcaaacaatccagacggtaaaaataagcaaattccttttgatcatgttctcagtcaacttgccaaattacacgaatatctggattcagtacaaaatgctaccaatataggcatacccgcgccatcggatgaaattatcacccaactccaagccacggcggagcggttgccgatcccattcaagggcatcatttcctcgttggcaatgggggctaacagtgatacacaagccagtaacgtaaagaatctcaataagcagctgaatacagaagtccaaggcttttgtcatcaagcgattgccaaccgctatccgctgacgccgtgggcacttgatgatatcagaccggatgatatggctcggatgtttgcgccacaaacggggatcatggatagctttttccaaaaaaatctggtgggaaaagtcgatacatctcacgaaaactggcgccttatactgggaacggatagcaaagcaaaagcattaccggaaagtcacaagttactcctgccattccaacaagcccagatcattcgagatactttattcagcgacggctcgcgtatcccttcatttcgggtcatcgtccgcaccgtaaatatggataaagagatattgagtatgatactggatgttgatggtcagcaattgcaatatagccacggcccacaagtttcgcagtcactcaattggcctggcccaaacggctccaatcaggctcgtatccaattaaatttagatgatgggacaacagcgagtctcatcacttccggcccgtgggcattaaatcgcttaattgaccatgaacaattcgcggcaggaaaacccgccacaaataatcatacaagccagcgtgtgacatttaatatcagaggccatcatgtctcattggaatttattccaaacagtattctcagcccgtttcaacttcccattttcgtctgtcccaagctgattaattcataaaaatagatggcctatacccatccaacttcacgttgccgcttgcaaacccatgtgagtgtttatacctctgtgcgggagatataagacgcatcttgaaaggcgacggctatattcaaccatcaatattttcattttcaactatcagaaaaagtaaaccctattatgaacatcgaaaccttactcgaacccgtcagcatcgaatctccttgtggggaaaatctggaatacgatcctgaatttatggcattagagcaatccttgcttggaaaaacggaacagcagtttggtgatatcactattccagcggagacacctgactggatacaggccgaaaaacaagccattagcctactgaggcggaccaaagatctgcgcatcatcatggcactgatacaatcatggttgcaaatgcggggattatgtggctacgcagacggccttaatctgctccagcagacactggaacgttattgggatgaagtttggccgaaattagcgtttgagggggaatatgatccccaatttcgcctcaacatacttgccgctattgaggacgattctcctctttcgttgcaagcgcaatattccactctgttgcggaacacgtcaaaggagttgtcattgctggaggtttgctcattattggatggcacgataaacgaaatcagcggctatactggcgggcgaacccgattacaggaggagttaaagcagcaggccagtagccctgaagttttggccgtgatccgtattcgggatcacctcattgcaatactcgacattattcgtcaggcattctcagaaagttatgtttctgaattgtcttggttattaaaacaattaaataaagtgattgaattttgcccttccctttcaaaaacaaggcatcgcgataaggagacagatcccaaaaatatttttgactcaacaacatgttcggaacagagaacgcctgcatctacatattcaacccatgcggtatctgcttcttggcataccattgaagccagcaaccgtgatgaagcacgcatgttactagaaaaggctaaaaactattttgtcgtcaatgaacccagtcaccctgccccacatatgattgcccgtattcagcggttgattgatcgtgatttcgttgacattatttatgatcttgccccagatggactcaaccagctcgaaatcatttttggtcgctcagacaattttgactcgaattaatcgtcgttttttcaacaatctatcaagccatgtgtcgttttatatccatccaacttcaagttgccgcttgcaaacccatgtaagtgtttatatctccccgctacgcggggagatatcacgcatcttgaaaggcgactgctatatatccgattaaattagctaattattagccagtaatggagaatttgtcatgaaatccagtggacaaaagtttattgctctaaatcgtcctccgcgcgtacagattgaatatgatgtcgagctttatggttcagaacaaaaaattcaattgccgtttgttatgggggtgatgagcgacttaacaggaaaaacattagaggctctaccggaagtgaatgaccgcaaattcatggaaattgatcttgataattttgatgaacgcatgaaatcaacacagccccgtgttgctttccaggtggacaatacactaacccatgatgggaaactgaatgtcgaattaatttttgaaaaaatggaagattttcagcctgatgtgattgctaaaaaagtggaacccctagctaagttactggaggcgcgaacccaactggcaaacctattatcctatatggatggcaaaagcggcgcagaacaattgatcgccgatatcctgcaaaatcctgctctgctgaaatcactggccgatgcaccaaaacccaccgaaggtgttgctgatactgagagtatcaccgacacagaagaggctgaaaataaggagtaattcatgagtacgactgaacaagaaactgaatttcagcaagagcagctctcaaaagaatatacccctgatgaactgagtgtattgctgaataaagaatttcgtccacaaagcgaccaggcacgaagcgctgtggaaagtgctgtgactacattggcacaacaggcgctggaaaatacggtcacaatctccggtgatacctaccgaaccattcaagccctgattactgagatcgataaaaaactatcacagcaaattaatcatattttgcatcatgatgagttccaagcgttggaaggggcttggcgagggttgcattatctcgtcaataacacggaaaccgatgaaatgttaaaaatccgtgttatgtgtatttccaaaaaagagttgggcagtacgctaaaacgtttcaaaggtgtgagctgggatcaaagccctgtctttaaaaaaatctatgaagcggaatatggccagtttggcggtgagccttatggttgccttatcggagattattatttcgatcacaccgcacccgatgttgaactcttacgggagatggctcagattagtgccgccgcgcattgtccatttctttcgggcgcctcaccaagtgtgatgcaaatggaatgctggcaagagttatctaatccacgggatctcaccaaagttttccaaaataccgaatatgccccttggcatagtttgcgtgaatcggaagatgttcgttatctgggattaactttaccccgttttctctcccgtctgccctatggtaataaaacaaatcctgtcgataattttaattttgaggaggataccgaaggccctacccacagtaactatacctgggccaatgcagcttatgctatggctgttaatatcaaccgctcatttaaattatatggctggtgtacttctatccatggcgtagaatccggtggtactgtagaaaatttgccttgctatactttcccaaccgatgatggcggggttgatatcaaatgccccaccgaaatcgccattagtgatcgccgtgaggctgaattggctaaaaatggttttattccactcttgcatcgtaaaaataccgatatggccgcctttattggggcacaatcattgcagaaaccgtctgaatattacgaccacgacgccaccgctaatgcaaatctttcagctcgcctaccttatttattcgcctgctgtcgtttcgctcactatttaaaatgtattgtccgcgataaaatcggtacatttcaggaacgtaatgatatggagaactggcttaataactggataatcaattatgttgacggtgatccgaccaactcttctgcaggaaccaaagcacgaaaacccttggctgccgcagaagtacaagtagaagaaatcccaagtaacccaggatattatcacgctaaatttttcctacgcccacattatcaattagaaggattaaccgtttctttacgtctggtatcaagattaccttcattaaaaagcacttagttctctaatattaggagtaacattatcaaccataatcttattgtctttcatctttaatttcccatcaacacatcactgttaccacataaattaaaactgttgttctgcattcaacattattcattattcattgttgttataataaatataatttgaggtgtaattatgtctgatttcaattccatgtataatactcattctttcgttcaattcgagggcattgagggtgaatcgcaaactaaaggttatgaaaaatggatcggtgtccaatttattagtcgtgccataattaaccctgctaatggcttaaccgatataggaagctggggttcaggtaaaggtattttaagccatttcatgcttcatattaattatgacaaagcaataagcgccttagaaaaatatgctgtcacgggtaaacatattaagacaacaaaaattcatatacttcgcttcattggcgataatgaaccggcaatatgggctaaatatgaacttaccaatacttatatttctgaaatcggcagtggacagccttccgataatgtcatcacggttggcctaaaaatgaaaaaattccaattcaattacacgccagcagattatgaaggtaaaaaacaggctgaaaccacctggacctgggatcttgaaaaaaatgtcatcgaataatattcattatttattttattttctcatataatacggccaataacctcccttaggggaggttatttcccaccaataataggcatctatcattatgcgattcaccattgttaaaaatattggtacaagccagccgcaacaactgagttatgattttatgccacccggtggcacaattggccgctccccagataataactggattttgcccgatgaagggcaggctatagctcgtttacaggccactgtatctgtttccatcgatggagaatgtcgtatgaccaatcggggggctgcctctgatattttgttaaataccatccccatcgctcccgaccggaggattgaaatacgcgatggtgatacgttaaatatcggtgattaccaaatccaagtcattaatattaaccaaggttcgaataatacgaatagtgtgaacacgccaccattgacaacaattcgcaaagatattcccagtgaaatttgggatggattggagaacacgtttacgcccgatgaaagcatgcctcagactccccaacaagttgctaagacactcaatgacaataatccactcataaaacctcagcggcatcaggaacgtaatccaataaaccctctcgaacagatggaaacaataattgatctggattccttgcaacaccgtgccacggatccaatcacgatgtttaatgcaaacacggatagccagcaggaaaatattctcaatgacagtacgcccagtaccttattgcagcagggcaatcagcgcgataaaccagaaattgatcccctgattctattttccgataaacatcggcgggggattttgcatgatgagccgctaaattgggtaatggagaatgctgaacctttggtcgcacaggctaatacaggctcttctgaccctcaatatggtgccagtgatccccctttccaccgtcataacaatgaacacttggatatcgacccagtgacatatccgcctaatccccatcaacccgatcaggccgaagaaggtgttaaattagagggtcaactcttagccgctttattggagggtatggggcttaatcatctccaaaacctgcaatttgatgggcataccctgtataaactggggaaattacttagccagttatcacaaggcattatagcgttaaatgcgtcacgcacacagttgaaatatgagactgataccggagttgcccagattctggtggatggcaacaatccctttgcactttttccttcgggtcaagcggtgctgatccaaatgattggcgaacatatgccaggatttatgtcagcagaacaggcaacacgagatattttaatcgagttacaagcacatcaattgggtatgattgccggtttacgcactattacggcagagatgttacaacgatttgatcccttagtggttaaacaaaaagcacaagctgccggcagactgcctcgtttggcattatcatcaacgtataaagctgctttatgggactatttcaccaaacattatcagaaaaatatggaaaaaattgaacaggatcacactatatttggtgaacagtttcggcaagcctatgagtcagaaattatccgatataaacactcacaagataaattaaagaacaaagataaaaaataacacccgcacaataacaacatttaatagataaccgataattaatgagtagataaataataatgaaagataatattactttattacatggcggttatcattttcgaaaacctcctgcacgcataactgccagagataggatgcagtcttctttgcttgacaggcttactgacaatgaacctgataagaaaaaagaaaacatgaacaattatttattatcacacagaacctttcggcaaaatgtcctgcgggatttacaatggttactcaacagcattaataaagaacctaatcaagatttttcttgtttccctgaaatacagcgctctgcttataactttggcatagcaccactggcgggtaaaaatatatccgatattgaatggagtgatatccaaaataaaatcattaaagcgatccatatttttgaaccccgtattattcccaatgaactgcaagttaattgcatttccgatattcgttcactgtctctatacaatacattgtccatcgaaataaaaggatttttgtggtgtatcccctggccaatagaatttttgtttcgcagtaacctcgatctagaacacggttatttcaccatgaaagaagccggataaaaaacctgagaggagaatcatggatagcaaactattggaatactataaccgagagttggtgtacttacgtgaaatgggtaaagagtttgcggaacgctaccccaaaattgccaatcgattaggcatgcatggcattgatatcgccgatccctatgttgaacgcctgatagaagggtttgctttcttgacttcccgcatccagttaaaaatggatgccgaatttcagcatttttcccagcatttactggaaatgctctatcccaattatctggctcccaccccttccatggccattacagaactccaaccagacatgagtaagggagatatcagccacggttttctggtgccacacggctcgattatgcgctgccagtctctggagaacgatggcattaccttgcaatattccacgactcaggatgtcatcttacaaccgctgaaactacaaaaagttgagcttggcaagatccccgccaattttcctctggtgggtttaaaccttcatcactatggtgcagtcagtgcattacgtatccgccttgcctgtaagggaaagctctttctccacgatttggatcttaataaactgaccttttttctttcagggccagatattcaatcccaaaaactgctggaactgataatggagcactcggttgggatggtatgccaaactcagggagcctccccacaatacctgacattgcctgacattgctccacatcatgaaggttttgatgatgagcaagccctcttacccaatgatccccgtaatttcagtggatatcgccaggttcaagaatattttgcctttccggcacgttttcgatttttcagtatttgtggtatgcaacctttgctcaaggagaccaaggaagacgttgaattcgaacttattctgctcttaaacaaaaccgatagccgtttggaaagcctgatcgatatttcctatctggcattgaactgtacacctgtgatcaatttatttcccaaaatgaccgagcgattgacggttgatgaaagtaccaatgaatatcatctggtcgtggataacacccgtccattagattacgaaattttttccgtgcaacgtttactcggtatcgatgcacaacataagcaagagcgtatatttcgtcctttttggtcaactaatagcgatgatcctgataattacggtgcctatttttcactgcgccgggagccacgcatattgtctgaacacgcccatcattatggcacccgcacgagctatatcggcacagaaacatttatctctattgtggatgaacatcactctccgtggcctgatacattaaggtatctgagtgccgatgtgatgtgtactaaccgagatctacccgcaatgttgcggcaaaaagatatcaatagctttgccatgctggactccatcccgatcagtaaaattgagtttattaaaaggccgaccatccctcgccctgctctggctgaaggggctgtatcatggaaattaatcagccagcttcaaattaattacatgaattttatggatcaaaaccaagaagaaggcacccagacgctacgacagctattaagtctctatgccgaccttgctgagccagcagtcgtacgccagattaatggcatacgacactgctcattaaaagaagtctatcgtagagtgcccgatactggccttatcgtctttgcccgtggtgtcagcattaaactcgaagtcgatgagcaggagtttgccggcgccagcccgtggcttttaggcagtgtgctggaaaaattattctcgcgtttggtcaccataaacgcctttactgaaatgacactgtatagccagcaacgtggacaagttggcttctggcctgcccgcatgggcagcaagaagttaatataagtgatgtgtggggacaagcccacaaagtaacaatgtgcgagaagatgggaattgaatatgaaaacagatattacggccattcatcgtgtatgccgcttgccagagtatttttggcaacaactcacccaagccccctggcaatttgatctgttccagaccctacgtcgcattgatgcccaagcgggagggtattaccgattagggacagccccattaccacgctatgaacctttgcgcttgggacaaaaagcgtcaatggcattcgcaccttccacaatttccacagtccatcagttaaaaaattcaaaactctacgaagtacttatttacagcttcggattatttggtcccaatggcccattacctctgcacctgactgaatatacctattcacgggaatataattatcaagatcccactttgggtgcctttaccaatctatttcaccatcggctgatactcctgttctatcgagcctgggccaatgcacaacctacctcatcattagatagacctgacaaccagaagttttgtcattatatggcttgcctgatagggatgggattgtcagcccagcagaattccaacccggtcaatcacaatcacattacccgtaactctattaacaatcatgcccattacgcgttgtccggccatctttcccgccagaggcataatgcggaagggttgaaaaaaataatgcttttttatttcaaggttcccgtaaaaattatccaaaatattccacaatggttgcagattgaaacgcaagatcaggcgcgactggcagcaggacgtcatgtgccctgtttaggtaagtccgccattttgggcattgcaatacatgatattcaacataaattccgtattgaactagggccattaactcaggcagagtacgacatgtttctgcctgaacagacgaaatctcaacaagtgcgtgagtgggtttatcaatacttaggtatcgagtacggctgggatattaggctgatacttgataaatcagacatcaccgaaatgcgcctgtcagaaacggggaaattgggactcaatagctggctgggtaaggttaacaaatcaagccattatgatgacttaatctacaaccctaaatcctgcaagacgcattaaaacctattcctccttcaacaccaatattgctgcgggtatatttatgccagaaatcagccgttctgtactctttggtaaactcaatcgtgtactcttcacctcactggaaaatgcgacaactttctgcaaactacgcagtaatccttatgtcgagttagtccattggctgcaccagcttatgcagcaacaagactgtgatttacaatcggttatccgttactttgcattagatgaagccaagctggcaaaagatattattacagcactggatcgcctgccacgtggagccagtgcgatttctgatctttccgaacatattgatagtgccgtagagcgtgcctgggtatatggatcattaaaatttggtgttgacaagatccgtaccgcgcactggctgattggtatgttaaagactttcaatctgtacaataccctgaaagccatttcccgacagtttgaacaagtcaatgcagatacgttaatagataatttcaacgccatctgcggtaatagcagtgaagaaccggagaatgaaccaccctctcatcattcccaaccgacaaaaccacaatcctctgacagtgccctgcggcaatatgggcaaaatctcactgatctggctcgccatggtgatattgatcccgtatcaggacgcgatgaagaaatacgccagattgtcgatatcttgatgcgccgccgccaaaataaccccttactgaccggtgaagctggggtaggaaaaaccgccatcattgaagggctggcattgcggatcgccgcaaatgaggtacctccaccactgcaaaatgtgcaactttggttattggatattgggatgttacaagccggggcgggaatcaagggcgaattcgaatcccgcttgcgcagagtgattgacgaagtgcaatccagcccccttccgatcattttattcattgatgaaatccatacattaatcggtgcaggcgggcaacagggaacgggggatgcggccaatttacttaagcccgtactggcacgtggtcagttacgaacgcttggagcaaccacctggtctgaatacaagaaatatattgaaaaagatccggccctcacccggcgttttcaggtcgtccaaattcatgaacccgatgaagccaaggcacttttgatgctacgcagtctggtctggacgctggaaaaacatcaccgtgttctcctactggatgaggccgttgaagctgccatacggctttcccatcgctatattcccgctcgtcagctacccgataaggctgtagctctattagatacggcatgcgccagagttgccattagccaaaacgctgaaccaccacagttggaaaattgccgacataaaatcgatgccttgaagattgagctagaaattgttgaacgagaagcaaaaatggggataggcgatcagcaacggtcaaataccatcctcaatgcgctatccctattggaagaacaacttattcaattggaaaaccgctggcagcaagaactctccttgattaatagaattattcatctgcaaactcaactttatgccccctcctttcatcaacaacagcataatgatcccaatgccctgcatgaagagctaatagcattgcaacaacaattaaaaacgttacaaggagagatcccccttatctttgcttcggtagacagcaatgttgtttccgccgttgtctcagactggacgggggttcctcttggccgcatggtaaaagacgaaattaatgcggtattgcatttggtggatacactcaaccaacgtattatcgggcagtaccatgctttagagttgatcgcaaaacgggtacgaacttcacgggcaaaattggatgatcccaataaaccggtgggggtgtttatgttatgtggcccttccggtgtcggtaagaccgaaaccgcgctggcattggcggaaacgctatatggtggcgaacagaatcttatcaccattaatatgagtgaatttcaggaagcccatacggtatccaccttaaaaggggcaccaccggggtatgtgggttatggtgaagggggagtattgaccgaagccgtgcgccggcgtccctacagtgtggtcttactggatgaaattgaaaaagcccactctgatgtccatgagattttttttcaagtctttgacaagggttggatggaagatggtgaaggccgccacattgattttcgcaataccattattatcctgacatccaatattggggctgatttggtgagttcgctgtgtttacaacaggctcctcttccagatccagaaaaactgagtaccgcattgcgaaaacccttactgcacgtatttcctgctgccttactcggacgtttgattgtcattccttactatccattgagtgataatgtgatgacaagtattgttcacctgcaattggcaaggatcaaaaaacgtttactggaaaaccatgacattgtagctacatttgatgaacccatgattaaatatatcgttggccgatgtacagaaatcgaatcaggtggccgtatggtagatgctatcctgaccaactccttgctgccgcagatcagccagctcttgctctctgctaacgcgaatggtcagcaatatcatcaattacaagtctctctcggacaaggtgagtttcagttccagttcatggaatgaacttgtgattaagagaatatttattaggggttgttgatgttttaaggtcatcgccctaatcacgtcatccatctctgagtaaaattattcattctgattatttgcaacaagtcggtttttcaggtgaagccagcctgccggaatacattgggttggcatgaactatttctggcgtatcgttgcatttgcagattgtgtctgtcacatatattaaaagctgaatttaatgtagggggagttatgggagaatatcggcacacaatttccaatattatagcaatgcctagtgatgtgctgctgcagaaaacggttgaggtgatttttcatcaggagaagcgatttcattattttttagatacaccaaaacataaaccgggagatcggctcaatattataggacacagctctccagtgggcagtccaatattatttgcgggagcatatgtgaatagttttggaatgaatccgcgtgttttttgccaaacaatcaatgcattattgactgatataaaaaatagagggaaaaatatccaatgtgtcagaataatagcttgctactctggagcaaataatcttgctcaaaaattagctaattatatcaatatgccagttaaaggctcattaggaggcacacgagtttatccaacgatgcaatttcattcaatacccaatataaaccgtcattttattgataagacagatataggtggtcactattatttcgaggagagggagagacagttgatgcatgatccctcctatggtttgtataggtggtacaaacctaaatcttcaaatccagatagtgaatttgatgagtttgctagtcaacgagtatcaagacttcagcgttcagattcagacagcgaatttgatacgtttgttagccaacgagtatcaagacttcagcgttcagattcagacagcgaatttgatacgtttgttagccaacgagtcaaaagaaaatagtcagtagcataacggatttaacggttctgtcgcattaacaaagaaagtacgagtgaagatgaggtgattgatttttactcagctaattgatagaaaaatgccgcgggtgaaatcggacacccttctttttgtcggtattgtcctttgcgcaacatacagacccattcaatcccggccaacacggtctgggcccgtctgaaattcttgaatcccagcataggacgtgttcgccgtttgatgttgcggtgatcctgttcaatcagattattaaggtatttgttttgccggataatgatgtcgttatccttaggttttccctgatttaactcgtccactgcggctttattggcgccacttttatccatcgtcaccacgtcaggttgtccatgctgacgcatcgcctttttaaagaaacgcaaggcggcctccttatctcgatgggctgtcaacaaaaaataaaccgtatcgccgtctgaatccgcagcacggtaaaggtaactccatttccctttgattttgatagaggtttcgtccattcgccaccgacgcccaacagcaggcttgctccgtcgatagcgtttgaccctcaacgggatcagatgatgaacccagcgggatagcgtggaatgatcgacggttatcccccgctcagctagcattccctccaggtcacgcaggctcagcgcataggccagataccagcgaacacactgagcgataacatcggtgggataatgcaggcaccggaaggcttttcggataaggaacatcggtgaatcactcaacaaaaaaacagcatgatacccggacacggcttaatacgacagaaccaactttatttgcaacagtgccgtttgttctcgagaacgtaaactatcagacccccattatcagattgaagtttcccttgattgaggtaatcaccgatatggcggtcaacggtggtctgatggagtcgctatgccttgacgatcatcacagaactccacccttcagaagccagaaggatagcttttattctgtctcgtacttgaccatcgcgagttgtgtcgtgaagacgctcaagtttgattttttgttctgatgtaataaatattttcatagcgaggataatgatctccatttcggataaaatcaagcaccttcaatgattacgggtatattaatatatagaattgccacaatctatcttttatattaattttcacagagtaaatctttctatttcgcaaaataattttaatatcattattaatgtattttacctatgaacagtggatttaataaatacgcaaaatcaatagcaaatttaaaaattatgaaggatatatattaatgaactcaaatgtctatttactccttaatgcagataataccagatataatgaaatattaaaaagcgcagacatagcctaccctcaacctatcagtaacgattggcctgatcttcctatcgagtttcaaataaatattgatgatgtgattaatttaaatggttatttatatttttttaaaggctcgcaatatgttaaattcggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccgttttttgtatatagtgataatcagacaacagatgtggcaatccagataactctctcatttctgacaataggttttatgtcgattaagtggcagaataggggatcacgcccatttaagtcgttggatgagaaaagtgaaaattttggttgatgaaaatatgccttacgctgaacaactttttcagcaattaggcgaagtacaggcaatcccggggcgcccagtccctgcgggtgctctggaacaggctgatgcctttatggtgcgttctgtcactaaagttaatgaatccttgttgaaaggcagttctgttaaatttgtgggtactgccactgcggggatggatcatgttgatcagcaatggttgtcgcaggcaggaattggcttctcagccgcgccgggatgcaatgcgattgcggttgttgagtatgtattttctgcactgatgttattggcggaacgggatcaatttcaactcaaagataaaactgtcggcattgtcggtgtgggtaatgtcggggggcgtctggctgatcggctggctgctttgggtgtgaaaaccttactgtgcgaccctcctcgtgtcgatcggggtgatgaaggtgaattctggccgttggaaaaattagtacaggaagcggatattctgactttccatactccgcttaatcaatcaggccgttatcagacttatcatctggccgatgcaggattactttctgcattaccggacaaccgaattttgattaatgccagccgtggtgaagtggttgataatcaagcactactttcagtattgcaaagtggaaaaaaattacgtgttgtgcttgatgtctgggaaccagagcctaacctttcattacccttactggctttggttgatatcggtacaccccatattgcagggtacactctggaaggcaaagcacgtggtacgactcaggtctttgaggcttactgcgaatttctggggcaaccatacagggcggaattgtccgaccttttgcctgaacctgatttcagccatatcaccgtacatggcgaagtgacacaaagcatcctgaagcgcttgatacatttagtgtatgatgtgcgccgtgatgacgcaccactacgtcaggtcgctgaacagaatggcgcttttgaccgattgcgtaaaaactatccagagcgccgggaatggtcttccctgacggtgcattgtgactcagaaagcagcgcccaattactgtctgaaattgggtttaacgccaaagtgatttaatacaggcaggcgttcctgcctgtcagcaaaataaagaagtggagaaaaccaacatgtcagaaggctggaatattgcgctcttgggtgcaacaggcgcagtaggtgaagcgatattggcgttattacaggagcgccagtttcaggttggtgaactgcatcttcttgccagtgagcaaaatgctgggaaaattcagcgttttaatggtaaaagcatcaccgtttatgatgccgcagaatttgattggtcacaggtgcagcttgcgttttttgctgcgacgaaagaagcaacggcacaatatgttgaaaaggcaacggaagcgggctgtctggtgatcgacagcagcggattgtttgccgcagagccggatgtacctctggtcgtaccgggagttaacccacacgctttggctgaatatcgcaaccgcaacattattgctgtggcggacagctcaacaagccaggttttgacggccattaagccattgatcgatctcgcaggtattgcacgtttaaatctgaccaatttattgccggtttccgtacatggcaaagccgccattaatgaattggcagggcaaagtgcccgtttattgagcggcgttccgccggatgaaagtctttttaacaaacaattagctttcaatctgctgcctttattgcctgatgccgaaggctcagtacgtgaagagcgtcgcattgtcgatcaaattcgcagaatattacaggacgaagggctacctatttcagtcagttgtgttcaatcttcggttttctacggaattgcccagatggtgagtgtggaaacactgcgtccagtcggcacagaagaagcgcgtgaagagcttgaacgttttgcagaaattcaggtctcagaagagggagattatcccactcaggtcacggatgcatccggtagtgacaggttgagtattggctgtctgcgtaataattatggtatgccggagatgctgcaattctggtcggttgccgacaatatccgttttggcggtgcgctgatggcggttgaaatcgcagaaaaactgatgcaggagcaattctactgatgtctgatgcagagctgagtcagtctgtaccagaggcagaaaaagtgaaaattgcactggggattgaatatgatggcagccgctattatggttggcagcgccagcaagaagtaaaaagtgtgcaggaatgtctggaaaaagctttgtcaaaagtggcagatgaaccgatttcggttttctgtgcaggcagaacggatgcgggggtacatgctactgggcaggtagtgcattttaaaacctcagcacaacgtaaagatgctgcctggacaatgggagtcaatagtcatttgccacccgatatcgcagtgcgctgggtaaaaacggtggatgatgaatttcatgcccgtttcagtgcaacggcacgtcgttatcgatatataatctttaaccatcgctatcgccctgcggtgttagcacagggcgtcacgcattttcactatctactcgatgagagaaaaatgcatgaagcggcgcagagtttactgggagagaatgactttacttctttcagggcagtacagtgccaatctaattcaccgtggcgcaatatgatgcacattaatgtcagtcggcacgggcattatgtggtggtggacattaaagcgaatgcatttgttcatcacatggtacgtaatattgttggcagtttgctggaaattggttgtagtaatcaggatatcggctggatggctgaactactggcactgaaagacagaacaaaagcggcggcaacagccaaagctgagggattatatttagttgcggtggattatcctgagcactttggtttacctgcacccactatggggccgttgtttctagctaatgatttaatctgacattttcaaaatgtgacagggatgttcgagcataacgaggaatattatggaatttttaactcattttgttgattttgctaagttcattgtcgattttattttacacattgatgcacatttgaaggaattggtcagtgattatggcaattgggtatatggcatcttattcctgatcatattttgtgaaacgggtctggtggtcacgccatttttgccgggagattcgctgctgtttgtggcaggcgcattatctgcattagattccaatgatctgaatgtgcatattatggtggcgttgatgattacagcggcaattattggtgacgctgtaaactatacaattggtcgtatttttggtgaaaaattatttaccaacccgaattcaaagattttccgccgcagttatttggataaaacccatgagttttatgaaaaacacggtggaaaagcgataattctggcacgatttgtgccgattattagaacatttgcaccgttcgttgcgggaatggggaaaatgtcttaccgccattttgctgcttataatgtaatcggtgcatttatatgggtgctattattcacgtatgccggttatttattcggcgatatgccaatcatacagcagaacctgaaattattgattgttgcaattatctttatttctatcctgccaggcatcattgaaatttggcgtcatcgacgagctgcatccaaaaaagcagtagatggcaagtagataaccgttagtaggtttgaacagtttttttatccacactgtaatggcattgtggtttaatggcacgtaaaacaaaagctggcataggccagaatcagacggaaaggttcattaatgagctggattgaaaagattctcaataaaagcaaaatcatgcaaactcgtaaggcaagtatacctgagggagtttggacaaaatgtgatagttgtggtcaggtactttatcgtgctgaattagagcgtaaccttgaagtgtgcccgaagtgtgaccaccacatgcggatttcagcccgtgagcgattgcatacatttctggatcaaggaaccggtatcgaattaggcagtgaactggaacctaaagatcttctgaaattccgtgacactaaaaaatacaaagatcgtttggtagcagcccagaagcagacgcaggaaaaagatgcgctgattgtgatgaaaggctcactgtacgaaatgccagttgtagcaggatcatttgaatttgcctttatgggtggctccatgggctctgtagtcggtgcgcgttttgtccgcgctgtcgaacagtcactggaagacaactgcccactcgtctgttttacttccagtggtggcgcacggatgcaggaagcgctgatgtctctgatgcagatggcaaaaaccagtgccgcgctggcgaaaatgcaagatcgaggtctgccttatatctgtgtcctgactaacccgacgatgggaggagtgacagcaagtctgggaatgctgggtgacatcaacattgctgaacctaaggcattgattgggtttgctggtccccgcgtcattgaacagaccgtgcgtgaaaaactgccggcaggcttccaacgcagtgaatttctgctggaaaaaggcgcaattgacatgattgtacgtcgtccagaaatgcgtgagaaaatagccaatctgctttcgatgttgactcgtcagcctcatcccggcacaaaagtagaaacggtagcggaaatggttgctgaacccgctgaggttgaaactgacataaacatcaatcctaataaagaagatgtctgatatattgcaaattcctcaagccacgtcgtcactgataacgtggctttcctatcttggaaatctacacgcaaaagccattgatatggggcttgaacgtgtgggagcactcgccgatcagttagatttgctgcatccggcgccgaaagtcatcaccgtgtccggcacgaatggcaaggggacgacttgtcatacccttgaatccattctactggccgctggcctgaaggtcggagtgtacagctccccgcatctggtgcgttataccgaacgggtacgtatacagggtaaagagccggcggaacaggatttctgccgtgtattcgcggacatcgaagctcaacgtggtgatatcacactaacctattttgaatacggtactttggctgcgttacagctttttaaagaagctgatcttgatgtcgtcattctggaagtggggctgggcgggcgtctggatgcgaccaatattgtggattcagatgttgcggcaatcaccagcattgcactcgatcatattgattggctgggtgcggatcgcgaacatattggccgtgaaaaagcaggtattttccgtcaggggcgttttgccgtggtgggggagcctgatatgccacataccatcgctgaagtggctgatgagctgggagcgaaattgtttcgtcgcggtgctgactgggatttctcacaggatgcgaacagttggtactggcgcacaggagatcaacagttcagtgaattacccgtccctaatctgcctctggcgaacgctgcaacagcgatgggagtgatttactgtctgttgcagcagaatgataacgtcagtcaggccattaatgaacaggcgatccgtgaagggttaagtaaggctcagttaccggggcgtttccaaatcgtcagggaaaacccgctggtgattttggatgtggcacataatccccatgcagcaggttatctagtacagaaactggcaaaattgccccgcgcaccagacagtaagatccgtggtgtcgttggcatgctggaagacaaggatatagcgggtacgcttgcttgtcttgcccagcaggttgacgaatggtactgcgcatcattgcatgaattccgtggggcagaagcaaacatattggccgagcaccttggcgatgcccgaacatttgtggaagttgagcaggcatggcatcaggccatggcagaagcctcagtgcaggatatcatcgtggtctgcggctctttccatactgttgctcatgtcatggaggctctggaggaggtgaaggaaggtggcaagtaaatttcaaaatcgtttagttggaaccctcgttcttgtggcactgggtataattgtgttaccggtgctatttgacggcgataagaaacataatgaaagccagtttgcttccatcccgctggcactcaagcctggtgatgaagaagatatcgatttgattgcacccctgacgcaggatatgccatcgacaccaccggaaggggcggctgaagcgatggcaaagcaagcacaagagctacagccagatatgctgtccagttcgttattgtcagagcctgcgccaatggcaccgccgcctgtggagatcacacaagcgcccaaagcgacggttaaatctgaacccaatcctcagccaaaggtggacgttaaacgggaaacgagggctgaaaccaaacctgaagttaagtctgaaagcaaaaccacgccagtaaaggcaccgcagggagtggcatatgttgttcagcttggtgcattgaagaatgcgggtaaagtggatgagattgtggcgaagctgcgtctttcgggtcatcaggtctatgttattccttcttctccagtacagggagaactaacgcggatttatgtcgggccgaatgcatcaaggcaaacccttgaatccactttgcctgaattgaaagaattgacgggtttgcaagggcaaatcaaaaactacagtccctgacttattggcgtcttacgggaagtgtctggcttcccgtcgtgatagttacaggttaggtttttgcggcgattgttgtttttgaatctgttacgaattattttcagtagactgaaaaatctgctacgcaaacgttttcgttttctgttagaatgcgcccgacctgaatgtcgggagcctgttttggattagaatatggtctggattgattatacaattattgccatcattggtttctcggcactggttagcctgatacgcggttttgttcgcgaagcgctctcactggtcacttgggggtgtgctttctttgttgcaagtcacttttatacttatctggcggcttatttcacccgcctggaagatgaactggtgcgtaatggggtagcgattgctatcttatttattgcaacactgattgttggtgcagtcgtaaactatgtgcttggttcacttgttcagcggacaggcctgtcaggtactgatcgggttctggggatctgttttggggcactgcgtggtgtattaattgtttctgcaattttatttattgcagattctttcacgccgctccctaaaagtgaggattggcaacagtcacaactcatcccacagttcagtcaaattatcaggtggttttttgactacctgcaaaacgcgtcgagtttcctaccggagaaatcactctctccgcttggctgatgaggaaaaactacatgtgcggtattgtcggtatcgtcggttttacaccggttaaccagtcgatttatgatgcattaacggtgcttcagcaccgtgggcaagatgcagcaggcattgcaactattgatggtaacaatgagttccgtttacgcaaggccaatggtttggtcaaggacgtgtttgagacacggcacatgctgcgtttacagggaacaactgggatcggacacgtccgttacccaacagcgggtagttccagcgcctctgaagcgcagcctttttacgtgaattcgccctttggtatcacactggcgcataacggcaatctgacaaacgcacataagttgaaaaaaatgctgtttgaacatgcacgccgccatgttaataccacatcagattctgaaatcctgctcaatatttttgccaatgaacttacccaattcccggattttccactggagccagatgatatctttgcggcgattgcagagatgcacaaaaaaatccgtggagcttatgcctgtgttgccctgattattggacatggcttggtggctttccgtgatccgaacggtatccggcctttggttctggggaaacgtgtgctggaagatgggcgcaatgaatatatggtcgcatcggaaagcgtggcactggatacattgggttttgaattcctgcgtgatgtggcttctggcgaagcgatctatatcactgaaaaagggcagttatttacccgccagtgtgtagaaaatcctgcattaacgccttgtttattcgagtttgtctattttgcccgtcctgactcctttattgacaaaatatcagtatataacgcgcggttacggatgggccggaaactgggcgaaaaaattgcccgcgaatgggaagatctgcatattgatgtcgtgatccctgttcctgaaacgtcttgtgataccgcactggaaatagcccatattctggataaaccctaccgtcaggggtttgtcaaaaaccgttatgtggggcgcacctttatcatgcccggccagcaggaacgccgcaaatcggttcgtcgtaaactgaatgccaatcgtgctgaattccgtggtaaaaatgtcttgttggtagatgattcaattgtacgtggtacgacctcagagcaaattgtggaattagctcgcgaagctggcgctaagaaggtctattttgcttcggcagcaccggaagttcgcttcccgaatgtctatggtatagatatgcctaatgctaatgaactgattgcccacggtcgagaagttgatgaaattcgccagctcattggtgctgatgcgctgatatatcaggatcttcgcgatcttatcaacgcggtgcgtgaagaaaaccctgatattgaaaaattcgaatgttctgtatttgatggtatctatgttacgaaagatatcgaccagatttacctcgattatctggagaatcttcgtaaagatgatgccatgaaattgcgtgggcagagcgaaattgaggatctggaaatatataatgagggataataacatatttattatcatcaaattatttccagtatctcagagggaagcatgaaaaaattgattgtcgggctgacgggagcaagtggcgcgatttatggcgtcagattattgcaggtcttgcagtcggttgagggcattgaaacgcatctggttatcagccagtctgcccggcaaacattggctctggagacggattatacgctgcgggatgtgcaggcactggctgatgtggtgcatgataaccgcgatatcgctgcttctatctcttcagggtcatttaaaaccttagggatggttatcttgccctgctcgataaaaaccctgtcgggtatcgtgcatagttatactgatggcttgatcacccgtgctgctgatgttgttttgaaagaaggacgcaagctggtattgagtgtccgggaaacgcctctgcatttagggcatttgagattaatgactcaggcggctgaaataggggcggtgattatgccgcctgtgccggcattttaccaccgtcccgatcatattcaggacattattgaccagacggtcaaccgagtactcgatcagtttaatatcgagctgccacaagatttattcaaccggtggcagggagcgaaacaaattgaaatttaaggtgaattagcttcctcctttaataaatctttgaaggcttcctctaattcaaaatagcggaagccgaatcctccttcttccagccgcttgggaatagcctgttgtccacctaaaaccagcatagcagcctctccaatgattatttttaatacaaaagcaggcatgcgaatgaaagcggggcgatgcagcacgttcgccagtgctgcactaaacagatcattatgcacaggataaggggctgtcatgttgaatgggccgctcagttcaggtgataccagcaggtaatagataccattgaccatatcatcaatgtggatccaaggtatatattgcttcccatcacccattttaccgcctaaacccaatcgaaatagtggcagcatttttttcagcactccgccgttacttgccagcacaattcctgtccgcagcaggcacactcgggttttttcactttctgcctgtaatgccagtgtttcccactgcttacagagctgatgggcaaactcgtcatgaggaagatcattttcagagactaccgcttgcccctgatcaccgtaatagctaacggctgaaccggaaataaatacagaaggcggaaattcactggcattaatcaaatgacttaatttctcagtgagttgccagcggctttgacagagttttgttttttgtgctgatgtccagcgcttatctgcaatgggttcaccagcaagattgatgactgcatcaaaatcattcaggttatttttattattcagtgttgcccaacattcaacttgttcggagaacagagaatataccttttgtggagaacggctcaaaatggtgatggaatgggaaagcgaaagtaattggcaagtcaatcgataaccaatcagccccgtacccccagtaattaagatacgcatagccacccccagtgaccaaatagatagtcgattattgactatagcaggggatggcctgcgtaacagcgaaaaatgctgttatctgttagcagtatcaagtttttcggtgaaaaattttgtcgttagccgagtaagcatgattagccattgttgtatgcggcttgtgttgcagggcgttgttcaattttcttaagccatttttcaaccgcagggtaatcattcagattaattttttgatgttcatgacatctagcccacggataggtagcgatatcggcgatgctgtactcatttccgccaagatacggcgttttttccagttgggtattcagaacattgactaaacgccgtgattcttccatatagcgattaatggcataaggtacgacttcagaagcgtaatgattgaaatggtgattttggccgagcatagggccaaagccggcaacctgccagaatagccattgcaattgctgattgcgttcacgtacatccttgcttaacagttgaccggttttattcgccagatagagtagaatagcgcctgactcaaagatggaaatgggttctcctccatcggcgggttggtgatcaacaattgccggaattttattattaggcgaaatggccagaaattcgggtttgaattgttctccggtgccgatattgattgggtagatagtgtaaggtaggccggcttcttcaaggaacaatgatattttatagccgtttggcgttggagcataatataggtctatcatataacctctggtaataataacggattggtaaatatagtttcagtacattaccactgatttgagttgtctgtaaaatgccacccatccgtcatttcactgtgcgtggatttattttattcagttatggcaacctttatctttggccttttaattaggcgcgttacagtagaaactggcatgcaaatcgtttattaaggtttttgggatggtggaagagaaatcagcaggtattgagtggattgatatcgtcaatgaaggcaatgaagtgatcgcgcaggcgactcggcagcagatgcgtagccaaaacttgaggcatcgtgcgacttacattgttgtgcatgatggtatgggcaaaattctggttcagcatcgtacagaaacgaaagatttttaccctggaagattggatgcaacggccggtggcgtggtcatggtgggagaaaacatgcttgattctgcccgccgggaagcagaagaagagctggggatcgcgggtgtgccttttgctgaacatggtatcttctattatgaagaaaaaacctgccggacatggggagggttattcagttgtgtcagccacgggccgtttgcattacaggaagaagaagtctcggctgtttactggttgtcgccagaagaaattactgcccgttgtgatgaatttacgccggattctctgaaagccctgtctttgtggctagcgcgtaacagacagagggaactgcctgaaaatggatgacgtaatgactttcattaccccttaatgtgcaagctcctctttatgaggagctttttatttgtctcttttgcaagttagcggtatgagatctagttgacattatgattgatgagcttggaatatatcccttatgaatattcaggttattgctgattaattaatatatgtatgtgaataaaaatgaataaaatagtttagtctattgttttaaaaacgccctttataaattagagaattttactattcacagtgattaaaaataaaaattattatatgcagcatagaattcaattaaataaaaattctaagtaaattaaatcaatagatatgattaaagcattaatttcaaatcatgaaatatcaaatattcattactgaatgattctgattgatgagtttatggtaaaaatgattaggtaagtatgattaaataagcatgacaatataatattgatattatttataaaatcatacattaggtatgatattttcttatgggtctgttaaaataaattatcggcaataattaactaatcttctgtattgtcatggtttaatattcttttttttgccagtttaccagtaattgcgattttatatattaatggcttgttattaactatttgtttttttaaaaaaaatcaaaaacacatacgattcaggtgatttttttaaggaattgaaagaaaaataaattaaaggtataccaatatagtgttaaggaaaaacatcagaattttatgttccaaatgatattcataatcaattttgtaacatgggaaatgataaatataagatgatcacctgtcaaaattgtaacaaggaaaaagctttatgattgcatttaacctcaaaagaggtctaactatgataaattacgctaattctttttggtgtaaagctattaatattgctattgttggtgtaatttactttttcctgatgaatatatcgcgagttgcttcatctattggcgattatctgatcttttttttatttttttcttgcattcaaatttctgttgaaataatttatgataatatcaatagcttttcttcgaaataccttaatcagactctgttaaataatgttatggcactaattgaagttaagggaaattatcgaggtttttatcagttgtggggactgattacctctatgtactggtgtttcattttttataaatactacctatttactccttattatcaaaaataagagttttgtcatggctttttagtggttttttactttgtttatttttccataacgttgttatattagttttgaattattgtcctgctgattttttgttgtaatctatttatgaacgttattgtttcgataatggtattttaattagtcagagtggtctatattattttgtaatggtctttttgtattaaatagcaaagaatactgatcgatatcaaagaaagcatattatttttagataaagataattgaaatttttggcagtataaaaatagctataacaggcagagtaaaagtagctataacagttcaaaacactgtgctacggaaaaaagaataaaaaaaattaccccagaaaaatatatataatattcttgtaagaatattacggtaatctactttggctaatatatgattcgatcatatatcaaggaggtattgggtagatacagaattattttttctggttgagtatggcggtgaaaacactcactcagtatataaatctatgctgtttacgggggtgttttattcaatacacgaggaatgtatgtctgagacatattttttgcatgataggaaagttcgtggggatatagcgattgttggtatggccagtcatttcccggatgcaccggatttgtataaattctgggaaaatatcatcggcaaaaaggactcgctgactgatgtctctaccatgttaggagacgaatattggcaaaaagaggatttttacgatcccaacccggcagtggcagataaaacctatggccatcgtgctggctttgtgcctccgattgacttcgatccggtggagttcaaaattccacccgcgattattgactcaattagtacggcgcagttgtttgcactctatgttgctaaacaggccatgctggatgcgggcttggttggacaggagaatagcagggtagaccgtgatcgtatcggcgtcattttaggtggcgcaggaaatggcaacacgtcattttcactggcttcacgccagcaggcaccttacttacgtaaaattatggtcaaatccggcctgtcagaaaaagtggcaaatgacatcatcgaacggatgcatggcatgtaccttgaatggaatgaagacagtttcccggggtttttgggtaacgtcgcttgtggccggattgccagttattttgatctcggtggcacgtcttatatggtagatgctgcctgtgccagtagccttgcggcaattaaggccgctatcggtgaactgcattctggtagttgtgatgccgtgttaacaggtggcgtcaatttggaaaactccattttttcattcctgtgtttcagtaaaacaccggcattgtcaaaaagtaatttgtcccgtcctttcgatcagagtgctgacggtatgatgcttggcgatggcgtgggaatgctggtactgaaacgtctcgaagatgcggaactggatggtgacagaatttatgctgtcatcaagtccattgaagcttccagtgacggcagagccaagagtatttttgcccctcgtctggaaggacaggccaaagccttgaggcgggcttatgccagcgcagggctctcgcccaatgatattcaattggttgaggcgcacggcacgggtacggcatcaggtgatgatacagaactaaaaagcttacacactgtgtttggtgaatatcaggtgcctgcaaaatcggtggcaattggcagcatcaagtctcagatcggccatactcgttgtgcagcgggtgctgcgtctatgatgaaagtcgcgttggcactgcatcataaagtcctccctcccactctcaatgtggataagccgacaaacttgctgaaagcagaaaacagcccgttttatgtcaacagcgaagccaggccatggttgcgttcattcaacagtgcaccgcgtcgtgcggcactgagtgcctttggtttcggtggcaccaatttccatgtcattctcgaagagtatgaaaaacatacacatgggcgttaccggctgaatgaatcaccttgggttatgctgtttaaaggtcataatccggcggaattgcttgcacagtgtgaagaagctctgacccgtttcagtggtaacttgcctgatatcgccatccgccaacatcttgagcagcaggacattgacagcttacagccgcaacaggccagagtgctgtttgtctctcaatccgcagaacagaccgttgaattgttgtcgattgccatcaaacagttgcagcagaatagcactcatggttgggaacatccgcgcgggatctattaccagccccaaggaaaaatgctggatggcaaaattgttgctctgttccccggtcaggggtcgcagtatgtcaacatggcgcgcgatattgccaacgattaccctgaaatgcggcaatcgctggaaacactggatgaagtatccatcagcgaattagggcatgaattatcgccagtggtttatcccgtaccgaccttttcagatgacgagcgccagatacaccaacaacggctgacggacacggctaatgcccagcccgcattgggtgctatcagtgccggttatttcaatattttgaaagggatgggattcgtccctgattttgttgccggacacagctatggtgaagtcacggcactctgggcggcaggggtgttttccgataagaatttccaccgcgtttctcttgccagaggctgggcagcagcatctgccagcgatcaccgtggggcagatactgatgctggcgcaatgctggccgcgtcgctcaactctgcacaacgtgcgcagatcctggaacgctatagcggcattatcattgctaatgacaactctcagcagcaggtggtattcggcggtgcgacacccctgatccaccagctccatgatgagttgaaaaagcgtgatgtgcactgccgtattctgccggtttcagccgctttccataccgcatttatcgagccggcttatcagccttatcgtgaacgtctggcaggaatcaatttccagtcaccgcaatgcagactgttctccagtgcaacagcggaaccgtatggaaattctccacaggcgatccgggaattgttagcggagcaattgatcaagccagtgcaattccgccaaaccattgaagccatttatcaggaggggggtcggttgtttgtcgaagtagggcctaaaggggtcttgggcaaactggtggccgatatcctgaaagataaagaacatgaggttatttccgttaatcccaatgacaaaggggaagatcggttacagtttgcccgtgctcaagctaaattgctggcggtaggtgtcaaactcagagaaataaatcagcacatacggccccaaccgatggcagaagacaaaagcaaacgtctgacgttcagaatgagtgggggtttttacctgtcccaaaaaaataaggcacgacgccaacgtgcgctacgtgatggcgacagcgcgattgtcgaacaatttatcgctgaatctgcacctgtaccgatggctccggttatgcctttgcattcccaaaaagaagtcaacatcaaagaagaacattcaggcaaagaagtcaaaccaacacaagaagtacatccaacacaagaagttgtggtagaaaaagttgaaaataaagtcgaaaaaatcgccgaaaacaaaacaatttctgcccaatttattcaacaaaatatgctgacaatcattcaaagacgagagagcacgatggaacagaacaatcagttgagtgaaaacgtagatgtaaacatgttaaatggactgttgcaggctcaacaggtcatgagccagcttcaccaacaatttcaagctaaccagaaagactatattcaactgctgggaatgttgttggataaacaatataccctgctggaaacctgtaaggatcatcagaacttgccgagcatgttatccagtctgagtcaaagcgttcaattactggacaaaaatcttgagttgtatcattccaaccatgaacactatttcatggctcaacaaagcttgttccagtctggtcaagtgacaccgatgatagcacccacccatcgtacgtcatcgccggtggtggattattctgctctggccaaagtgaccacttcggcgacaatagcgtctgctccagtatcaacgccaattccaactccgattccgacaactgccccagcagtgaaggttgacacggctcctgtacaggccaagcctgtggatccgataaaggaaattgagccagtgcgttcaatgatgccagaaatgcctgtcatgccatcagtggtagaggaagctgttaaaccaatagtgaatgacacacctgtcagtcagcctacacctgtagtgattgagacaaaggcgaaagtccttgatccgaaagtagaaaaacagttccagatcttgtcacaaatcactgaagagaagattgtcaaccaattaatctccatcgtcagtgacagaaccggttacccgcaggatatgatcacgccagaaatggatctggaagctgatttgggtattgactccattaagcggctggaaatctttggtgcaatgtttgacgcgttctctgcgaacgtgggtctttacaatgaggcttctagaaataaagatctggaaaacttcgaagtcgattccttgagtaatatcagcaagatgggcgtgttctttaagcaaatgcttgacgatgtcatgaatgacttgctcggcaacgggggtgatgaagccgtagcagagcaatcaccgccatcagtcgaaacccgtgaacatgaaaacaccaaaagcaacgttgtccctgatagcgggggagcaacaggcaaattacagtctctcgggtttttcacatcaacagtaacttcacctgaggctgacagcgtaaaaaagccattagctgaaccgcaactgattgtaccttctgtggttcagcctgtactaaagaatgaaattgtcttaaatgaagaagagtcttttgccggctcacccgtttcgcgttttgccgtggtgaaacaatccctgcctatgccagatcgtctacagggggtgttttcatcccctaaacgctggctggtcgttgatgaggggacaaccaccgtggatgacgtagtgaacgcactcaggcaacagggacagcaggttgctgtcctaatgctgaagcaaaacccggcggtgatggagagtgaagctgcgttagacgcggctttagcagacattgagcagcaacatggcacgattgagggcgttatttacttgcagacacctaagcagagcgttaaggcgttagctgaggtgttcaatgaacaggattaccgctcagttgaaaccacgttcctactggcaaaacgtctgcaaagaagccttaaccatgatgaacagaaaacgggttattttatggttatcatgcgcggtgatggtgagttactcacctctgggcgggaacacttgtctatcgtttcggctgggctcacagggctgactaagtcgctgaatattgaatggaaaaatgtcttctgccgaacagtcgatattgatgccagagtcaaggacagtgatgcggcgaagatggtggtagaagagcttcaagatagccggacggatatgggggaagtgggacgcggcgtgaatggcgagcgtatgacattggcactgacagaagaaaatgtactgtcagcggcattcgtcaatcaggtcaatgcgggtgatgtgctgattgtgacgggaggtgcccgtggcattaccgcacaatgcgttattgaattggcgaaacagagtcaggccacttttattctgcttgggcgtacggatatcaccgaaccattaccggaatgggcagaaggcaagacgacgcaggatgagcgcaaaactgcggctatggcttatctgaaagcgcagggtattcaactcacacctgttaagattaatgggatgttgagccgcttgacgcatcttgatgaaatcaatggcacattgcaggcaatcagacaggctgggggacgggtcatgtaccttcactgcgatatcactgatctaaagcaggtgaaaatcgcactgaccaaagcacagcagcaacttgggcagataacgggtctgatccatggtgccggcaatctggcggataagcgaattgaaaagaaaacactggcggatttacattcggtctttaatgccaaggtcaaagggctggaaaacctgtgccgcgaattagactttacatccctgcgccatattatgttgttctcatcggtttccggtttcttcggcaatgccgggcaggccgactactcgttggcgaacgaaacactgaataaatttatctacctgcctttcaagggtaaaaacagtcagataatccgttcagtgaactgggggccgtgggatggcggtatggtcagtgatgttctcaaacgggtatatgacgcacagaatatggcgattattccgctcgaagaaggcactcaacgttttgtgcgtgagttccgggatcccggttcactccagatcacgattggcggggcaaactacaaggctgagaagacagttaaggcgttggggatcggagagcaggttgaccgtcaattgagtctcgataagaacccgtttttgtatcaccatgttatcgagggtaaatccgtattgcccatgacggcggcgattgcctggatggcgcggatctgtgaagatcgtttccccggttataaactggaaaccatcactgatttcaaggttctgaaaggtattgtctttgataacacgctggctgaatcttactgtgtggcatgggttccgaatacatttgatgaatcgggtgatgggcggctggcactggatgttgtcattaccagtaaacgaatgaaacattatcaggcgaccttgatcctgagcctgcaaagccgtgaagcgcagcatgaagtagtcggtatcgatctgaacgcagaggttccgcagacgctgccattctatgacggtgtcgggggagagggcatattgttccatggggaatcattccatggtgtccagaaagtcgtccatgttgatgatgataatattacattgaagtgctgtgttatgccggtacagcttgaaatgcaggggcagttctcgacccgtttatttaatttgttcattaacgatattgcttttcagttgcctgcaatatggtttctgcaacgaaatgaaatgtgtttacccaatgcaattgaaaaaatagaacaatatgctgagttgaagtttggtcaggaattctacgcgtcaattgaaatcaagcaccaaatgtcaacggaaataataatagatattattttttatgatgaacaaggctatatttatagtcggtttcataatgcaaaatttaccgtgtttgttgaatagaggaaattatctttcctcagtcaactatcgaacagggtgaatagcgaaaataattaatcgttataattagaaagcagattgataatatacctgagcgaaagtattcgctcagggaaactctgtcatattcaggagtctctcctagatggaaaatattgcaattattgggatggggtgcttatttcccggtgcagatacccttgagaaatattgggataacttgctgcgggaaaaggattgcacaactcccttatctgctctggaactgggcgtagatctggactgttattattctccggttgcaggtaaaccggatacaatcaattatgttaagaatggacatgtccgggattttcattttgacggcaaaggatataacttgccggaagaagaattaaattcgctggataatttatttaaatggactatttattctgctgagcaggcattgaatgatagtggctatcgccaacataaaacagttttagaaaaaaccggattaattctcggtagtattggtatgccgactcattcaaccaaacgattaatgagtcctttttatcaaaaaatattgcaaccttatattcagcaattaatcgggcgacctgattttcattttgattcggtttggccacaagcaaaccattccgatcagaatttaattacgggtggacacaatgccacgattgcagcgctggcactggggttattgggtcctcgttattgtcttgatgctgcctgtgcatcagcactgtatgccatcaaactggggatagattatctcctcagtcataaggctgacatgatgctggttggggcgatttgccatacagaccatatctatatcgatcatggtttcaatatgttgcaggtattccctgcaaaaggggaatccattccttttgatagatcatccaaaggggtgaaagcgggcgagggaagcggcattgttgccatcaaacgctactctgatgcgatacgtgataatgacaagatttatggtgtcattgaatcgttcggtttgtccaacgatgcgggggcgaaacacttattagtgccagatctacaggggcagcgtatcgctctggagcgcgcctatcaggataatccgcagcgtgttgattatgttgaatgtcatgcgaccggtacaaacattggtgatcaagtcgaattatcgacaattgaatccttctttggtgaacgtggaacaatgccattgattggcgccaacaaagctatcaatggccatatgctcaccgcgtcaggtatgggggggttactgaaagtgctgttggctatgcagcataatatgatccctgccaccccgcgtgtcgaacaattggtttcgacacaaaaagggctgctgaacattgatcacgtcgtgcgggaagccaaaccctggcctgtcagcaatggacctaagcgtgccggcattaacgcctttggttttggtggggtcaatgcgcacatggtcattggtgaagatacacctgaacggcgggcagcatgcacacaggcgaagttggagaaccgtcagaaaattgagcgtctgtctatcgtcggtattggtgtgcatatggcgaaaaccgaagatggcaaaacgctggatcagacattgcagcaagggatacaacatttttatcccctgccgaaaacccgctggattggcatagaaaagcgtcacgatgtcttggcaatgcaggggatcagccaaccgcctttaggctcttatattgaaacgtttgaatttgactgcaagcacttcaaattgccgcccaatgtggtaggtgcgcatttaagctgccatatgttcttgttgcccatcgcggaacgtgcctttattgatgcgggttatacgctgaatggcagtaaacgtaatatcgccgtcattgtagcaggaggcgtggactatagctctttgcgctatcaggcacgtaatgaaattagttggcaactcagccagagtttggccagcagaggtattcatctgtcagaagaagataccgtagccttgcaggaaatcgttaaagatggcctgtttcctaaaccttatcctgaaggtattaccggcggtataggtaatattgtagcaagccgtctggcggctcatttgaagttgaatggcccggcgtttacgctctatggagaagaaaattccccgttcaaggcactggaattggctcagttcatgttgagcagacagcatgttgatgccgtcatgattgccagcagcagtttcggtggcagtctggaaaatgtgctgtgggatcatcaatccaatcacggtaaccaaatcgttggcgatgcgggtggtgtgattattcttaagcgtgaacaggatgctattcgtgataatacgcctgtttatgctgtactggatgggctcagcatcacctatatgcctgatcactctattgatttcaaaggaaacgaagacgcgattctggcggcagcgagatccggattagaagcagcaggttgcacagccgatcagattgattacattgaactgtatgcaggtggaaaaccaggcgaaatcgccgctgaaatgtcggcattaggtcgggtttatgcttcacaaaacaggcaactgaccgccactatcggcaccgttaaggccaactacggacatttgtttatgaccacgggcctgcttggaatcatcaaatctgcgttacagcttacacagcgatacttaccggcactgccagattatccgcagcatcaggaattggcgcattatgcagaagggaaattccaactgccggctcatacccaatcctggcctgcaccggcaacaggtccccgccgtgcagcaattagtcatttgggtattgaccgggcttacagtcatgtgatcttaagtgaaccacaaagcggaaagcgcgctcgcccaacgagtcgtccagagtcaaatcaggcaggcttaaaagttctatcgtataccgcaagagaaaaaaccgttgaagagttaatcctcaatgaacagacattggcgcgttttgcgtcactggctacggctgcacatgtcaatatggcggtgaccccggcagatgccgaaacaaaagtggtatatcccgaagtatcaaccctgacgatgccattgccgatggaacttaatcacttcatacgcaatgcccatactcaactgcattacctgcaattggagcagacgtattatcagttgcttaaacagcatctggcggagctgcccttaattcagtctacaaccacagaatctgcattggttgcaccgacgaaaaagagagtgacaacctcacccgtcgttttcgacgagcagcaagttctggaattgacagacggcagtgtagaaaaagttttgggtgctgattatgccgaagtcgatagctatccgatacgtacgcgtatgccatcacctcctttcatgtttgtttcgcgcattacggcactttctgccgtcaagggcaagttagaaccctgctatatcgaatgggaatacgacgtgcctgaagatgcgtggtatgccgtaaatggccgtgtgccatcgttcgtcgcgctggaatcgtcccatgcgatgatcgtggcgtttacggtgattggttgtgacctgatgttcaaaggacagcgctgttaccgtgcggtggactgcaataccacgatttacagcgagatgccgaaaacgggagatgtgttgcgtggccgcgtcaatatcacctctgttgtgcgggtaggcggcttgattctagtcgcttatgaatatctttgttatgtggaggaacgtctggtattccggctggtggccaactccggtttctttggccgcaaagaaattgagaacgcaggtaactttgataccagcgcttatttcgccaaaggcaaaaatggcattccagcaaaaccctttacaccgttgctgcactgtgatcggacaacattcaatgagcaggatatcactaacgtcatgaatggtgatctcgctgcctgtttcgggtcgcagtatcaatataaccgggaaggcaaattatgcgtcccggatacccgcatgttaagtcggatcttgaatgtcgatacagcgggtggcgcattcggtctggggcagattgtggcggaattagatatcgatcccgcacattgggcattcaaagctcacttcaagaacgatccggtgatgccggggactttactggtagaaggctctgaacaattgatgaagttctatctgttctatctcggactgaactcacagcctgatctggaagtgcatacgctgactgaacatacatccggtgccaaattccgtggtgaagtgaaatgcgaacgggatgtggtgcagttccggctgacctgtaaagccattgatgccctctattctgatgacaagctggagtctattactttgtttttcattgcggagacgctctatcgcggcaatgtagttggcgtgagtgacaacatgggcgtgagatacgagcgacgccagccacaccagatcatggcggcagaactgaaacaggaagctttaaaatgagtcagcgcttatctgtgaatcaatcgaaccatcaactgacagcgttaccgctaacgatagggatctcccacttgcaggcgttgtcgactgaactgcgtgtcgtaaaggtgggtgaatcaatatcactgttattgccagatgacataatagcagaacagacgaccctgcttggtcgcctgccagcagtgacggcaggcagtttgggggatgcaggtttcatggcggattacggcgtgaattacgcctattacgcgggtgcgatggcaaatggcatccactctgaagaaatggttattgcgctgggaaaacagcgcattcttgggatatttggttcaggtggcctgcgtattccacggattgctgaggcgattgcccgtatccggcaggcattacccgaaggcccatttggtgtcaacctgctgcataacccgggtaatcctgagtgggaaatggcctgtgtacgtctgtgcatagaaaatcaggtgcgggtgattgaagcctcggcttacatcaaccttagttcggcgctggtctattaccgcgccagtggtctggtacaacaagctgacggcactatcttgcgtcatcatcgtctgattgccaaagtttcccgtcgcgaagtcgctcagaacttcctgcggccagcgccggaaaagattttgcaaaaattactggcagaggagcttatcacacctgagcaggcagaactggctcgccaaataccgatggcagatgatatcacggtagaaggggattcagggggtcatactgatcagggcgtgctcgcctgcatttttcgttcagtcgtccagttacgggatgaaattgcagacgaaactcagcatgactatcaggtgcggattggtgcggcgggcggtctgggaacacctcatgccattctggccgcttttgctctgggcgcggcttatgttgtcactggctcgatcaatcaggcttgtgtggaagccggcacatcccgcgcggtgaaaaaaatgctggggcaggctcacattaatgatgttgccactgcaccctcagcggacatgtttgaactgggagcaaaagtacaggtactgaaacagggcagtatgtatgcagtgcgagcacagaaattatacaatctgtataagcagcacgacagtctggacaccctgcctgtacaggaaatcgctctgctggaaaaacagatattccacaaaccactgacggaaatctggcaggaaactattgcctatttccagagtattcaccaactggacatcattgccaaagcggaaaaacagccgaagacaaagatggcgttggtgttccaatggtatctcggccagtcatcccgctgggcgatcacgggtgatccagtccgcaatctggattaccagatctggtgtggtgcggcgatgggtgccatgaacgaatggctgcaaggaacgccttttgaagcagtggaaaacaggcatgtcagcgacattgcccaattgctgatgaagggggcggcttatctcactcgcattaccctacttgaattattcaatgttgctgttcctgagcagattaaacggtatctaccgttgcatttctacacgggcggggaaaattccccgccaaatgaatttagtcatgaaccatctaacgacgatcttactgaccacagtcaggttgagaatcgtcatcttaatttaatgtcaattcaaaaatcacaggtgaggggtaaagaacctatggacgcttcaacaaaactggtattggataattcaaaggacttttataaaaaatgttgggagctgatgcctggtggtacgcactacaactttggtgatcctgagcgcccgctggtgatccctttcaaccgtgggcgcaattcccgtgtatgggatttggatggtaatgaacatcttgatctgttctgtaaatttggtgcattactggttggacaccacaatgaggcttataaccaatccctgatcgaatatatgggtaaagtgacttcagttgatacctgcgatctggaagtgggtgtctgcgaaacgttggttaaacatattccctgtgcagaaatggtgcgtttctgcctgagcggaacagaagcagtacagaatgcgttgcgtcttgcccgtgcctttacgggcaaaaatcgctttattcgcttccacggccattaccacggtaacgccgacaatatcatgggctggcgtaaaaagcaggatctcacttaccccgtaccagagcagttcaacggggacctgctggatacactgggacgtgatcccaaaatcatggtagaccaaacgttcatgttgccctggaatgacattgatgttctgacggcgactattgaacgttatcacaatgaaatcggcgctgttctgatggaacctctctgcatcaatggtggcgggattttcccggaagaaggttatctggaaaaaaccaaagcattatgtgaaaaacataacattgtgttgatttttgatgaaatcatcacgggtgttcgtttaggactggggggagcacaaaaaatactgggcgtgacaccacatctggcgaccttcgggaaagctcttggcggcggctccatgccaatctctgctattgtcggtcgtagtgacatcatgaacctgtacacccgtggaaaagtgattcatgcaggcactttcaacggttacccactgggtctggcagcaattcagacgacctttaatttgattgaacaagatcccggctgctatgaccgtatggggaatatcatgcgtcagatctccgacgtgttcgtgaaagcggccaaagcggttgacctgccactcgtggtacagggaatgccaaccgcgctggtttatcactcccagagcatccccgtcagttctacggaaggctacagcgataaagtcaaattctgcgacatcatcattcgtgaaatatccaaacgctatggcattcagttctcaccattgtctcgcatgtactctaacctattgatgtcacaggatgacgtgcgtttcttcgaagagaggatctttgatgcgatggtaaatgctcgcaaagtcattgatatcgcattcaaagaaggaattgatgcatgagccgacaaattgctgtcgtcactggggctgcggggggattcggcacagcgattagcaaggtgttgctggatattggttatctggtggcggcaacggatgtcagcagtcaaaaactggcgctcctgaaggagcgtctcggacaccctgaatcccttgcaacctttgaaatggacgtaactgacttagcctcagtagaacaggcggcgcaacagattgttgaaacattcggtgacaccattacggtgctggtgaacaacgcaggcattattaatcgggcattctgtctttccggccaagggtttagtgagacaaccaaggttataaacgtcaatttgataggtgctttcaacagcacatcaatttttgtccgctacatggcgcgcctgaaatatgggcgcatcatcaacattgcctcggttgcgggcatttggggagcggcaggtagttccgcttatggcgcttcaaaagcaggtctgatctctgcgacagaatcctgggggcgtgaattgggtccactgaatatcagtgtgacagccgttgctccgggggtctgtaaaaccgacatgctggagcagtttgtggaatcaggcccgatggagtcggcgggagaggataaggttgtacgttccattgttccggtcgggcgttggggaacgccagatgacgtggctgaagttgtgggatttttggcgagttgcaaaactaactacctcaattccgcagtgatcccattggatggcggaatgcgtgtcggaacgttatagccgcgcaggggaataaaaagttaggaagatcaggcgcttttctgcctgatctcatactttcgccgctatgtgatgacttttaggggataaatatgttcgaccataataaaaaggacgtcagtagtatcttgcttaccggtgcaactggcgtgatggggggaaggatccttctggaaattctgacgacgacggatattgaggtttactgtctgatacgggcagaaaacagccagcaggcaatggaacgtctgaaaggtatcttgtttgcttatgatcaggaaaaacaaagtgagcacactcatcatcggattattccggtactgggggatgtctctaaaaaaagattggggctgacacaagagctttaccgcgaactggctgacaaagttgaccgggtcattcattgcgctgctaacgttagtcttgtggcgtcttataaaaagattgcgcctgttaacgtgcaggggacacagaatgtcattgatttctgtctccggggcaatgtagcgatgttgcatgcttccagtttcagcatggcaggggatcgcctgtataaggacggttttgtcctgcatgaaacagatctggacgtggggcaacgatttgatgacatggattacgaacgctccaaatttgagtccgaaaaaattattcacagtgccggaaaaaaagggctgaagtgggtgattgtgcgcccgggcaacatttggggagaaagtacaaatgggcgttacccattagcgcatacgaaggtcaagggcatttattacgaaatggttaaggcattagtggaaactggtctgacgttcaatgcacaggacgattttgatatcactcctgtggattacgtggcggaagcctcgctgtatgccattttcaatattgagaaatttaatgggaagacgcttaatctgactaatcctaacccgattacgttcaatgatatcgtctctttcctgcgtgattttggttatcgtattgataccattaacatgaatgattacatggaagcactgtcacaaaaccgtctgtaccgttatgaccagccttatcgctcggtttttaccgatctgctggggctattttattccggcatggaactgaccgaaaaagccaaatattccacacaactgacaactgaattactcagtggcagtggaattcagtgccccctgtcggatagaacgttacttttccattacttcaattacctggtcgaatgtgagtttattgcgccgccacaacagcagggagaaagggctgaaatacgggaagcatctgtacgggggagttatctggaacaactgtttgatgctgatttgtaatgaggatatacgaggcgacatggctgcatctggatcctgatcttcttcaagggttgtttataaaacaatctaataaaagacaagtaatgacagaaatatgtattgaatcggagcttgcaatgattgaacaaaatcttaaggtgacgttggttcaaaccgatttggtttgggaaaatgcagaacaaaaccgtgaacatatcgaacagcacatcgatcagatcacaggtagtgatctgattatcttaccggagatgtttaccacgggtttcagcatgaagccacaggccattgctgagacaatgacagggccaagtattcagtggatgaaggcgatggctgccaagaaagattgtgccattgtcggcagcatcattatcacggaaaaccagcgcttttataaccgtctgctgtgggttaatcccgatggctctgtcgctcattatgacaaaaaacatctctttactttcgcccaggaagatcacgaatacaccgcaggcaatgccccgctggtggtgaattttaagggttggaaaatcgctgcctttatctgttatgacctgcgtttccccgtctggtcgcgtaacgtcaatggtcattatgatgcggcgatctacatcgccagctggccggcaagacgttcggctcactggtgctcgcttcttcaggctcgcgccattgaaaaccagagctacattatcggggttaaccgtgttgggcaggatggcaaccaactagactatgacggccacaccatgttgatcgacccactgggtgaaatactgctgcacgaaatgaatcacgaagtggtgaaaactgtgcatctgtcactctcccatgtgcagggtgtcagggaacgtttcccatttctgaaagatgctgatctctttgttttgaacaacgatgtgttaggaaatgatacctaacgtaactctgcattgttgaaggaagatggctactgccgcctgtttcacctcgttgaaaagaatattcctctgggagcagcagcattagccatcatgatcgtattgtttgggaacatcgtcctgatgctgaatcaaactcactccatccatacctaatagatttccagttgcagccgacaaagccaaaactggaaagataagagggataacaatgaaatttgccggaggtcgtatgcatatgcaaaaacatacatttcaacccaaagcccccctggagcaaaaacagttgagattgactcagacattgcatcaggcgtttgagcagaaggtacagcgctatccacacgccattgtgctgaatactgagaacgggttggggctgacttatgagcagtttaatcagcgagccaatcaactggcgcactatatcctgcaaatcaaacagcagatgggggaaacggacgccttttcacccgttatcggaatctgtctggagcatgatgaagagatgctggtatccattctggcaatcctgaaagcgggactggcttacctgcccattaacagcacccatggagcggaaagaatcggtttttacattgaagatgcgggtgtcaagcttgtcattggcgtcttgcagtatcaatcactatttgatgaaagtaaggtagattacctctgcattgacagcgaaaaagcctttatccagaccatgccattacataacccggatgtgagtattcattctgactcattggcttgtatcgcctacgtatctaagactgccggtgtctcgaaaagcgttgacatatcccataccagcgcgatgcgactgagtgccatgagattgcttcgtgctgagaaacatcatcttgatttgacagaaaataactcgacagaaaatgacatttggacactgcttgacgccagtacttttgaagttcacacgatgggaaaatgacgttaccaatatttatgtcacactctttagtgagagcacaacttatcaccaaatgagacacagagaattttatgggtattcaacacaacgagaaagtgattgagtttgaacaggtcaagaagcactacaaggactatcaagcgctaaaaggaatttccctggatgtctatcgcggagagttcctgggtctgcttggtccgaatggggcgggtaaaacgacactggtcgaaatactggaagggctgaaaacgccggattcaggctcggttcgggtattaggcaaaacatggcagcaggacgcgccttacctgcgtcagcacctcagcggtgtcttacagcagaccctgtttatcgataagctcagtgtagaagaaacacttaacctgtttggcagcttttatggttgttcacgtaaacgagcgcaggaggtgatggaactggtcgagctggaagaaaaacgcaaaacctatgtagaggggttatccggtggtcagcgtcagcgtctcgcattgggtgtgtccatcatcaatgagccggaaatcctgatcctggacgaacccaccacggggcttgacccgcgcattcgtcatgatacttgggatatcctgcgtaagctcaaccgtgaaaagcactcaactatgatcttaactacccactatatggaggaagctgagtatctctgtgatcgcatttgtatcatgaataagggagaaattatcacacagggcagtatggatgagttgttgaaaaaacactgcgatggcgatctcattgaattccgtacccattttcctgaccgcttgcaggtactgagtcaacatgctcaagtcttaaactatgagtacgatgaaaggaaagataagatctgtatgctgattgaagattccaccagttttgttgctcatctttttgagtttgccaaacaagtcgaggttgacatcattgaactgatggtcaggaagaaaacgctggatgacttgttcatgactttggccgggagaaggttacatgaatagtgcactgctcaacttgatgaaaactcaattccggcaatatatccgtgagccggaaattttgttctggtcgtttggttttcctctattgctggtctggctactaggggtttcgttctcctctcaggacattcccgaaagagaaatcggcatcgtgctgcctgtggaagccgtagaacagcagcaagtcaaacagtggggagagcagcttactgcgcaggagcacatgatctcaggcattatcaataaaaaagaaatcaagcgtgaaaggctggtcaaagttcggtacaacatcacctactatcctgatcatgagtctgtcgtgcgcgggctgaagcgaggggatatccagatgttcattgaacaggataaagagggaaaacgtgtccattaccttgacccacagaacagcgacgccttactgacctattacctgcttaaccagcaagagggaatagaggttgaaaaaaacctgtttatactggaaacaccgggactgcgctatgtggattttctggtaccgggcttactggcaatggcgattatggagacttgcctgattgcggttggctgggcactggcggaaaagcgcatcacacgggtcactcgtcagatgtgcattaccccgatgcgcaaatccacattcctgctggcgcatatcctttcctgccttttgatcagcattaccgagatattaatcatctacctgtttgcagacctctattttgatgtagaaatacaaggctcgttttacgctttcctgctcttgatgctcacggggaatatttgcttttccggtgtggcagtgctggtggcatcccgcgcccgcaaagcccaaaccgcgaatggattgttggaagtttccattttgattcaggttttgttgtcagggatttttttcagttacaaaaacttcccgcagtggatggcgaatattattgaatacctgccattaaccattctggccgacaatatgcgcaaagtatttattgaaggtggtgatttattgcaggccgtgcccgcagcaatcatcttgagtgtcattgggattgtgacatttgtgttgggtatgaaaatatttcgctggtattgaagggattattataaacatccggcggatggtttgccggatgtttattttcaaaacagatatatgtcaatccaacgacaattgtcgacgcaactgggctactcgctcacgccattgctgctgtaatatcggtttctggtgtgcagccttgcgttgcaaatctgtcgccagtttttcctctagtgaaatcagctctgccagtttcatttcgtcatcattagagagcacttccgatgatggttcgagagaaaacgtagatacgggtgcgctgcccgtttgtgtattgctattagcgtgacggattttctgatataccgcatccaaatcgtggtattccgttaaacgctgaccatcaatataccaataacggttacagctttgctcaatcaattcacgatcatggctgaccagcaataatccacccgcgaacagccggatttcatcgcgaagcgtatttttaccatccatatccaaatggttggttggttcatccagcatcaataatgaatatttcgccaaactcaggccgatgaataacagtctggcgcgttcaccaccactcaatgatgcgactgtttgttgatggcgcaaatacggaaaccccgcgctgatcaacgccattttccgctgtttgtctagcagggcagcaaacggttttaaggcatcagacagcgtatcactatcggacaactgtgccagtttctggtcgtaatacccaagattgacacgcggatgcagtacaagaggactatccggcagcgtcagagtctgagattgcgattgtgccaaaatcattcttaacagagatgattttccggttccgttcgcacccataattgcaatgcgatcaccgcttttcacggataaattgtccgttttatatagtggtgggcaggacggtgccgggatcaccgtcagttgattgaactcacacaggcgatctgcacgcaaaatatcaccggtcagtttcaaccgccattggctgctaacagccagttcaacctgacagtcctgcaaacggtcgacgtgtttctccatttgtttggctttacgggaaagcgcttcgttatcgtacactttgccccagatagccagacgtttggcactgtgcgcgatgcgatcaatctctttttgctgcgcgttatggcggtgttcatcactgagatcttgtgctgtctgcgcttcacgggcttgcgagcacggaagacgatagagagacacattaccgtcgcgtaatatccaggtgcaattcgttaagtgatccaacagtgtattgtcatgagaaactagaataaaactgccgcaccactgtgtcagaaattgctcaagccagagaattgtcggcaaatcgagatggttactcggctcatccagcaataataaatctgggttaatgataagcgcccgcgccagtaataagcgcgtatgctgaccgccactgagtgctgagatcgccagactgtgttgctccggctgaaaccccatttcacttaacaaaatttccgcccgccaattgtcctcaattcgttgttctgccggcagtttatccaacacagcctcaatcagcgtcatactgtgcaatgtaaccggtaaatgctgttcggtgtaggccagaatgcagtgatttgccagtgttacggttccttcattcggtgataatttggaagaaagtaatttcagtagcgtactttttccacaaccgttatacccgatcagaccgattttctcgcctttattaatggagatagaaatatcggctaacagtggagtgtgaccgtgatggaatgacagattttgggttgataataatgtactcatagcttactcaaattttaggcgtgataacaccttgggtcataaaacgcgataaccctgtaagctgaggaagagatattaaattggtaaaaacttcactcaggcaggattaacgcaatgcgttagtggataagcctgagtgctgacgattaccaaagaaatgtgaatattcaatcacatcacttaacatcataattaacctccttttcttctctgtgggtaaatggatgatggatagattatagcatctttatatcatctgcaattataagtagacaacgagaacctgtttaagttgacttaagcgaaagggcagaatcgtgtttgattagccaagacttgggtgtagcaatgttcaggcgtgatgggcattgccgtagtcgattttccttgccgttcctgtcttaattacagtgaccaaaatcagtctgccacaacagatataccaatgtgacggatgccttttatattgggagtgtttttttaaatggttaattcaatttttacctgatttagattaataaatgatgctatttttatttattaatatatttaaagtcatggtgaaaaattattttctctgataattaagatatatatttaataataacttatggtcttgattagtcaaaacccattgggtataaattccatcctattagggctattttattaggtattttgaacttgggctgtgttcagataaaagcgatagcttttggacgcattttagtatggactgaaagaaggagcagtgaatcattctcatgtactaaccattgataaactacatgcatgctccgatttttacgtgcagtctgtgtgcaaaaattacgcttattgggatagatttttagttaactgatgacctaaaggtaaattgctgaacctttgtgccgtttttatcgtggtttttgtctctggaatatggatttttcagcgttatatttattaatgtattgatttttaagtatattattttattttaaagtaaaatgcccatttgcaaatttttattgaaattgtaatcgtaaaatactgacatgataaatgaatagttattgaacaattcaggttgattcctattatttcctcaattcatgcctctttttatttattttttatgcataaactatgcataaattgtaaataaaactgcttttataaattgtgaaaaacatcataaagtaaattatttgtaatttcattgtattgactttgttaactcccaaagagatgatgcattcagcttgcaatcttaaagggtggaaaaagatactcatagaatgtaattagaaactaattgaaataattaatagaaaatatgagtaaacctattaattaaacaaatacatttcatggtatatcaattcatttttattttagtgattaacttttttgaggaaaaataaatgtcaaacacgattcagagaagctggtttgatcagtatatggtcccttgtttttcaccggctcaatttattcctgtccgcgccaaaggttctcgtgtatgggatcaggaagggaaagaatacgttgattttgccggtggtatcgcggtgaactcattgggacatgccaatgatgagttaaagaaagtattaacttctcaaatagaaagtatgtggcatgttggtaatggttatacgaatgaacctgttttgaaactggcaaaaacacttgtcgaaaatacctttgctgataaggtttttttctgtaattcgggtgctgaagcaaatgaagctgcactaaagattgcgagaaaatatgctttagataaatatggcagtcataaaaacgaaatcatttcatttgaaaattccttccacggtagaacattatttacggtgactgtgggcggccaacccaaatactcacaagatttcgcgccattgccgcaacaaattagccatcttccctataacaatattgacgctatcaaagcccacatttcggaaaatacttgcgctgtgattgtggaacctatcattggtgaaggcggtgtcattcctgctgatcctgccttcctgaaagctttgcgggaactgtgtgaccaacatcaggcattgttgatttttgatgaaatccagacaggagttggtcggacagggtatttttatgcttacgaagaaacaggtgttgagccagatatcctgactagcgccaaaggtcttggtggcggttttcctatcggagccatgctggttaaacagcctatagcagacgttttccagccgggttcacacggtacaacattcggcggtaatccgctggcggcggcggttgccaatcaggtagttgctttagttaaccaaccggagtttctggcgggagtacaagagcgtcatcataaatttatcaagcgtatgtcagatttgaaccaacgttatcacgtgttcagtgaattacgtggaaaaggcttgctgctgggagccgaactggagaaaaaatatcagggtaaggctaaaaccctgagcaatatcgctgcggaagaagggttgattgccttgattgccggtccaaatgtgttgcgttttgcccctgcgttaaatatcgaagagcaggacatcaatgacggtttcgcccgtcttgaaaacgccctcaagcgatttgttcaggaataatacaggtttgaggtgatatcatgatgctatttagatccgttcaacataaagatttaggagatattctcgatctttcgtcccgtgctggcgttggtctgacatcgctgccacataatcaggaatacctgacggcacggatttcacgcagcattgattcatttaacgatgtaaatggacgagcacagcagggattcctatttactctggaagatacggagaagcatcgtgttgttggtgttagtgcactggaagttgcggtagggctggaagacgcattctataatttccgtttacagcggtcggtgcgtgcatcccgtgaactgggcgtttacaacacatttgaaacgcttatggtggggcaggattatacggggtgtagtgagttatgtacgttgttcctcgaccctgattatcaggggggaggtaatggtgttttcctttccagaagccgcttcctgtttatttcggcattcaggcatctctttccaaaatctatttttgcggaaatgcgtggggtggtggatctacagggagaatccccgttttggaatgcccttgggcaacactttttcaatatccctttcgctcaggccgattacttgaccggcattggtataagaacgtttattgcggaattgatgccattccatcccatttatgtacctctactgccggaagatgcgcagaaagccatcggtcaggtgcatgaaaataccgtacccgctcgcgctatcttagaaaaggaaggtttcttctataacgatggggtcgatatttttgatgcaggtgccatcttgcaagcagaaattgataatgtgcgttcgatcaaggcaagtcggcttgcctatgtcaaaaaaagcgaaaaggtctcccgacagagtaatggggtgccgtgtattgtttccaatgtgcactttcaggactttaaggcactgctcctgaatatccctgatccgtttagttatgatgaactgcaactgactcctgcggagatggaagtgctccatgtggatgagggggatgctgtgcgctttatttctcttttttctgagggatcttcacaatgaatcatcaagcaaattatatcggtagcgggtgggtagcagggcaaggcgaacccgtcatcaaatattcccctcttgatcagcggattttatggcaggcaaacagtgcttctgtcagtcaagtaaatgacgcgtgtcaatctgcccgcagggcgttcccggcatgggcgaaactgacggctgaaaaacgtatagctattattcaggcgtttgctgatttactcacacaggaaaaagaggccattgcccgtgtgatcagcgaagaaaccagtaagcctttgtgggaaacaaggacagaagttcagtctatgattggcaaagttgctatttccattgagggatggcaacagcggactggctattcagaaacgcctatgccagatggcaaggcgatattacagcaccgtccccacggcgtgatggcggttttcggcccttataattttcccggccatttacctaacggccatattgttccggcgttgattgccggtaatacactggtgtttaagccgagtgaactgacccccatgacggcggaaaaaaccgtgcaattatggatcaaagcggggttgcctgcgggtgtgttgaatctggttcaagggggaagggaaactggcggtgcattgctggatagccgtgagattgacggtgtgttgtttaccggcagtgcagcgacagggtttcatttccaccgcgtacttgcgggtcagcctgaaaaaatgctggcgctggaaatgggcggcaacaatgctctgattgtggatgattatgacgatcttgaggccgcggtttacaccatcatccaatctgcgtttatttctgctgggcagcgctgtacctgtgcccgcaggctgttggtaaaacgtggagagaagggggatgctctgattcaacggctacttgataccgcaggtcagattatcccgtctcgctgggatgccgatccccaaccgtttataggcggggtgatctcgttgcccgcagtagaaaatctgctggatgctcagtcacgattacaggcattgggcggcgtttcgctgctgactatgactcaacctgatcctgactcaacgtttatgacacccggcattatcgatctgaccgatgccaaagaggttcctgacgaagaatattttggacctctgttaaccttgaagcgttatgacacttttgaagaagccatctctatcgcaaatgatacgcgctttggtcttgcaacggggttaatttcgccggatgccgctctattcgagcatctgttgcaggaggcgagggcagggattgtgaattggaacaaaccgttgaccggcgcctccagcgctgccccgttcggtggtattggtgcatcgggcaatcatcgtcccagtgcgtactatgccgcagattattgtgcctggccaatggcatctctgacggcagacaagctggttttacctgatgcaccggcgccgggtctggattttttccgttcctgatttttgtcattaatagcttagagaacagaggtaattatgtcaggaattgaagcaaattttgatggcctggtgggtatgactcaccattacgccgggctgtcaatgggtaatgaagcctcgatgactcatcgggggcaacagtccaatccccgcaaagctgcgcttcagggattgatgaaaatgaagtcgctgtctgatatggggctggttcagggggttctgcccccgcagcagcgccctaaccttcccgcactgcggcagttgggttttactggcagtgatgagcaggtattaagcaaagctgcacaatattcacccttgttgctgtccaatctcagttccgcttcttccatgtggacagcaaatgcagcaacggtttcaccttctgctgacagtgctgatcaacgagtccattttacggtggcgaacctgaataacaaactgcatcgttcattggaaagtacagtcaccgcgcgagtgctggaagccgtctttcctgatcaggcttgtttcgcccatcatgatcctttgcctcaacatggggactggggagatgaaggtgcggcaaaccataatcgtttctgcggcgaatatggtgaagcgggtgtgcagctatttgtgtatggtcgcagtgccttacaggaaggcacggcacctaaactctatccggcaaggcagacattggaagccagtcaggcggtcgctcgtctgcaccaacttgaggccgctcaaacggtatttgcccagcagaatccggtcgctattgatagcggagtgtttcataacgacgtgatcgctgtcagtaaccgcaatgtttttttccatcatcagcaggcctttgtgaatcagcagtccgtattggctgaacttgagaaaaaaatggtgcggcttgggcaaaaattgattgcggttgaagtcccttcatcacaagtgacgcttcaggatgcggttggatcctatctttttaacagtcaattattgagccaacctaatggcgatatgatgttgatcttgccagaagagtgtcgccagaatgtcaatgtctgggcgtatttgcaggctttggttgctggtgccgattcccctattaagaaactccacttttttgatttacgggaaagtatgcgtaatggcggaggccctgcctgcctgcggttacgtgtcgtcttgaaagaacaggagttagcggcggtgaatcaggctgctctgatgacgccggaactgtatcaacgcctgacctcttgggttgaacggtattatcgcgattccctgtataccgcagatttggttgatccccaattgctgaatgaagtctattttgcccttgatgaattgacccagatcctcaagctcggctcgatctatgagtttcagcgttaatcaggagaaaaaatggatttattgaccttattgtttgaaaagaaactggagaaagttctgcatttcccacctgctttaaaagcctcatggctggcggagggagtattgcaattgctgccacaggagagcaaagcggatacgttgattctctccgtcggtatccacggtaatgaaaccgcgcccgtggagctcctgattcagttagtgtcgcaacttgctctgggaagcctaccgttgcagcacaaccttctgctgattttcggtaatgtacccgccatgcgtgaaaataagcgttatatcgataatgatctcaatcgcatgtttggcggccgccaccagaattttccttcagggaatgaatcccaacgagcgatggagctggaaacggttgttcgccagttctttcgtgagccagcagttagggcatcaacacggcgctggcaccttgatctgcatacggcaattcgcggctcctgccatgaacagtttgctttgctgccgtttcaggctcgtgaatatgcatctgatttcctacagtggctggaggggagcgatattgatgctctggtcttccataacgcagccggcgggacgttcagtcactttaccagtgaacatttcaacgtagagagttgtacgatggaggtgggtaaagcacgtccttttggacagaacgacctgagcagatttaataatattacgcttgcattacgtgatgtcgtggcgggttcgtttttgattaaacgggaaaaaccgacaatgaagcgttaccgtgttatagacgcgattatcaaacaagaggacagttttcggctccatattcctgaggatacgaaaaacttcactgcgctgccggacgggttcgaaattgccagccagccgaatcaattctggaaaattacttctcctgcaaactttattctatttcccaacgctcatgttgccattggtcagcgtgcgggtctattgctggtgcaattaacgtaaagaatcctatggaggttatcgatgacgaggacggtaaaaacacctgtggagcaatccgcaggtgcgcagaaacttcaccgcggattaggcaaacgtcatgttcaattaattgctattggaggggctattggtacagggttgtttatgggaacgggaaaaaccattgctgtatcaggcacttcaataatcctgacttacctgctgatcggtttttttgctttcatggtcatgcgggcgatgggagaactgttgctcacaaaactggattaccgaacctttgctgattttgtggcggattatctcggtgagaaagccagttattttcttggctggacatactggatgagctgggtagtcagctgtattgcggatgttgtagtgtgcggtggctatatccaatattggtttcctgatgtctcactctggttcacagctctgtcacttttggggctgatatgtttgtgtaacttcttttcggtacagttattcggcgaaactgaattctggttcgctatgatcaaagtcgtggcaatcgtagcactgattatcgtcggtgtcggcatggtgtttgtcggatggacatcgcctaatggcgtgacagcgtctgttcgtcatttgactgatcctgaagtgttcttgccgaacgggatgtttgggtttctggcaggctttcagattgccattttctcttttactggcattgagctggttggcaccgtgactgcggaaactaaagaaccagaaaaagttttaccgaaagccatcaacactattcccatcaggatcatcattttctatgtgctttctattatgtgcattatcgccgtgacttcgtggacgaatatttccccggaagtcagcccgtttgtgacgctgtttgcattggctgggttgcctgcggcggcggcagtgattaattttgtcgctctgacttcggcgatgtcttcggctaatagtggtttatacgcgtgtacccggatgctgtatggcttgtccacagaaaagctggcgcatggtaaattcgcacaactctcagtgagcagtgcggttcctatcttcagtttgatattttctgttatctgcatggcaagcggggtattcctgctgttcattgtccccaacgtgatgaaattatttactattgtctcaacggtggcggctattatggtcatttatagctggggaatgatattgattgcttacctggcttatcgtaaaaaacgtcctgatttgcataaaatttccatctataaaatgcctatgggcataccaatgacatggtgtaccttgatattctttgctttcacagtagtgattatggtgtttgattacgatacccgcgttgcattatatggcacaccgatatggtttgtgatattggaggttttgtggcgtatgcggaaaaatcggaagcagcgtgtaatagaaaaaagagtggtaaattaatctatattcacaaatagtcagttaaatggagcaaaaagatttaggtcggtttttaatattattatctttataaaaaatttattggatatttaattcacttatataaatgaattaacgatgatccctttttattaccttaccaataaaaaagatgattattgctataaaaaaataaccccagccaaaaagtatggggttattttatctgtcgcagttatctcatcatgtttctcacaatcagagaaaacgacttagaaatagaagattacgcgttttcttgttgagctgcctgaatcgcagtcagtgcaacagtataaacgatgtcatcaaccaatgcgccacgggacagatcgttaactggcttgcgcattccttgcagcattggcccgatggaaaccagatccgcagaacgttgcaccgctttataagtagtgttaccggtgttcagatccggaaaaatgaacacggtagcctgaccagcaactggtgagtttggtgccttggattttgctacgtctgccatgatagctgcgtcgtactgcaatggaccatcgatgatcaggtccggacgtttttcctgtgccagacgcgtcgcttcgcgaactttctctacatcgctgcccgcaccagagttacccgtggagtaggagatcatcgcaacgcgaggatcgatgccgaatgctttggctgaatccgcagattggatggcgatttcagacagttgctctgcggttggatctgggttgatcgcacagtcgccgtaaaccagtacttgttctggcagtaacatgaaaaagacagaagaaaccagtgagctgtttggtgctgttttaattaactgcaacggtggacgaatggtgttcgccgtggtgtgaactgcaccggaaaccagaccgtcaacttcgccttgttccagcatcagcgtacccagaacaacgttgtcttccagttgctcacgcgccacaacttcggtcatgcctttgcttttacgcagttcaaccagacgcggaacgtaacgttcgcgcacagcggctggattaaccagttcaatgcccgtgcccagctcaacaccttgagccgcagcgacacggcggatttcttccggatcacccagcaggatacattctgcaatgccacgttcagcacagatagccgctgctttgaccgtacgtggttcgtcgccttctggcagaacgatacgtttgccagcctgacgtgccaattcggtcagttgataacggaatgcaggtggagacagacggtttggacgctcagaagtagcagccagagaatcgatccattcgctgctgatgtgttgtgcaacgtagttttgcagtttttcgatacgctcatgatcatcagcagggacttccaggctgaaactttgcaggttcagggaagtctgccaggtgttggttttcactgtgaaaaccggcaggccagtgttgaatgcacgttcgcacagttcacggatagaatcatcaatagcgtagccgccggtcagcagaactgcacctacgtcaacaccattcattgcggccagacatgccgtgatcagcacgtcaggacggtcagcagaagtgaccagcagagaacccggacggaagtattccagcatgttaggaatgctgcgagcacagaaagtcaccgatttaatacgacggctctgaatggcaccttcgttgatgatgtctgctttcaggtgtttcgccatgtcgattgcacgggttgcgatcaggtcgaaactccacggaatgcaaccgagaataggtagtgggctgtttttgaatacggtttttggatcgatgtaggcaacggtcgctttggaggcttcgtcgaagatttctgataaatctgggcgagtacggccttgttcatcaacaggtgcattcagtttgttaacaatcacaccgatgatgttctggttttttataccaccgtattcggcacggctcagttcaatctgctcttttaactgttctggggaatgggtacccagtgccgtgacaaacacgatgtctgcattcagtgtcttggcaatttcatagttcagtgactgtgcaaatggatgcttgcgagttggcaccagaccttcgatcagaaccacttcggcatctttggtgtttgcgtggtaacgagccacgatttcttccatcaacacatctttcttattggtggtcagcagggattccacatacgccatatccagaggttcagcagcgtgcatgctggagtgagaacggatgatggatgtggtttgatcctgagaaccactatggcgtggttgtgcgataggtttgaaaacactcaggcgaacgcctttttgctccatggagcgaattacgcctaggctgacactggttaaaccaacgctggtgccagtagggatcaacataattatacgggacacggaaacctctttaacggttgctcgtcagtcaatcaacgtgactcaatgctatataaatagatgaaaaatgagtcaacgcaatagatatcaatgaaatattaatcaatgcattcatgaatagagaaccgccagcattgctggcagttcttgaaatcatatgacttatgcagtcaggcgcgctgcatcctgagcgatcaccaattcttcattagttgggatcaccagagcagggcggctgttatcagtagtgataacgccagatttgccgaagcgagctgcaaggttacgctcgtgatcatattcgaagcccagcagagcgatttttttcactgccagttcacgaaccagtgaggagttttcaccgatgccgccggtgaagataatcgcatccagacggccttccatcagtgcactgtatgcaccaatgtatttcgccagacggtggcagtaaacgtccattgcacgtttagcatcagctttggtttcgtagttatcttctacataacggcagtcgctggtgacttcagtcagacccagtaaaccagattctttagtcagcagagtattgatctgatcaacgctcatgcccattgcatcgtgcaggtggaatacgatagcaggatcgatgtcaccactacgagttcccattaccagaccttccagtggagtcagacccatggaagtgtcaacacattggccgttaacaatggcagaaacagaaccaccgttacccaaatggcaggtgatgatgttcagttcttccactggcttgttcagcattttggcggcttcacgggtaacgtagaaatggctggtgccatgtgcgccgtaacgacggatgccatgctctttgtacaagttgtatggcagagcgtataggtatgattcttccggcatagtctggtggaatgcagtgtcaaatacggcgatatttttctcaaccagatgagagaatgcttttttcgcttctgcgataccaatcaggtgagcagggttgtgcaacggtgcgaatgggatagcggcttcaataccttggatcacttcatcagtgataataacggaagacgtgaatttttcaccgccgtgaacgatacgatggccgatggctgaaatttgcgcagaaagttctggcttttcagacaaaatagtattaacaataaagttcagtgcttcactgtgtgctgcgccggcacctaaagcagcttcgtttttcgcgccatccattttccatttaatacgggcttcaggcaggccaaagcattctgccagaccggaaagatattcttcaccattggcagggttgatgatagcgaatttcagggaggagctaccgcagttaagaaccagtaccagcttacttgacatggaaatacctattatcttgttgtgatctaatcttgaataagaatgatgttaaaaaatgaaataatctgttaacaaactgaaccaaagtgttgcgaaaaaggacaatttttctgttttgctactgcaacgacataaaagtctgtgtaggataccgtttgctagcaataaagacaaaatatacttaatagtattaatactacaaaaaagattttatctgttgtaggaattttttaaaaattatacctttaattgattgaggtcatgatgaatacgacgccacctgtcaaccaaggttggtttaagagagtacaattagggcagcaatatttgaaaacgtggccgctggaaaaacagctcgcgccaattttccctgaaaatcgcattatcaaagcgactcgttttggcattcgtttcatgccgccgctggcgatttttactttgacatggcaaattgcactgggtgggcaattggggccatctgccgcaaccgcgctgtttgcctgtagtttgccgttgcagggattatggtggttgggaaaacgtgcagcaacgcctttaccagaagggctgctgaaatggttttatgaaattcgtgagaaatttgccgaagcgggaattgccatgatgcctgtggaaagcacaccaacttacttctcgctggctgaattgcttaaacgggcattcaagcaactagataacgctttccttgatgatatttgaaccgtcagatcccctccctgacggctgctgaatcaattaactgataaaccccctttcagatcaataaatggttgttttgcgctactcataaaaaatggatacagaagggcgttatactcatcttgatttcggcagtcatggtttcaactcctagacaccgatgtgaaataagtgtcagcgtatgttggctgtcctcgccaatatcacctgagcaccgttgagatatgtcagattattaacgcatgattgcgtttggaggatttgggtgtggtactgaaatgcagaggtttcttattcgatctggatggcacgttgattgattcactaccggtagttgagcgtgcatggtgccagtttgcagataaaatggacatcgatagagatgaagtgttgagttttgttcatggtactccggctatgatatcactacgtcattttatgcctgatgcaagtgaagaggagatcaatcgcacttttaagtggattgaaaaaattgaatcagaagatacagaaggggttactgctttacccggtgcgattgcactgattgataaactcaatgcgctggatattccgtgggcgatagtgacttcgtgtacggttccccttgcttctgtccgtcataaagtggcggagttgcctgagcccgctcattgggttactgctgagagtatcaaaaatgggaaaccgaaccctgagccttatctgttgggagccagtatgctggggctgtcgccagaggagtgtgtggtttttgaagatgctgctgctggtattcatgcgggtctggatgctggctgtcaggtggtggttgtccataattcgccgggtattccacgtcgtgatgaacttcatcttgtgctcaataatctggaagacattgaaattagcaaatctggcggttatgtaacaatttatgccttaaatgaggaaaattgttgatcttaacgagggatttatcctgagaaaaatggtctacttacgcgcttaatgcctataccgataggctcttgataacgaccaatctgcctatcggcagattggtattgctgatgggatattccttaaggtatagctgattagatactgttgatagaggccatattgaatagcgaactgttgtgggtattgaccctgttattagtagccattgttcttttcaccaccaataaagtcagaatggatgttgtggcgttattggtgatcatcgtatttgtcctgagtggtacgctctccctgaatgaagccactatcggtttcagtgatccgaatgtcttgttgattgctgctctgtttgtcattggcgaggggctggtgaggacaggcgttgcctaccagatgggggattggctggttcgtgttgccggtagcagtgaaaccaaaatgctggctctgctgatgctgtcagttgccgggctgggggctttcatgagttccacgggggttgtggctatctttattcctgttgtcctgagtgtcgccgctagaatgaaaacctctccaggccggctgatgatgccgttgggttttgctggcttgattagtggcatgatgacgctggtcgcaacaccacccaatatggtggtcaatagtgaattggtgcgtgaaggtctgcggggttttgactttttttccattacaccgataggtattttagtgttgctggcgggaattgtttacatgcttgttacccgtcgttggctaggcgtgaaagcacttcagaaaccggacgaacgttaccatcgtacgtttcgtgacttgatccgtgactataaattaacgggtcgtgcccgccgtcttgctgtccgcgaaggctccccattgattggtcatgcactggatgaattgagtctgcgtacccactatggtgccaatgtggttggtattgaacgctggaggaagtttcgtcgggtgatggtagctgccaccggtgaaactgagttacatcagcaggatgtgctgctggtggatatgtccgatagcgatgtggatttgcgagaattttgcagcgagcaacagttagagccgatgatattgcgcggggaatatttttcggaacagtcccgtgatgtgggaatggccgaagtttctgtgatccctgaatcagagctattgggaaaatcgttgcgtgatatgaaatttcgcacacgttatggtctcaacgtggtggggattcgtcgtagcggtaaagccattgttgaaaaattagtcgatgaacctgtacaccttggtgacaccttactggtgattggcgactggaaactgattcgggcattgaaaaccaaaacacctgatttcattgtgttgaacctgcccgttgaagtggaaagtgccgctcctgcagcatcacaggcgcctcatgctctgttttgccttgcccttatggtggcgatgatgctgaccaatgaaattcccaattttgttgctgccttgattgcctgcctgctaatgggaaaatttcgctgtatcgatatggaaagcgcctatcgtgccattcactggccgagcatcattttgattgtcgggatgatgccttttgctctggcactacaaaaaacgggcggtattgatttaattgtcaaaggcttgatggatattgccggcaacatggggccgcgggtgatgctgttgtgcctgtttgtactctgtgcgctgatcgggttgtttatctccaatacagcgactgccgtattgatggcgccgattgctattgctgcggcgaaacagatgtctgtttcacccttgccctttgcgatgattattggtgttgcggcttcggctgcgtttatgacacctgtttcatctcctgttaatacgctgatactggggcctggtggatatcggtttgctgatttcctgaaacttggcgtaccttttacgctgatcgtcatggggattagtgtggcgatgatcccgatactttttccattttgatctttttcccaatcgactgtttcagggatttcaggtggctaagtttaaatagtacagcttccgcatcaaggaagctgcattgtggttacaggctgatttcatcaagcgaaagactgaaacctggcacaaacactgtcagaaagtaatccatctcttcactgtggcgttcggccaatgttttttccaatcgtgatttggcctgattgaattcagcgttgccagccgatagctcctccagacatttcaaataagcacataacgcatcggcctgtttgacaatggcagtttcttcgtccgtgtgaagctgatcatccaaaatagagcgaaaatcatcctgtaattcagaaggcagcatagtcaataatttatgttgggcgattttttctatttttttgtattcgtgggcaatttggggattgtaatatttaattggggtgggcagatctccggtgatgacttcgctggcatcatggtacatggccagcagggcgatccgttcggcattaagactgccgttgaatttacggtttttgatcaccgccagtgcgtgggcgacaaaagcgacttgcaaactgtgctctgaaacattttctgtacgtacatttcgcatgagaggccagcgattgatcaacttcaggcgagataactgggcgaaaaaatgactcataatttcctcttgctgcgggacaacaatgtgattaattgtgggcggagtcaggacggaagtaaacccattaagagccaaaataagttgtgaaaggcaattggaatctgtactgaatgagagtgtgggggatatgtgcggcatagagatattagagcctaaacggctctaatattcacgcagggtggttatgcttattgacgataattgccgataaatcgggcaaatttctcaatcgctatttgcagatcagttgtatgtggcaatgtgacaatacggaaatggtcaggttctggccaattgaacgctgtaccttgaaccagcagcactttttcctgtaataacagatccagtaccattttttgatcgtcatggatgttgaaacgtttggtgtctattttcgggaacatatacagagcacccatgggcttaacgcaggaaacacctgggatctgattaatcaattcccatgcacgattacgctgttcataaaggcgaccgcccggaaaaataaattcgctgatgctctgatagccacccaaagctgtttgaatggcgtgctgcatagggacgttggcgcaaagacgcatggatgccagcatctccagcccttcaatatagcctttggcctgttttttcggaccattcagtaccatccagccttgacggaaacccgcaacgcgataggtttttgacaaaccattaaaggtaacggtaaagagatcgggagccagtgccgcgatggaatggtgctgggcatcatcgtacagaattttgtcgtaaatctcatcggcgaaaatagtcaaattatgctgacgggcaatttccacgatttccagtagcagctctttgctatataccgctccggttgggttgttcgggttaataatgacaatcccccgggtacgcggggtgattttacggcgaatgtcatctaaatcagggaaccagccttgttgttcatcacataggtaatgaacagccttgccgctggaaagtgataccgctgctgtccagagaggataatccggcgcaggtaccaacatttcatccccagtattgagcagagcttgcatggattgaacgataagctcagaaacaccgttaccaataaagatatcttcaacggtaatatccagcatatttctggcttgataatgctgcatgattgctttgcgcgcggagtacagccctttcgaatcagagtatccctgagcggttgcaagattgcgaataacatcgaccagaatttcatcgggtgcttcgaagccaaatggcgccggattaccaatgtttaatttcagtatcttattgccttcttcttcaagtcgtttggcttctttgagggtattaccccggatgtcatagcagacattatctaatttgctggatttattaatggaaaacatagagtgccttaacctcgtggcaataagtgggttttacccggcatacaaggtgtggtgattaaagtgtaatgattaatgtactcctcccggtctgtattttgaagatgctttgatatctttggtgaaaacggttgttttaaagactaatgtataagtttgccctctaaaaatgcgtattttattggtgttttattctttatttttatttattcttggttttatatttcaaataatgacgtgtttttagttggttgaatgaaaaaataggtaatttaatgatgaatttttagtctgtaacattaaatggaactcgaattgtcaataaaagtaagaaggtttgtataatgtattcttataatttatctttactgacgtaaagttaattaaggtttttatcacatgatactttgacaatgtttttgaatttttacccgtaacattttcaggacttttcaatgaaaaagtaaaaccattaagaatgttaatatttttcggttgagataaattttcttcattcagttactctattctttgaggtaagtcagaaaaaggatatttgtactggaaattagtgattatgtgatgtaaatagagttttatctccgctttaatttggagattgcataaattttgttaagaaaggagaaattaaaacccatgattatatagatagtaaaaaaaaagcagtaaacctttgccctctttaatagagtagagtaatgtcacaatcggtattattttatttgatactgctgaagtaaaaacaccaggttagttagtaattaaaatcaaaaaaaagtgatgaataaacaatgataaatgcaaatcgtcagataataaacctcgatctcgatctgctaagaacttttgttgccgttgctgacttaaatacttttgcagccgcagcagcagcagtttgtagaacgcaatcggctgtgagtcagcaaatgcaacgtctggagcatcttgtggggagagaattgtttgctcgccacggacgtaacaagctcctgactgaacatgggcttcaacttcttggttatgcacgccagattttgcgtgccaatgacgatgctactgcatcattgacgtacaatgatgctgacggtgaattaagaataggggcatctgatgatactgttgatacccttcttcctttcctgttaaatcgcattgcttctgtctatccacgcatggctgttgatgtgcgaatcaaacgcactcagtttattgaaagcatgctggataaccatgaaattgatttggcattgaccacagcaaaaattaatcaccatccaaaaacggttctgcgctcctcgcctgtactatggcactgtgcgcctgattttcagttgcagacgaacgaagctataccgttggttgtaatggatgaaaccaacccattccgtcagatcgcgctggatacgctggatacggccggtatttcatggcgtattgcttatgaagcggcttccctatcagctgttcgtgcagctgtgaatgctgaagttggcattactgcccgccctctggaaatgcagaatgcagatctaagaattttgggggaaagtgaagggttgccacgcctgccagaaatacaatttttcttgtatcgaaacagtaacgaacagaatgaatctgtcctgactgtttttgatgcaatagaaaataagaaaacaccttataccgtaactactatcgaatctaatgaaaccgacgagattgatgaatcagttgaaatatcctctgttgaaaatatagacgagtaagtattacgtgttttataggctaatatttccattttatttgtagagatattagcctttctctaaactgttattaatagttcttcaggttttcgtttccatttctgatatttccctccaaaaatataccctattaattttcctatctctttcgaattttagttaaaggaatgttgttttgttaacaactttcatttttttaaattgataaaataaactcgcttttggaaatagttgctagattacggttctatagtcctttttagaaataatttattaatgattgaatgaattacattcaagtgttgaatatttttcaatgaaattgtgcactcgatcataaaaatactctgatcagtgcggtggaaagacaggtttttcctgagataatagtgtagtaaagtcgagttatcggttaaactagttatagcgtgttggtggctttttactcgactgacacgttttagcgatatataagcacaatctgttaattaatggttttttgtttgtaaataaataggtagtcgcttttgccatgcaggcaaaatattgtttagaggaataaaaaccaagacgattcaagctattaatgatattgattagcactgtttcatatttggttgttatcccttcccatgagtcgatgtggtgcaacactgccggcaaaaaagcagacatcttgacaccacttttgatgagtaagcaacgagtatgtctacatccactggagtttttgcccatcactgggcgtttgcagttttcctgctaggtgcttttggtctgtgtgcgcttatgttattgggtgcgtacttcctggggggcaggtcaaaaggcagagcgaaacacataccttatgaatcgggtatcgattctgtcggcagcgcccgtctccgcctgtcagcgaagttttatctggtcgccatgttctttgtcatcttcgatgttgaagccctttacttatacgcatggtcagtttctattaaagaaagtggctggctgggttttgccgaagcaagtattttcattttggtgttattggcaggcttggtttatctggctcgcatcggagcactgaactggactcctgtacgctcacaacgtcaagtcagtcaacccagtgctgacattcataccaacaacagtcatatgcagtaaatagcgaggcataaagatggattatacgctcacccgcatagaaccgaacggtgagaatgaccgttatcccctgcaaaaacaggaacttgtcaatgatcccctggagcagcacgttcaccgcagtgtctatatgggtaaactggaacatgctttgcatgacatggtgaactggggaagaaagaattccttgtggccttataacttcggactttcctgttgttatgtagaaatggtgacgtcatttaccgccgttcacgatgttgcgcgtttcggcgcagaagtattgcgggcatccccacgtcaggccgacttcatggtgatttcaggaacctgcttcgtcaaaatggcacccgttattcaacgtctgtatgaccagctgcttgagccaaaatgggtaatttccatgggtgcctgtgcaaactccggcggtatgtacgatatttattctgtagttcaaggggtcgataaatttatccctgttgatgtttatatcccgggctgtcctccccgccccgaagcctatatgcaagcactgctgctgttgcaggagtctataggcaaagagcgccgccctctatcatgggttgtcggcgatcagggggtttaccgcgctaatatgcaatcagaaagagaacggaagcgcggtgaacgtattgcagtgaaaaacctgcgtaccccagacgaaatttaaggcttttagccatatagcgtacgtaaccagagcaatgtgttgcgatcacaataaaccctgatcaagcgttgtggtgaagaatgatgacagatcagatagcgcaagaaagcgcacggcctgcttgggaaactcaggatcactttgatgatccggttgtaagcgagcttaatcgtcaatttggcccagaggccttttccgtccagcctacccgtaccggtatgccggttgtctgggttaggcgagaacaattactggcagtaataacgtttctgaaaaaattgcccaaaccttatgtcatgctgtttgacctgcatggtgtcgatgagcgtcagcgctctcaccgacaggggcttcctgcggcagacttttcggtattttatcacttgatttccattgagcgtaatcgtgacatcatgctgaaagtcgcactcaatgaaaaagacttgaatatcccaaccatcacgtcaatttactctaatgctaattggtatgagcgtgaaacgtgggagatgttcgggattacattcaatggtcatccgaatttgcgtcgcatcctgatgccggatacatgggaaggacacccgctgcgcaaggaatattccgcacgcgctacggaattcgaccctttcatgttgaccaagcagaaagaagatctggaaatggaagcactgactttcaaaccagaagagtggggtatgaaacgcggtaccgaaagtgaggatttcatgttcctcaacctcggccccaatcatccttcagctcacggcgcattccgcattgttcttcagcttgatggcgaagaaatcattgattgtgttcccgatattggctaccaccaccgtggtgcggaaaaaatgggtgaacgtcagtcatggcacagttatatcccttacaccgatcgtgtcgagtatttgggaggatgtgtcaacgaaatgccgtacgtgctggccgttgagaaactggctggcattgatgtgcctgatcgcgtgaaaactatccgcgtcatgttgtctgagttgttccgcattaacagccacctactctatatcagtacatttattcaggacgttggcgcaatgtctccagtgttcttcgcctttacagaccgtcagaaagtgtacgatgtcgtcgaggcgattaccggattccgtatgcatccagcatggttccgtattggcggtgttgctcatgacttgccccgaggctgggataaacttctgcgtgaactgcttgactggatgccaaaacgtttgaattcctatgtcaaggcagcgctgaaaaacagtgttctgaaagggcgttctgtaggcgtagcttcttataactccaagcaggcattggactggggcgtgacaggtgcaggtttgcgtgcaactggtatcggttttgacgtgcgtaaatggcgcccttattccggctatgagaacttcgattttgaagtgccaacaggttataacggtgactgttacgaccgtgtcatgctgaaagtggaagagatccgccagagcatgcgcatccttgagcagtgtctcaagaatatgccagaaggcccgttcaaggcggatcacccactgaccactccaccacccagagagcgtaccctgcaacacatcgaaaccatgatcaaccacttcctgcaagtgtcatggggtccggttatgcctgccaatgaatcattccagatgattgaagcaaccaagggtatcaacagttattacctgaccagtgatggtaacactatgagttaccgtacccgcatccgtacaccgagttttgctcacttgcagcagatcccatcggtgatccgcggcagtctggtttctgacctgatcgtttatctgggcagtatcgattttgttatgtctgatgtggatcgctaacgatgcaaagtgaatttaacgcaaacaagcaagtacgtcttgatgtgattaacgtaacggacgctcagacacagggtgcgtttgtactgagtaccgcagaacgtgatgccatcgagcaggaaaaacaccattacgaagatccgcgtgccgcgtcaattgaggcactgaaaattgtgcagaaacagcgtggttgggtgccggacggcgccatctatgccgttgctgaagttttgggtattcccgccagtgatgtggaaggggtggcgacgttttacagccagatttaccgccagccagtagggcgtcacattattcgctattgcgatagcgttgtgtgtcacatcacaggttatcaggatgttcaggcagcgatagaaatgcacttgaacattcgtccggggcaaactacggaagatgggcgtttcacactgttgccaacctgttgtctggggaactgtgacaaggggcctaccatgatgattgatgaggacactcacagttacgtgaaaccagaagaaattgaaaaactactggagcagtatccatgacaacgcactcaggagtgaaagaaattatccgcgtagcggaaactcatcccctgacatggcggttgcgtgatgaccaacaacctgtctggctggatgaataccgtagcaagagtggttataaaggagctgaaaaagcactgaagggcatggttcctgatgaagttaccacgctggtgaaagatgctggtttgaaagggcgtggtggagcaggtttttccacgggcttgaagtggagcctgatgccaaaagatgaaagcatgaacattcgctatttgctgtgtaacgcggatgaaatggagccgggaacctacaaagaccgcctgttgatggagcagctgcctcatctgctggtggaagggatgctgatcagcgcatttgcgttgaaagcctaccgcggctacatcttcctgcgtggcgaatatgtcgaggcggcggtacatctgcgcagagcaattgaagaagctaaagcggccggtttgctcggtaaaaatattcttggtagtggttttgattttgaactgtttgttcataccggcgcagggcgttatatctgtggtgaagaaaccgcgttgattaactcccttgaaggacgtcgggcgaatccccgttcaaaacctccatttccggctacgtccggcgtatggggtaaaccaacttgtgtaaacaatgttgaaaccttgtgtaacgtccctgcgatccttgaatatggtaaagagtggtacatcggtctgagcgaaggcaaaagtaaagatgccggcaccaaactgatgggcttttccggtcgggtcaaaaatccgggcgtttgggaactgccttttggcaccactgcccgtgaaattctcgaagattatgcgggtggtatgcgtgacggtctgaaattcaaggcttggcagcccggcggagcgggaaccgatttcctgactgtggatcaccttgatctgccgatggattttgaaaatatcgctaaagcaggcagccgcttgggaactgcactcgcaatggccgttgatcatgagatcaacatcgtttccctgacccgtaaccttgaagagtttttcgcccgtgaatcctgtggctggtgtacgccatgccgtgatggtttgccgtggagcgttaaaatcctccgcgccattgagaacgggaaaggtcagcctggtgatatcgaaactttggaacaactctgccgtttcctcggccccggcaaaactttctgtgcccatgcgcccggcgctatggagcctttgcagagtgctattaaatatttccgtgatgaatttgaagcgggaattgtcaccaaagactacggcaacaccaatctgattgcgggcattcagccaaacctgcttaagcagcgctggtaaggcttgtttgcaagaacggttcgctcaagcagaatttttgattaacgcctgccacggcaggccattgggaagcatgctgactatggctacgatacatgtagacggcaaagaatatgatgtaaacggggctgataacctgttacaagcctgcctctcattggggctggatataccttatttttgctggcatccagcgctgggaagcgttggcgcttgccgccagtgtgcggtgaagcaatatcagaacgcggaagatacgcgtggtcgtctggtgatgtcttgtatgacaccagcgacagaaggcacgtttatctccattgatgatgaagaagcgaagcaatttcgcgcaagtgtcgtggaatggttgatgaccaaccatccccatgactgccctgtctgtgaggaagggggtaactgtcacttgcaggatatgacggtgatgacggggcattcattccgtaaataccgttttaccaaacgtactcaccaaaatcaggaactggggccatttgttgcccatgaaatgaaccgctgcatcgcctgttaccgttgcgttcgctactacaaagattatgcggacggcacagactttggcgtttatggtgctcatgacaacgtttattttggtcgcactgaaagtggtacgctggagagtgaattttccggcaaccttgttgaaatctgcccgacaggggtatttaccgacaagacccattcagagcgttacaaccgtaagtgggatatgcagtttgcaccaagcatctgccaacagtgcagtattggctgtaataccagtcccggtgaacgtcatggtgaagttcgccggattgagaaccgttacaatggcaccgttaaccactactttatgtgtgaccgtggtcgttttggctacggttatgttaaccgtgacgatcgtcctcgtcagccacagcaattgcgtggtgatcagtggatttcactgaatgccgagcaggttatgcagggtggggcggatattttgcgtcaggccaaaaatgctattggtatcggttcgccacgcgccagcattgaaagcaactttgctctgcgtgaactggttggtgaagaaaacttctatagcggcatatccgtggaagaacagaaccgactcgatatgatactggaaattcttcagcaaggcggcgtctatactccatccctgcgtgagatcgaaggttacgatgcagtactgattttgggtgaagatctgacccaaacgggggctcgcatggcactgtctgtacgccaggcggtcaagggcaaggcgcgtgaaatggcggcggctcagaaagtggctgattggcagattgccgcagtgatgaatatcggtcagcacgccaaatatcctttgtttttaaccagcgttgatgatacccgactggatgatattgcagcatggaattaccgtgcaccaactgatgatcaagcccgatttggttttgctgtggcgcatgccctgaacagcattgcacccgccgtcaatgacctgccggatgagctgaaaacgaaggtagaaattgttgcacaggcactgcgtgatgcgaaaaaaccattgattatcagtggtagtaatgctggcagtgatgcattgattcaggcggcggccaatatcgcatgggcattgaaagacaaaggtgcaaatgttgggctttcctttgttgcggcttatgctaatagcctcggtctggcgatgatggaagcacagccgttggatgtcgctttgcagcgtattgccaaaggcgattctgataccgcgattgtagtggaaaatgatctctatcggcatgcggcagccgataagattgacagtgcattaggcagcctgaaaaatctgatcgtcgttgatcatcaacgtactgctatcatggataaggctcacttgattctgtcagctgccagctttgccgaaagtgatggtacgctggtgaatcaggaaggccgtgcccagcgctattttcaggtttatgaaccgtcattctatgacaaatctgtcgttatgctggaaagctggcgctggatgcattccctgtataccacttacgcacaatgccagactgactgggcgcaacttgaccatgtgattgaagcttgtgtcaaagctatgcctcaattcaaaggtatcgttaatgccgctccggattccacattccgtatccgtggtcagaaattggctcgttcacctcatcgttacagtggccgtacggcaatgctggccaatgttagtgtccatgagcagcgccaaccgcaggatatcgacacggcatttgctttctcaatggaagggaacaacagcccgtttgccgaacgtcagcaaatcccatttgcatgggcgcccggctggaactccccgcaggcatggaacaaattccaggcggaagtcggtggcaaactgcgtttcggtgatcctggtatgcgtttgattgaaacgaccgatggtgggttgaactactttgacagcattccggctgcatttgctgcacagaaaaaccaatggtatgtcgcgccttatttccacctgttcggcagtgaagaattgtcacagcgtgcagaagtaatacaggaacgtatgcctgagccgtatgtgatgataaatcatcaggatgctgaacatctgaatgtgaaagaaggttccatgatggaatttgactgtgcgggtcaacaattgcgtctggctgtgcgcttaagcggcaatctggtgcagggtcagattggcctgccgctgggaatgccgggtattccacctgttctggcgggtaaatcagtcaataacttacgggggatggcacaatgagttggtttactcccgatgtgattgaagtcttgattactattctgaaagcggttgtcattctgctggttgttgttgtttgcggggcgttcatgagtttcggtgaacgccgcctgcttgggctattccagaaccgctacgggccaaaccgtgtgggttggggcggttcattgcagctcgtcgctgacatgctcaaaatgttttttaaagaggactgggtaccgcgtttctccgatcgggctattttcactctggctccaatcattgctttctgctcgttactgctggcgtttgctatcgtgccagtcagcccaacgtggatggtggcggatctgaacatcggcattctgttctttatgatgatggcaggtttgtcggtttacgctgtgctgtttgccggttggtcgagcaacaataaatattccctgttgggggcaatgcgcgcatcggcacagacactgagctatgaagttttccttggtcttgctctgatgggtgtcgtagcacaggctggctccttcaacatggtggatatcgtcaattcacaacaacatatgtggaatgtcattccccagttctttggtttcctgacctttgctattgctggtgtggcggtgtgtcaccgtcacccttttgaccagccggaagcagagcaggaattggcggatggttatcacgtcgaatattccggcatgaaattcggtttgttctttgtcggggaatatatcggtatcgtgacggtatctgctttaatcgtcacactgttctttggtggctggcatgggcctttattgccttccttcatctggtttgcgttgaaaacggcatttttcatggtgatgttcattctgatccgtgccgcattgccgcgtccgcgttatgaccaagtgatgtcatttggctggaaagtctgcctgccgttaactttactcaacttgctggcgactgccgcagtaattttatacaacgctcaataaaggggggattgaaccatgacattgaaagagttagtggttggtttcgccacccaggtacgcagtatttggatgatagggcttcatgccttccataaacgcgaaacaaaaatgtatccggaagagccggtttatttgccaccccgttaccgtgggcgcatcgttctgacgcgtgatcctgacggtgaagagcgttgtgtcgcctgtaacttgtgtgcggcggtgtgtccagtaggatgtatctcactgcaaaaagccgaacataaagatggccgatggtatcctgaatttttccgcatcaacttttcgcgctgcattttctgcggactgtgtgaagaggcttgcccgacgaccgctatccagttgacaccggatttcgaattgggtgaattcaagcgtcaagatctcgtatatgaaaaagaagatctgctgatttcaggaccgggtaaatatcctgattataacttttaccataagacaggcatggcgattgatggcaaagataaaggggaagccgacaatgaagctaaacctatcgatgttaaaagcctgttgccgtaaggagcgatattcatggaatttacattttatgtcgcagggctggttgccatcctcgctacactcagggtgataacgcacactaactcagtacatgcgttgctgtacctgattacttccctgttggcactttcggtcgtgttcttttcactgggcgcatattttgccggcgcactggaaattatcgtttacgcgggtgcgatcatggtgttgtttgtcttcgtcgtgatgatgctcaacctcggtaaatctgttgtcgagcaagaacgggcatggttgcagctccgcgtttggatcggcccggctattctggctgctgtgctgctgattgtgttgatctttgctatcagcagcctgccaacggctgagatcagcggtgaagtggtcagtgccaaagaagtgggaattagcctgttcgggccttatgttctggcagtagaactggcatcactgttactgctggcagggctggtagtggcttatcacattggccgtgaaaatcgtcagggtgaagtgatcagtaatcgtacggaggatcaataatgatacctttagaacatggtctgattctggcggctattttgtttgtattgggctttgtttgcctgattgtccgccgcaatctgttatttatgctgatcgggctggaaatcatgatcaatgcttcggctctggcgtttgttgttgccggcagctattggctccagcctgatggtcaggtgatgtacattctggccattactctggcagccgccgaggcgagtataggtctggcactgctactacagttgtaccgtcgtcgccagagtctgaatattgatatagtcagtgagatgcgcggatgaacctactctatttaacaattctactgccactgctgggttttttactattggcattctctcgtggccgctggtctgaaaatctgtcagctatcattgggagtgcttctgttgggctggcagcattagtcacactctgggccgggatggatttccacgcccagaatggggcagaggggctggtttacagccagacattgtggaactggatggaggcagataacttcaatattccggttaatctggtactggatgggctatctctgaccatgctgagtgtcgtgacgggcgttggtttcctgatccatatttatgcttcatggtacatgcgcggtgaagagggttattcccgtttcttcgcttataccaatttgtttatcgccagtatggtggttttggtactggcagataacatgctgctgatgtacctcggttgggaaggtgttgggctgtgtagttatctgctgatcggtttctactataaaacgcctgccaatggtgcagcggcaatgaaagccttcatcgtaacccgcgtaggtgacgtgttccttgccattgggatgttcatcctttatgaccagcttggcacattgagtttccgcgaattggcggtattggcaccgcagcatatcgaagcaggctctacggcgattacttgggcaaccttgatgattctgggtggtgctgtgggtaaatcggctcagttaccactgcaaacatggttggcagatgcgatggcaggtccgacaccagtttctgccttgatccacgcggccactatggttactgccggggtttacctgattgcccgcagccatgcgttgttcctgatggcgccggatattcttcatctggttggtactattggggctattaccttgctgctggcaggctttgcagcgctggtgcagaccgatatcaaacgtgtgctggcctattccaccatgagtcagattggttatatgtttctggctctgggcgttcaggcgtgggatgccgccatcttccacctgatgactcacgcattcttcaaggcactgttattccttgcttctggctccgtgattctggcttgtcaccacgaacagaatatcttcaaaatgggtggcttgagtaagcgtattccgtttgtttatctctgcttcatcgtaggtggttcggcactgtcagcgctgccacttctgactgctggtttctacagtaaagatgaaattctgtggggcgcactggcgaatggtcatatgaacctgatgctggcagggcttgtcggtgctttgatgacatcactgtataccttccgcatgatctttatcgtgtttcacggtgaagaaaataccaaggctcatccagtcaaagggattacccatactttacctctatcggtactgctggtgctctctacttttgtgggagcgctgattgtgccaccgttggcgggagttctgccggaaagaagtacaacggcagggcatgatgacaaactgacattggagattgtttctggtgtggtcgctgttttcggtatcttgctggcagcagcgttgtacctgggcaaacgtgctgtggttaaggccactgcaaacagtataccggggcgtttcttatccacatggtggttccatgcatggggatttgatgcactatatgactggatattcgtgaaaccattcaaaggtattactcaactattacagaatgatcctttgaactcactgatgaatattcctgccatattgtcacgttggggcaataagggacttagcttaagtgagaacggacaagtccgttggtacgctgcctctttggggttgggtgcagtgctggttttggctctgctgcttttgatttaattaagggacacattgcgccatgctactaccttggctaattcttctacccttcatcggaggcttgctatgctggcaggcggagcgcttcggcacccgtatgccgcgttggatagcgcttctggcgatgggactgactctgctgctttccctgcaactttggttacagggcggttatacgctgaccaacccacagggcattccacagtggcaatcagaatttctgatcccgtggatacctcgctttggcatctccattcatctggctttggatggtttatcactgctgatggtggtcttgacagcactgttgggtttgatggcaattctctgttcgtggaatgaaaaccagccatatcagggattcttccatctgaacttgctatggatacttggcggtgtgatgggggtcttccttgccatcgacctgttcctgttctttttcttttgggaaatgatgctggtgccgatgtatttcctgatcgctctgtggggacacagaggttcaggcggcaaaacccgtattacggcagcgacgaaattcttcatctatacccaagccagtggtctggtaatgctgatttcgattctggcattagccttcgtttatcacgatgcaacgggagaatggtcattcagctatgaaaaactgctgaatacaccgatgtcagatacagttcaatacttactgatgctgggtttcttcatcgcatttgccgtaaaaatgcccgttgtgcctctgcatggctggttgccggatgctcatagtcaggcaccgactgcaggttcagttgaccttgcggggatcttgttgaaaacagcggcgtatggtctgttgcgttttagtttgcctctgtttccacaagcctctgcggaatttgcgccgattgcgatgtggctgggtgtcattggtatcttctacggtgcgtggatggctttcagccagactgacatcaaacgcctgattgcctataccagtgtttctcacatgggtttcgtacttattgccatctacaccggcagccaactggcttatcagggggcggtcatccagatgattgcacatggtctgtcagccgctggcctgtttatcgtgtgtggacaattatatgaacgtctgcatacccgcgatatgcgcaatatgggcggtttatggggaaaaattcaattgttgcctgcgatctcgctgtttttcgctgtagcgacactgggtatgccgggaaccggtaactttgttggtgaattcatgatcctgttcggtagtttcagcaaattcacccttattactaccgtatccgtgtttggtttagtttttgcatccgtctacgcactgtatttaatgcagaaagcgtattacggcacaccaacaactgataagccactacaacggatggatgtgcgtgaaatctccattttgctactgttagtcgtcttgctggtgattgtgggtgtttatccgcagcctgtccttgatacctcagcggcggcgatgagtaacatccaaaattggtattcagcttcacttttaactacaaggccgtaactcgccatgacaataacttctgaacaattgatcgcactgttgccgctattgatcgtcggattgacggtggtggttgtgatgctgtccattgcgtggcgacgcgatcatttgatcaatttcaccttaacggtaattggtctgaatctagccctgctttctctctattttgttggacagcaggagccgatggatgtcacgccactgattcatgtggatagatttgcaatgttttataccagccttgtgttgattgcgagcctcgcaacgaccacatttgcttactcatggctggagaattatcccgataataaagaagaattttacctgttggtgctgattgcagctgtcggaggaattctgctttcttctgctaaccatatggcatcactgtttatcggcattgaattaattactctgccattattcggcttgattggttatgcgtaccgccagaaacgttcactggaagcgagtattaaatatatgctgctgtccgcagcagcatcttcgtttctactattcggtattgcactgttgtacgcagaatcaggtgacttgtcctttgcgtcactgggtagaaacctgagtgacagtcaactgcatgagccgctgatcttggcagggctgggaatgatgctggtgggggtgggtttcaaactttctctcgtacctttccaactttggacacctgacgtttatcaaggcgccccggcacctgtatcgacttttctggcgacggccagcaaagtcgctatttttgcggtgataatgcgtttattcctcgaagcacctgtggctgaaagtgaaacgctgcgcattgtgctgaccgtgatggcaattgcttccattctgtttggtaacttgctggcactgacacaaagtaatatcaagcgtctgctcggttactcatcgattgcgcacttgggttacttgctggtggttttggttgccatccgaagtcacacattggcagaagaaacggcgggtatttatctggcgggttacctgtttgccagcatcggcgcatttggggtggttagtctgatgtccagtccataccgagggccagatgctgactcactgtattcataccgtggcctgttctggcataaaccgatcctgtcggcagtaatgaccatcataatgctgtcactggcaggaataccgttaacattcgggtttatcggtaaattctatgttatcgctacggcggtagaagcaaaattatggtggctgacgggggctgtcgtgctgggcagtgccattggtctttactactatttgcgcgtgatggttagtctgtatctgcctgcaccgaagacactgaatcgcgatacgccaagcaactgggcgttgacttcaggtgggattgttgtgttgatctctgggttgctggtgttgatcctcggcatttggccacaaccagtaattgatatcgttcagcaggcgaaaagcgccatgtagagcataatcttaataaaactttactgaagactcagccatttttggctgggcctttttttgagacacgaggaaagtatcatgaaatagcatttattacggtagtagcatcagaatggtttctattatgcagcaataagaaatcgtccatgtgtaggttctgtcgtattaagcagtgtccgggtatcatgccgtttttttgttgagtgattcaccgatgtcccttatccgaaaagcattcaaacgcctgcactaccctgttaatatcatcgttcagtgtgttcgctggtatctggcctatgcactgagcctgcgtgacctggaggaaatgctagctgagcgggggataaccgtcgatcatttcacgctctcccgctgggttcatcgtctgatcccgttgatggtcaaacgctatcgacggagcaagcctgctgttgggcgtcggtggcaaatggacgaaacctctatcaaaatcaaagggaaatggagttacctttaccgtgctgtggattcagacggcaaggcaatcgcatctaaatttgatgcgctttgcccagtactgtaagtagatattcaccatcccaaccagcccgtttacggcgtgctttaattcccgctttggtgggagctaagcgcagtaaattcaacgcgattttattgagtaatgccatattggcggctgcattgccttcccgcatccgctgctgatcttcattaaaagcaatatccagacaccaatggagttgcgtttctatttgccagtgactgcggatcgctgtcgctgcccgttgagcctctgtcggacgtaaagtgctgataaaataacagctctcccggctcacttcatttcctacatagcgttcgcggatcacccgtattatgctgtgtaaaccacaccagcacgccttttccggcaaccaatcaacatgggtcatttgtactgtgcgtcgctcaatgcggccatgtccggcatccacgtcttcatattcgctcaggcgctccggttgggatgagacataatcgaaataatggctgacatcattatacgggccgggatgattttctttcaggctcagtacgtaatccgcgcccgcttcatgtaattgatgagcaatcgctttctggcatcccatggcatcgatagtcaccagacttccagacaaaaccaatcgtcgaagtaactcaggaatagcggtgatttcattggatttactctccactttcacttgtcccagaactaagcgattggtacaggcaaaggcgctgaccagatggattgccgccttgccgttggctttatcgagtgaccggcgcatggttttgccatcaatagcgatgataccctgatcaactccttgtgccagcgtagatatccaggaggtgaaacagtcggcaaaagcctgcgcatcaagtgcagcaaagacacgaccaaaggtatcgtgagaggggatgccattagtgagatcaagcagttgggtaaagaaatcctgtttagattcgccaaactcttcaatttcgacccaaccttcagcgccacaaatcacagcgcagatggcgatagtcaggatattttccaaactatgcaactgagttcgttgaactcggggatcttcaagtgaggcaaaatgctgtaacaaagggctgacagaggacataaggatggatttaaaagctgcataacgacatgaaattaaaccattgtcaatgaattttagatgcgattgccctgcctaaaggggagagttacattattattgagtcagaaggtgttaaaattagccggatcgggatcaatcatgatgaaccccgcgtaagaaaagctaaacatcgttctttaatagctcaattaaatgaagagctcgaaggctatacgccggatctttttaaggaaactgatagtaagcatagtgacattaatacgttaggtatgttgttaataaatattaaccctccatatcatgagtctcaggtcagcatgatggatttgaggatagtggttcctttcactgacatgaaaggttatcactacgataaatctgtcacggagcttttaatgctctacaccggagagaagaaggtagttattcctgatatggtcgtacctaagcttaaacagcgcctgaaggatcaggaaagtaaataggtgagacattatgagagtgggaatttctggtttccaacccgcaaggctgacacagatgagagaggctagagggttatctaaaattagcctgggtaagttagtggagcgttctccatcaacggtgactaaatgggagaacggtaaccattccccggatgcagaaatactgcacagcttaagtcgagtgctgaattgcccagtgggttggtttacaaagcctgttatcaagtatgaaaagaaaccagtattctttcgaacactttcaagcacagcaaaagacttatgtatttctgcagaacgatacatggggtggtttcaagaactatcatttaagatgcaagaatatcttgattatccggatgttgacattcctcatctcgatgtcagggattacagagcaatagatgatcagttaattgaaagaatggcttttgaatgcaggaaagcgtggggattaggtattgccccgatagatgatttgttactcgtaatggaaaatgcaggcgtcgtttgctctcgatttgaacagggtagcactgtcatggatggctattctcaatggaatgacgtagaaaatagaccttacgtaatattagcaagtgacaaagataattattatcgcagtcggtttgatgctgcacatgagttaggtcatattgttttacatcgatatattaataagtttgatcatattaactttaccccgatagaagaacaggcacatatgtttgcatcgtgcttcatgttgccggaagaatctttttctgtggagcttccgccttacccgacattagagaactttttagcgttaaaaagtcgttggggaatgtctgcacaagcgatgatcttgagagcacggaatttggagttaatatcacctttggaatatcaaagattgtataaaagtatttcggccagagggtggagaaaaggagagccgcttgatgagcttagaaaaccagaattggttcgcttattacctcgatgcctgaatttattactggattctggaacatttaataaaaaaacatttcttgaggaatttggtttccctaaaggtgatttggaggatttatgttcagtgcctaaaggttttttgtcagagtcaccgatacttgattttcaatcccgaatacaattaaagaatagtatgaatgtgaatgtatcttctgtacggcaagatacaaatgtcgttaacttattcaatagaaagtaaagttgggtattcacgctaacacctgttattctattcgcatcggcctgaacatccgaacctaaacatacgctgctgtgccattaccttaagggatcaagaatggcgcagcatagttttatcaaaatttccaacgacaccctacggcctgctactccagcgaccagagaatacctgcattcgaaaatcaaatgtagtgatgtgctgcaagctgattttaagaaagtccgtaatcctcgtttccaccgcaaatactttgccctgctgaatctcggttttgaatactgggaaccggttggtggcacgatttccccggaagaaaaagccattgtgcgcggttacgtacaatttctggctcactttgctggtagagaagatgccttacaatccgctgaggatgaataccttgcgggcttatccaaaaaccgtgcccataacatcacggccactaaatactttgatgcctttagacgttggataatagtcgagtccggccactatgacacctacgaaatgccggatggccgcctgtaccgtgaactccgttcagtcagcttcgccaaaatggatgaactggaatttcagtccctctatcaatccacactgaatgtgctgtggaatttcatcttataccgcaacttccctaccaaagacgcagctgaaaatgccgctgctcagttatttgattttgtgtgagcaagaagcaagaccaatgaccagaaatgaaaaacagtggctgtcagatgtggcttcgctgggctgtattgcctgcaggaatcaggggatggggatgtctccagcggacattcatcatgtgagaaccggacagggaatggcacaacgcgccgctcacctcagcgttctgccgctttgtcctcgtctcaccgggcatgttatcccacgggttttcatgctgatccgaaaagttggcaggcaacccacgggacagaaattgaattattagaacaggttaaaagggaagtaggagaggtgcggttaaccaaactcggcctcggccactacaaactatccggcgtccttggctataactcagacggtgcatggggtgttcatggcggtatcagtgttccccgtgacgtcaacggcaatgagttagtgtatgtcgatgataaggtgctgccggatggggctattgaaatcagggtgacgcaccgacagaacgcgcatatgcctgcccggttacagaacaggcgcattaagtcacaggatgagcagacgcactacaccgatgatgaggcctgtgatttgcccgcaggcacccggttagacgtacgtgtccagatgccggaggattctgtttggaatttgaggcagaaggcggtgaatggtgttgaagtgggtaaacaggcagagtaaggaatttttaacccgcaggaggttgcgggttaaaaattattgatgtgtttgaagatttagatgagagttataatcaacgaaatattttcttataattcagaatatatgattttgggtttgcgtgacaaagcatatcatatgcttcataaactatttcttgatcttgaggattgttacgcaccatagcaatacctcgcttatctgaggtcacttttttcttaaggcgtacaaaagctttatccgtaagaccaagaagcataatcttatcggcttcgagatcataaatatgataagtatttacaacgcttgcataagcagttgcaaccactctggatgatgcacgacagaatctacctatatttacttctgtgaattctgccccaccttcttcggttacggttttggctatattgtgggcatcttccattctgatttggtgcaatctggctgcactatcattagcctcattgacggatttttctatatctatctcttttgagtaaaatttatatacacactcaaaatcttcatatgggtaagtttttttattaaagcatttataaactaaatcttttttgacaatttttggttcttccgttaacccagcctctttaaagtatctatctctaatactttcaaaagtttcgggttctgtggatgagtgttcatagatgtaagtttgcccttttgaaacttgcatcaaatagttaaatttttgaacgtctgtagtggcagctttcttttcagtcagtaaagcatcaaccctttcgaattcagcacacccagacaacaaaacaatcccagctaataaaaaaatcaattttttcattttaatacctcatttaaactctggttataataacctagtggtattaaaaaacaatatgacaccccaagaggttaaaaagtgggaacttcataaaagtataaaggtgggatttctcaccttttaaccttttgatagatagtatctccggcatggtacaggcacgcttccggttgaaacggaggcagtggaagaaatgggcatacaaggcgttaaatatcagctaaatctttcgctcattccgaatcagtcaaattttcgaccaataaacccgccgaaaggtggctaattttccagatttaaaatcgggggcattatcatctcaaagcaggtgatttgaggtggtattcaagtcagcgcttgaagtatttatctaactcatcgtggtatcggtattttctgtattcgatgaaccaaaagacaaagcctagcactgcaccaattgctgcaagcttggtgtatagccaccatctgaatagaatgaattcgtaaaaagtgtattctttttttattaaatcaattgcaacaccacccatgatcatatcactgataaacgcaattactggtagagcaagagcgcatgcaattaccaaatatatcggagtaaatattcttactttagtattgaagttcataaagcttcgtaccttattgttaatgtatcaatattgtctatataggtagttaagattacttgaacagtgcaccaccaacactcccatgtcatcacattccgtggtggcatttttatttcaactatagaggaaatcaccacggttgccgtaaggtgtgatatcccatcttgggtattgcgaaaatcacaataccttttgtgtgtgcagataccccatatgtcaaagagcaggtttctgccctatagtgacagtagctttctttcccaccgttccacaatctcacgtttttctttaggtgtggttagatcccgatatctcatcaatgtaatcagtgggctggtgggtgggcgtggttttgtgtttgaaatttagtctaaaacagcgagataaaatggagatattgaggtgggattttacaccagttttacaccaagcaaatttgaagcataaaaaaaccaaccttaacaggttggcttttctagggaattttggtcggcatgataggatttgaacctacgacccccgacaccccatgacggtgcgctaccaagctgcgctacatgccgatgacttttcctatactaccgttttttattttcaaagcaagcacttaatttagtgagtgcttgatttttcgacgattagtttgctaaaaatcgtttaacctcagttagtatttgtaataactgagcgaggttaggtttggctccttgaatttcattaccatccaaatcatacagataatattctccgttcttggaaagatagatggtatttgtagccgttgtgacaatcaatgagccgtcatcacccgtgattaaccatgggttatctctctgagcggtaaagaggtcttcaccttgtgaataatcatctggagaattactgacatgtaataaacgttgcatcagggtagtcatgacatcctgatgactggttaacttgttgatgacctgtgcaggtgtacccggccagtgaatgatgagtgggacatgtatttgttcacgattgaatttatcgccagtaagccattttggtgagtgtcccgcggacaattcactgtgtttggctgtaataaccacgatggttttatccaacatacctttattggttagtgtttctaaaacattattgatttcggtatcaagtgcttttttgtcaaattggctcgttgagtgtgtaaaaccattaatgcccaaaaatgaaaaccacggggtagtgccatgattaagatccagccactgacgccattttgtcacagttaggctatcatctttcttggttgggacagggaatgaataatcggtcaaaagagcctggcggtaaagaggtgtttggaacccatccgaagagaacagaccaaattgatacctctggtgagtcagtgcatcaagaagtgctgaggattttctactattaagaataccatctagatagcctgatgatatgccatagaataatccaaacaatgcagtatcgttttgaatgccagtactgaagtgctgtgtaaattggatattgttctgagtaaagcgctcaagggacggcatggcgttggtaatgtctttgttatccagaccatctacaactagcaacagtaaattataaccttgcttgttatcttgataggataagccattcagtggatattcaacggatagggcagccgggtttccttgttgattcatacggcgctggtattcttgttgatccagtaatccgtgtttttcaaggaatttgcgtgctgtcattggataagacagtggtaaatttgaacgctgcatggtaattgagcggtagaagttggcatctgcccagatatacatcaaatgggaagcgataaaagctataataaataccgccgccaatggcttaccaaaccgttgacgattcaggctacgtaatttttgccaactccatgtgccaaatagcatctgcaccagaaaaatagccggtatgcagatgaacatcagttgccattcccttgtcagctcaccttggtctgggttggtgactaagtcccaaaccaacggtgtcaggtgcaggtgaaagcgaatatagatagaggaatctaatatcagcagggttagccctgctgtggccagtgcagcggaaagaaacctcaataaccgctgtgacatcacaataaacgtcagcggaaataaaataagtaagtaaatagcaaagacaatgaaactgaaatgaccgagccaactgagtagcgcataaatgcgaccaaacagtgaacccggccagtcagacgcaaataaatagcgactgcccagcacaagactgaacataatattgaacagtgcaaaccagtgcccccagctgatcatctgagaaactttttcgcggtaatgctgacgactagtcaccatattttttacgttaaggttttaatgaaaaattaatgcgctttgtcttcattaatcgaggactgtaacgcgcgtgcaaacgagtctgcgatgtgcctgcgctgtgcaggagcaatgctcgtattgattaaattcgttaccatattgcccaagatcatcagggataaatcagtaggcgtatggtttttctcgaaaacatttaccaattcagctaataaatgttcaactttttcatcgctgtagcgagacgactgtggcataaatcaaagatcctgaatatacaaagccctatatactaccgtatagaagggcaattttctgcttttttatgacaaattaatttcccgactgtgtgaattgttgccattctgaagtctgttgcatcatttttgccatttgaaatgagaggagtggatcattacattgtgaacacttttccatcacttggttttttggttgcagcagaaaggtaacggtgtttgaatacgccgctaaccgcaaggcccaacggtcaaagctgcaaaaggagtataaataatgagtctggaaatcacccagatcgcgttacaccgattgattaaacgtgatgaacaaacacttgaagtcattctgcgtgattctttgctgaccaccaatcaggtcgtagaagatatgatggctgaattacatcgtgtgtatagcgcaaaaagcaaagcctatggtttattcaatgatgaaagtgaactggcggaatcactccgtcatcaacgtaagggagatgaagactttctcggttttagccgtgctgcaaccgttcgcttgaaagatgaattgacaaaatatccgtttgcggaaggtggtacggtgctattttgccagtaccgatatctggccgtcgaatatttactgatttcggttctcaatagttgcaacagcatgtctgtcaatgacgagctggatgtgaacactacgcagtatcttgatattcctcatgctgatatcgttgcgagaattgacttgactgagtgggaaactaatcccgaatccagtcgttatctgacttttctgaaaggacgggtagggcgtaaggtttctgacttttttatggattttttggctgctagtgaaggcatgaatgccaaagtgcagaataaggggctattgcaggcggtggacgattattgcgaatcagcccagattgataaaaatgaacgtcaggcttatcgccagcaggtttacagctattgtaatgagcagttacaggccggtgaagagattaaactacaagagttgtcccaagaattgccaccattaggcgagcagaatttccagcaattttcgcaggaacagggatacgcattggaagatagtttcccagcagatcgcggtacattgcgtcaattaacaaaatttgctggcagtggtggtgggttgaccatcaactttgatgcaatgttgttgggagagcgaattttttgggacccagtgacggatactctgacaattaaaggcacaccaccaaacttgcgtgaccaactgcaacgtcgcggtagtggtaatgactaacgcctatcagtagtaagaataaagcagtagaaataaataacgccgcaaatgcggcgttatttactcggcgtcccgataaaagctcgattgtggctaattaagcacgcaggaaatcgatgtgcgtcagcttaggtttaaaaggatgacgctgtactgcctgcactttaactgtagtttctttaccatcaacaaccagattcagaacttcatagaattctggtttactttcatggttgataactgcatcgtgatccagttcgatagaaactggttcttggttaccaccatagataatagctgggaacttgttagctctacgcaggcggcggctcgcacccttgccctgctctttacgtacttctgcattaatagttaacattattttttctctgtaaaagaagaaaataaatcctgctacaggcgacccagcagcaggttcgagacttggcttaatataatgtactacactaagcgggcggcattttaacgaaaaacctatatgacagcaaatagaaagtacttttgggctgatttaatcggctcagtacagatcatctgctcggcgaaaccgcccttgatagtcaaagatcttttcccgaatttgccagaactggcctttttttcgtgcgacaacgaagtcgggatgtcgtaatagaggaagctgttgtgcaatgtcctcagctgttttccattgcagaggaatacccggcgcgcgctggtgctggcgcaaaaagtgaagctcaaatacttttctctgagcgggtgttgctaaacggaaccgttctgatacgctcgcaccatcttcatcgtgataagtgatttgcagccattcccctttattatcatgacccgacgttaattgcataccgccacaacgtagtacgagtgcatttttgagcttaagggcggctttcagcatatcatcaggatcgaccaggacttcctgacagcggtgacagcgtcgtgccgcgatatcattttctgcaccgcaatgtgggcatgatttaaaacgaaagcgaaaatcacattgatgccgtttgccgctttcatcttcttcccatccttggcaacggcggccaaaatgctcaatgatttcaccttcctctgtacatttcccccagaaggtattggcaaactggcagatagggcaaaatacctgtataggctggttttgagaattgggcttgctactaccgacttcgggggaataaatatcatgaggatttccggcgtaatccagaattaagcactcttttttgtcaggagataaacgtaatccccgtccgatgatttgttggtagaggctgacggactctgttggacgcaatatggcgattaaatcgacatgaggcgcatcaaaccctgttgtcagtacggagacgttgaccatatattggagttgttgcgccttgaaagcagtgatcaatagatcccgttcagttgctggcgtatctgcgctgaccaatgcagcctgttcagcaggcagcaattggaagatctctttagcatgttccactgtggcagcgaaaatcatgactcctctacggtcttgggcatattcgatgatttgcctgatgatgtgaggagtaatgcgtttttgtcgttttatctcccgattcaggtcagcttcatggaaaattccctgctggctggtacgaacctgactgaaatcatattgcattacgggcatatccaatctttctgggggcaccagaaagtgatgtttaatcatataacgtaacggaagttcataaatacaatcacgaaaaaaacagtgttcatctccacgtatcatgccatgatagtgatattggtatatccagccagagcctaaacggtagggcgtggcggttaagcccaagatacgtatctggggattgtttttcttgagttgctggataatttgttgatactgactattttcatcatcactgatgcgatggcattcatcaataattaacagtgagaaatgatagtcaaaacagtccagattgcgagcaacggattgaatactaccaaagacaacttttctttcactctgcttttgatgcaatcccgcagaaaaaatatccgcttgcaggtcataggcacaatacttgctatggttttgtgcaacaagttctttgacgtgtgccagtatcaaaactcggccgtgagccagttttgctaattctgcgatgatgaggcttttacccgcccctgttggcaaaacaatgaccgcaggatctttgtgctgacgaaaatggcggatggtagcatctaccgcttcttgttggtaagggcgtaaagtaaaagccattgttatgttactgtcatgggtattagataaaagatagttgatagagaggataacatttttctgtggtcttgccgtcgggaaagcgttttccattcagttgctaaagtaagatggctataacatgtagtttattattgttataattattgatgttacgatgactctgaatattatctggttaatcttgtactccaatagtgacccttgaagtgcttgcaatatcaagggtgtgttcatatgtttttattttctgtcaggtacatctattcatgcgattggataaatttttatcacagcagttaggtataagtcgtaacgatgtaggtcgtgaactacgggctagtcgggttactgttgatgacgaggtcattaagagcggtgcgtataaattgaagcccgatcatcagatagcctatgaaggttcagtattggaacaattaggtggttcccgctattttatgctgaataaaccacagggatatgtgtgttcgacggatgatccaacaaatccgacaattttgtattttatcgatgaacctgttgcccataaattacattcagcaggtcgtttggatattgataccacaggtttggttttgctgacagatgatgggcaatggtcacatcgtattacatcacccaaacatcattgtgaaaaaacctatcttgttacattggaatatccaatatcagacgataccgagatgaaatttcttgcaggtgtgcagttgaatggcgaaaaaacactgacaaaaccagcgaaattagaaattattgagcctcaccgtgtacgtttgagtatccgtgaaggacgatatcaccaagtgaaacggatgttcgctgcagtgggtaatcatgttgttgagcttcatcgtgaacgagttggtcaaatttatttggactctacattggagccaggagaatatcgagcattgaccaaacatgaaattaacagcatacaggtgccaacaccttaaccctcttttatctatctatttaacaagttgttacgggagttaaagcgtgcaacaacaacgattatcctatttgggattagtcttgatccttggtttgctttctatgttgatgccattggcaattgatatgtatttgccaagtatgccaacgattgccaccaattttggcgtcgatgccggtcgagtacaaatgacgctgagtagttacattttgggttttgccattgggcagatggtttatgggccaatgtcagatagtctgggacgtaagccagtcattgtaggtggtgtaattgtttttgccattgcttctgctgcgtgtgctttgtcacaagatattgatacctttatttctatgcgctttctgcacgggttttctgcagcagcagcaagtgttgtgatcaacgccttgatgcgagatatgttcacgaaagatgaattttcccgcagtatgtcttttgtgacattggtgatgatcattgcgccgttgttggctcccatgttaggtgggttgatgatggtatggttcaattggcatgctattttttggtcaatttcgattgctggagtgataaccgcgtttcttgttgctttctttatccgggaaacattaccgaaagagagaaggcagcgattcaatttaaaaactatttttaaccaatttgctatgttatttcggcagcgtcaggtgctgttttacatcttggcaagtgggttttcttttgcaggcatgttttcttttcttagtgccggtgcatttgtttacattgacttgaacggggtttctgcacaacattttggttactattttgggttgaacattatttttctgttcattatgaccatgattaatagtcaatgtgtccgcaaatatggtgcatcgaaaatgctgcatttcggcgtgtttgtgcaatttgtcatgggtttatggttattatttagcactgtacttgatttagggtttatttctcttgtaatgggtgttgcaatttatatcagtggtatttccatgatcacttctaatgctatggctgttgtgctggacgattatcctcatatggctggaacggttgcgtcactggctggaactattcgtttcagtattgctgcgctggtgggcacaattttatcttcagtatctgcaaaaagcgcatggcctatggtgggctcaatggcattatgcgtaatattggcaatgttacttattatttatgcgaataaggccaaaaaataaaataatcagaggggctaccagatagcataaggtagcctctgttttttaattcatatattgcttccttacgcttgccgtactgactatcgctacattaagaaatcatagaattttcccaatatttttttatcctgtcctgatagtagctgcatttagaggtaattccccaagatcttgaaatagcaaaagaagctattgatttttggatagataggaaatgccgagcaataagcagacaaatgtagaaatttgttaatttgatgatgctaatcaatgttgggttgttggttttttgttaactttgtgctattaaattcatgactatagattaaaataattttgttgttaattaactgattataatataaaaatattatttccctagtatgtggtatggcttattacacataaatatgtaaatgaaaagttgcttatttgcataaaaataagttgaattttttacctaaacagtataaatatatacaaaatgagagtttgatctcacttttttaaaatggaagatgaaaaacgtgtgataaatcggattttattttaactttttatttacttttttgtttgctttttgttggggggttattcggttttgacgaatcgatagcctacagctggtggttagatgtattaatgttgtttctgataggaataatacgtggataatatccaactttcggtagtacatagactgccgcaaagttatcggtggtcatctggcttcgttggtacgaaagttgaaattttaccaacagaagaaacagatatagaaaatagcctgatggggctgaaattgttaagccatgaaggtgaaaatgcttgggttattttgcataatttgaatcaatctattgctgatatgcaaatattgagcgcagtaattgagtgggaaagtgagccatgtttattttttgctaaagaggatgagagtgcagtgatatgtcgactcaagacattaggtgctgcgattgcagaaaacataacggcgttgtacccgctttagtggataacaattggataaaaaaacgcttccaaagggaagcgtttttttatgtctgcaagggaattaagtatagtcaggagactttgttcacgtctcgcagaattcgtcttgcgccgtagtaccgtttagtccagtaggtatcggttaatttggaaacgatcactccattactggtcgaggcatgtacaaattggttattgccgatgtaaataccgacatggcgcatgtaaatgcctgttttgaacagaactaaatcacctgcccgtaatttagaacggctgacggtttgaccaattttttgctgctctgatgtagaacgcggtaaatctatatcgaattgatcatggaaagtacgttggacaaaagcagagcaatcaataccgcgctttgtactcccaccaagccgataggcaacacctttccagtctgcatattggttaaggattttggatttagtatccaaatttttaactagagtttcaaactcatcctgagacgcttgcagtaagaagtgcttttggctgtttactgcatgagtatcagcttttttgctacgcatttgggagtctggcgaactacatgcggttagtaccactgccgcgagaattgcgggtatcaaccgcaatatgtatctcagtattggttgagacttgaccattatattgattttcccttgcagcccttaacgtggcttatcgccatcatggaaacactaaacgttctaaagcgtagtcagaagatgatgaattaacaaattttctgtccctaaagtgtgcgaaccaacacattttattaatatctttacaaagcgcattattttaatcatagggagcagagaagggtacagaaatgataagtaaaaagcgagatacaaaaagcgttctttacaaaaaattagattaggaactaaggggttagaatgattgttgctattttatacttgtttggtaaaaattgtgtagttttgaggagataagcaatatctcctcatcattactattttaactagtacgcctaatatacggtaattttttatccagccatgttgccataatatcacttaagggtgttagtaatacccagctcattccaattaatgtcagggataatgaaccgatagcaatatctgtaaaccaatgagcacctgccataatgcgtgggagggtaaaggtgatcataatgagcagggcaatgaaaaatgcgccgcgagagacatagcgaagaataaaacaactaaaaatcaatagcattaatccatgatcaccagggaaactgtctttggaagcatcttttgtatgccaactgatcatgtcgtccacgcgattaacattttcgaatgttaatgttgggcttgggcggctgacgggaattttgtggcctatttggttaataatgacagcagtgactagcattaccagccctatcatgaaaagacggcgtttacccgcatagctctgtttgcgaaatgcgctgtaatagagcaagcccatacacagaagcgatataacatcaaatgccctgatattcacgatggcgacaaacagtgcaaatctggaatttggaagcagtttttcattaaagaaatgaaaaatggctgcatcaatgttaaaccaaaaaccgtgattctcaggcaaataccatgagaaaaatagggcaataccgaacatgttaagtataaatattgataatggattactgcgggtcatgagatacctatttaaaacgaaagtaaattttggtggtagtcaaattaactggggggagcactatagcaaaatttatggcaaagagtaatcgctctggcatgttgttgctaagacatggagatatcagcatatttataccatttatggactggcgtaactattattagtatgcgaattattttgtaatatcggaaaaatagctaaatccccacttcagtaccgataatatatatttgtctcaattttgagcactgactattattaaataaccacaaattgctttccccatatcctaacttgttagaatattatgttgaaatgtagtctttataaataaaaatcataaagaaattgtttcattttctgttatatcgttatatagatagcagagcgttgtaccattatctggttttctaacttagcgtggggctaaagctgaaaaaagataataatacttgtagtggaggttaaatgcttatgttacgaaaaacgacgacttttttgtttatatctttgtcttatcctgtaatggcgcatgatccgccaccctcaagttctgagtttcttcaatttcatggcgctattgttgagcctccatgtcagtttaattggggtaaaaaacgtactgaagtagcctattggcacaatggcgaacagattaatcaagataaaaaattagaatgtcaaaaagatagttattatccattatcaaagcatattagaatagaaaaaataaggtggatagaagaaaacaaaaagtcagggattgttactatcacttatcactaaaaattatataatacctttttaatcatattgtttatttgatttataaatataattattaattgtaaatttttttataattttgtttaaataatggttattaataaccgttttgtaaatgatttaataaaaacagtatctttttttgagctgaaaattcatttttgatatgaatcaataaaatgtgtcaatgttgtatttttttcatgtgaaataattatgatggagatgaaggaataaaggtaactgagttttagttaatggaaaaacgaaagtgaggtaaccatgcaaaattatcttaagttgttaattagctgtttgttggtttcatggatgtcttatggatatgcgcaatctacaggagggaaaattcagttttcaggttctattgttgacccaggatgtcaagttgtcgtatcgaatactcaggccaatatctcttgctatcggttggggaaaaaccttactgtaaagcaaattatttcaactcagaaaacaaccggcgaggtcatgcttcctggcaatataggtgtttccagtgtgaagtggactgatagccaaaaacgtgtggcgatcattaatgtggattacttctgattttaataggtgatgaattgctcttttcatcgaaagggaaagagcaattcatattttaaggatatagaattaatcacaacgtcccatataacgacgttctgcaatatgaatgcggattttttcgtctgaactcagatattcaggcacctgaatagtgagccctgtactcattttagcgggttttgtacgagcacttgctgatgctcctttaatactcggcgtggtttcttcgatgatcatatcaacagtttgtggtaattcgagagccagtaattgcccatccattgtcaaaacgtgcattcccggcaaaccttcttcaggaataaacagtaattcttcttcgatttgattttttttaaagtgataaggggtgaaatcttcatcatccatgaagatatattcatcaccatcaatataggaaaaactgacgctgcagcgggtcaatgtgatggtttcgaggatatcatcacctttgaaacgttcttccactttctgacccgttctaacatcagtaaagcgcatcttatacagtgtgctggcaccacgcgcactgggtgtttgaatatcgatgtctttaactaataatagtttgccattgtgactgattgcagttccgcgcttaatttcattggctttagccatagataccttccgtaaaaacaaggaaataatggaatgaatgttgaagtggcgacaaaattactcgcagtcagcacattaggcaagaaatgatatgaaaaccccagtgaaaatactggggcatggggatatatcaatgataagcaggtaacacatcaaatagggagagaacatgagctgtagcatttatcagtccgaacagaatgataaaggcaatcaggaaactaccgccgggagcctgatagctggcatttggatagcgcatacggctagcacgagccatcagggctggaacgatgaccgcccaaattgttgccgccagtcctgcaaaaccgatcgcatataggaagccgtttggaaagattaacgccagtaccgttggcggaatgaatgtcaccagtgcggttttaaaacgaccttctccactgtcgtcgaatccaaaaaaatcagccagatagtcaaatagacccagagatacacccaagaatgaactcgccaatgccatatatgagaaagcatttaagagttgggctatggtagtattgttggacgtattatccatctgttgcagtaaattagcgatattacccccatcggcgatgatctgcttgaaggcttcacggggaatatttccctgaatcacatactgccacaaaatgtagatgaccaaagcaattaatgtgccgtagaacaggctgagtgcaacagctttactgtccttatggtaatatttcaccagacctgggatatttccgtgatagccaaatgaggccagcaaataaggtagcgccatgaaagtatatggtaaatagctggtttcagtattggcttgatcaaataagacagttaatttgacttcggtaaacatgcttccaactgacataataaatgttattaccatgccgcctatcaaaatggtacttaagcgatcaactgctttggtggacatccagacaataaaggcaacgatcagcgcgaacagcaacccagttcccgattgaggcaggggaaggaaatgcgtaaaattatgaaacaaaaccgagctgccggctgaaacataagcataggtcaggatatacaaaacgaaggcgatagataggccattgagtgtactccagcctttacccagtaaatctttagtaacagtatggaaactagagccagacggataattaagattagcttccagaatcattaagccagagaagtacatacatgcccaagtatataccagcaaaattattgatcctgtaaaccatacacctgaagtagcaataggaatggaaaacatacctgcaccgacggcagtgccggcaatgatcattgtgcctccaagtatggagggacgttttaaattttgcgttacctcaatggtcatgtagactcctaattaatagtactaccttgtactagcttgacgatacgttaatgaatgatatgtgtaaacaaatatttatggatgataagtaaattccttttgttgtatttttcatacaaatgtgggatcaggttatatgaaataacccgcctgaaaagcacttgagaagatgggttgttttaagcgataagatagaatttttccatttgccatagcttgatggcattgcggctggcttcaaagtggggttctggtagctgatgaggatcacaccagattaactgctcacatttttcaggttccattagttgtggctcacctccagggtgatgtgccaataaacagacagaaactgtatgttttccttcttcatggtaggtttcgagattattgcagacaccatagactttaggatcttgaatcgttaatccagtttcttcctgaatttctcggatggcacattcttcaaaagtttcacctggatcgacgtgcccaccaaagattgaccaatagggtgcgtgctggctggtgcgttttcccagcaggacttcacctttatcattaataatgatgacaccaactccgacaacaactgacactgtatattcctccggctggaatttatccatgatgatgaagatagattttaaattatctgtagtggttttattttcgtcatctgacaagcaatcttctctcggcatatttttacttttagatcgagataacacaacgatcaatcaagtggtaattttaactgaaacgattcaattttgatgttataaataacagagaaatcttaatattacttatgattgtttactcaggagacaccgggcaagatgagtcgtcgagttgccacaattaccttaaatccagcttatgatttagttggtttatgcccaaatattaccaagggaactgttaatcgcgtacagaccgcaggattgcatgctgcgggtaaagggaacaatgttgcgaaggtgctgcgtgatttgggcattgatgtcacggtcagcggttttctgggacgagaaaatcaggaaggatttcaaaagttctttggtaaaaacaatatgataagccgatttcatttggtctcaggccgaacgcgtatcaatgtgaaattgacagaaaaatacggtgaagtgacggatttcaatttttcaggtttccatgtgacagcagaagagtggaattattttgtcagtgattctctcgactggctggggcagttcgatatggtggtagtcagtggtagtttgccagagggcgttttaccggaatcatttgcggattggatgctgcaattgaaacaacgttgcccctgtataatttttgacagcagccgggaagcctttgttgctggtctggaggcgtcaccgtggctggtaaaacctaatcgtgatgagttggaaatttgggctggtaagccattgcctgacctagatagcgtgattaatgccgcccatgaattgcgtaatagagggattgcccatgtcgtcatttcattgggagaacaaggggcgttatgggtcaatgcctcaggcgcatggctggcaaaaccaccgtattgtgaaattgtcagtactgttggggctggggactcgatggtaggagggttagtttacggcttattaatgcgtgaaaccagtgaacacactttgcgtctggcaaccgcagtttctgcacttacggtcagccagccgaatgtagggatcaagagccgcacggaacttgcatcaatgatgtcaaagattgagctgacttctttcaggtaatcaattctgttgggatttcagccaagcaatttcctgatcccagatgcctggattgatcgtttcaagaaccaatggaatgccattgaaacggtcatctttcataatgtagctgaacggtgtattgccaatattgccttctccaaggctatgatggcgatcaacacgactggaaaattcgctcttggcgtcgttgagatgcatagctcgcaggtacttaaacccaacaattttatcgaatgcctcgaaagttgcttcgcagtctttttccgtgcgtaagtcataacctgctgcaaaagcatggcaggtatcaatacagacaccaacacggtttttatcttcaacaccttcaataatggctgcaagttgttcaaatttaaagcctagattggttccctgaccggccgtgttttcaatgacagcggttacaccctgtgttttgtccagcacgatattgatagactcggcaattcgggcgagacatttatcaatatcgatttttttgagatgacttcctggatggaagttaagtaaatcaatgtctagttgttcacaacgctgcatttcatcaaaaaaggcggcgcgggatttttccagcgcttctgcttcgggatgaccaaggttgatcaggtaactgtcgtggggaagaatttgttggctgccatagccataacgttcacaattggctatgaacttatcaatgacatctgccgataatggtggggcatgccattggcgctgatttttcgtgaataaggcgaaggcggttgcctgtaactcatgcgctcggatcaccgcctgatcaacaccaccagcagcgctcacatgggctccaacaaatttcatattttttcctcttctaattttgtttcactattatggcattgttcatcctgccaaaaaaatctctgtcaaaaacagagaatacaatttaacgcttgttctcacttaacccaatatccgttggattccttgattgacaactaatcctccagctataagccagataaacaggaagaatgccagcagaatcggtttaactccagcctgacgaatggcgctgacatgagtcgttaaacctaatgcaaccattgccattgctagcatgatggtatcggcggtaataatatgtttgataagggagccaggtaataaatgaaaagagtttagtcctgccgtagcaatgaaaaatatagcaaaccacggaatactgactggggattttttttgatcttgatcactgccaaagtttttagcctctatccgactaatataaccagagagcagtagtagaaagggagctaacatcatgacacggatcattttgctgataacggctgcattctcggcattgttgcctaatgtatgcccaacagcaatgacttgagcgacttcgtgaatcgttgaaccagagaagatgccgaatgtttcttgagagaaaggaagccattggtaatgggcattgagctggtaaaaccatggatagataaatattgcgagcgttccgaaaattaccacggtagaaactgcaacggccactttactggcagatgccttgaccactggctcggttgccatgatggctgcggctccacaaatactgcttcctgcaccaatcaatactgcggtttggctatccaaccccaaaaaggtacgtccaagccataaggcaatgaaaaaggtggaagaaagcataatggcatcaatcagtaaccctgttgtaccaatatctgcgatttgttgaaacgttagacgaaagccgtaaaggatgataccagcgcgcaaaaggtagtatttagcgaaatgaacccctttatcacatgtgggcttcaaaagaggataaagcgtatttccgacaataatccctaaaagaattgcaagtgtcagggcacttaatcccatattgataaaacacggcatgttgcctacatggatagcgattgcggtcagaactgcggttagtacgaatccgggaattaatatcagtactggattgtgctggaacctgtcgattctgccaagttgactttcagacattattgctactcatattgcttatgtattttgagaataagcatatgccaagctttttaatcaataaaattgataatatttatatatataaccattaaaatggattaattaagtgtgacttttgttaagttgcttaatactgtctagaatcaagactatcttaaacttttatttttgcttcccgcgaggccatatgcgtatcactctgagacaactggaaatttttgcagaagttctgaaaagtggttcaacgacacaggcttctcagcatttagcgttatcacaatctgcggtgagcgcttcactgacggatctcgaagggcaattgggtgtacagctttttgatagagtgggaaagcgattagtgactaatgaacatggccgtttgctgtatcccaaagcattagcattacttgaacaggttggtgaagtagaacagctttttaaactggaattaggagcgctgcggttagcggccagcagcaccattggcaattacatgttacctgaaatgttgtcgaattatcgtcaggactatcctgatacaccattggaattgaatatcagtaatactgaagatgtcataaaggcggttgtcgaatttcgcgtcgatttaggattgattgaaggcttatgtcacaatcctgaattgattactcaaccgtggatggaagatgaattgattatcttctgctcaccgaaaaattcactttcacagcgtgactttactgtggaagatttgattaaagagccttggatactgagagagaaaggttcaggcacaagggaagtgctagatcaccttttattctcgaaaatgcctcgattcaatattgcaatggaattgggaaattcggaagcgattaaacatgcagttcaatatggtatgggtatcagttgcctttcgcgacgggtcgtccaagagcaattgaaaaatggcacattagttgagttggtgatccctgaactgaatctttatcgtacactctatctgatttatcaccgtcagaaacatatgtccaatgcactacaaaaattgttgagctattgtaaataataacaatccagtatacctacatggaactagtaatacgaaaataatcgtgtagcttataatcggcggtcaattatgaaggtatcttataatcgctaatagccgctattctcgagacggggatttgttacaatttcacattagaactactttcaatgatatagggatagaatgtctcaagaacaaagcacactaggggagcagcctccaagaaccctgcgccgtgaattaaaagcgcggcatatggcgatgattgccattggagggtcaattggcacagggttatttgttgcttccggcgcaacaatttcacaggctggtcctggtggagccttactttcctatgcattaattggtctgatggtttatttcctgatgaccagcttgggcgaattggcagcttatatgccagtttcgggttcattttcaacctatggatccaaatatgttgatgaaggttttggcttcgcgttggggtggaactactggtataactgggccgttacgatagctgttgaccttgtggcagcacagttggtcatggggtactggttcaatgatgtgccaggttgggtatggagtgcgttgttccttggcataatttttctgctgaactttatttctgttaaaggttttggtgaagctgaatactggttttccctgattaaagtttctacgattattgtcttcattattgttggcatcttgatgatcatcggtatcatgaaaggggctgaaagtgccggctggcaaaattggcaagtgggtgatgcgccatttgccggtgggtttgctgccatgattggggtagcgatgattgtcggtttctcatttcagggaaccgaactgattggtattacagcaggagaatcaaaagatccggcgaaaaacattccacgagctgtacgcaaagtattttggcggatcctgttattctatgtttttgccattttgattattagtttgatcattccttatactgaccccaacttattgcgtaatggtgtgaaagatatcagtgtcagcccgttcacgctggtatttgaaaatgcggggttgttgtctgcggctgcgatgatgaacgcagtgatattgacggctgtgctttcagcaggaaattcgggtatgtatgcttctactcgcatgttgttcacgttggcgagggaaggtaaggcccccaaaatttttggtcatttatcaaaaggaggcgttccacgtaacgcactttacgcgactaccgtggttgcagggttgtgttttttcagctcaatgttcggcaaccagacagtatatctgtggctattgaatacctcaggtatgacagggtttattgcgtggctagggattgcaatcagccactaccgtttccgtaaaggctatatcgcacaaggacgggacttgaatgagctaccctatcgctcaggttttttccctgtcgggccgatttttgcgtttgtgttgtgtttgatgatcacattgggccagaactatcaggcgtttttgcaagataatatcgattggtacggtgtaactgcgacttacatcggtattccggtattcttgattatctggttcagctacaaactgaaaaagaaaactcggtttgttaaatgtagtgagatggaatttccatcattaaaatttacaggtaatgaataatttgttaataaacatcaataaattgatatttattaattaacttattattatttatatattacaaaaaaccgcttcttctgtgatgaaattggcggtttttatttttcatggtattacgggaagaatatagtcagtaaattgtagcgatcctgaattaatcgcattgataagtattcttatttgctttattgttagcgccataattgttgtatgaagaggctaactaaagtgaagtttgtatttcgagcagtcgtgaagggtatgaatatcagtctactggcaagctccgctatgatggcgagttttgcatcttgggctgaaacagtcacggatgttgctgggcgtactgttgaggtgcctgaaaaagtcaatcgtattttgttgggagaagggcgtttattccattcccttgcactattggaaggagacaagcctttagcgcgtatcgttggctggcaaggtgatttccgtaaactggatccacaaacttactctatttataaagctaaattccctgagattgataatattcccctgataggtaacaccagtgctgacagtgtcagttctgaaaaagtgctgacgcttaatcctgatgtcgctattttcggcttatctgggcatgggccaggaaaaaacagtgagctggttaaacagttggaaaaagcaggtattcctgttgtttttgtcgatttccgcaacgaccctttgaaaaacacattaccgagcatccgcatgctgggtaaaatgctgcatcgtgaagagcaagctaacgcttacgctgatttttatgaaaagaatcaaaaattagttaccgatattactgaccaaatagcggaagctcagaaaccttcagtctttattgagttgctagcgggtttcagcggcgattgctgtggtacggcaggtaatggcaatatggggaatttcattgacttggctggaggcaaaaacatagccaaagatgtattgccgtcaccgttggggatgatgaatctggaaaaagtgattgtcgcagatccttatatttatattgcgagtggtgcacaggatccgggtgataaagatgggggtgttcaaatgggtgcccaaacttctgcggatattgcccgcgctggactgaaaactatcactgtacgtaaaggtatcaatactttgaccgcagtgaaagaagggcgtagttacggtatctggcatcattactacaattcaccttataacgttgtggtaactcaggtctttgctaaatggttctaccctgaaaaatttgctgacctagatccacagcaaacattgaaagaacttcataataaattcttggctgttgaaccagcaggcacgtattggatcagtgagaagtaagcagtaaacgggtaataaaaatgagtatcactaccaaacctatgccaatggtaaaacaacaattgagtgagtgcgatgtaaaagcacgctatcgtcatattttgcatcgacgtattacattgatatttaccattattttggtgattggtgcctctttgatattggattttacaatggggccatcaggattatcactgcaagccctttggcagacactaatttcgccggaaagtgttgatgtaggaacgcgggtaatcgtttgggatatccgattaccctatgccttgatggcggtagtcatcggcttgtcgcttgggttggcaggcgctgaaatgcagactgtcctgaataacccactggccagtccatttaccttgggcgtttccaatgccgcctcatttggcgcagcactggccatcgtgcttggcattggcattccgggaataccggatcaatggctcatctctgcaaacgcttttatcttcgctttattggctgctttgatgcttgatagtattacacgctggacaagagtggcaacgtctggcgttgtgttgtttggcattgcgatggtgtttaccttcgaagcgctggtttctatgatgcagtttatcgctacagaagacactttacaggggctggttttttggacgatgggtagccttgcaagggctacatgggaaaagctcggcattatgttgctggtatttctcattattatgcctatctcaatgatgaactcttggaagctgacagcattgcgtttaggtgaagatcgtgcagccagttttggtatcaacatcagtcgtcttcgtctgggaacattgctgcgcatcagtattctaaccgctctggcggtagcgtttgtcgggccgattgcgtttatcgggctgatcgcccctcatattgccagaatgatgttcggtgaggatcaccgtttctacttacctgcgagcgcgttgattggtgcattagtgttatcgatggcgtctattgcatccaaaaacctgatccccggaattatcataccggtgggcatcgtcacatcgctgattggtgttccgttcttcctgagcattattttacgccataagggaagtatatgaatcagggactgaaaatcaaccgactcacggccgggtatcctaagcatccggtgattgaaaatctggatgtcaagtcattgcctcgtggtcaaatcacggtattgctggggcctaatggcagtggaaagtccacacttcttcgttcattggcggggcttaataaagctagaggtgaattgttgctcaatgggcaggatttgatgcagatgaatttcgctcaacgcgctcagggtgtagtttacctgcctcagtcattgccggagggggttcatctccatgtactggaatccgtgattgttgcccagcgagcatcaggtggtgtaagcagcaaacaatgtgaaaatgaagtcatggaactgttacgtcagcttggcattgaacatctagcgctcagctatctggatcaattatcaggtggacagaaacagttagtgggattggctcaatcattaatcaggcagccgacactgttattattggatgagccattaagtgcgctggatttaaattaccagtaccatgtcatggatttagtggcacgtgaaactcgtcgtcgcaatattattacggttgttgttgttcacgatattaatattgcattgcgtcatggtgaccatgtattaatgctgaaaaaaggcgagttaattgccgaaggtacacctgaacaggtgattacaccagatagtctggcgcaggtttatggtgttaaaggccgcattgagcgttgctctcagggagtgcctcaggtattaattgatggtttagtgacggaattggctaattagaataataaagagaaatagatagttttattaaaactaaagcttaataaatataacactgacagggataaataattatccctgtactttgagcgtatatcgattatccatattaattattaaataattttattctgccttttggagaactgggaatggctgtttttgtaaaaagaaaaatcgtattgggaattattgccgctatttcatccagcgctgttttagctgccaataatggtgatgacaaaattgttgtaactaccgcagcgggcttccagcaaaagattgaagatgcacccgcttctatttcggtagttagccgtgaacagttagaaacgaaatcttatcgtgatatcacggatgcactgaaagatgtaccaggggtagttgtgactggtggtggtagtagtagtgacatcagtattcgtggtatggcttcaaaatatactatgattctgattgatggtaagcgtgttgatactcgcagtacccgcccaaatagtgatggttctggtatcgaacagggatggttgccaccattagcatcaattgaacgtatcgaagtcgtgcgtgggccgatgtcttctctttatggttctgatgctatgggcggcgtaatcaatattattacccgtaaggtacagaaagagtggcataccagcctgcgtgcagatactactctgaccgaacgtaaaaattcaggtaatagctaccaaaccagcgcttatgctgcggggccattaattgatggtttgttaggattgaaagtcaatggcctgttttctcatcgtaatgaagataagtttattggtggctttagagagcaggaaatgcgtaatggtgcagcaacgttctctttgacacctgatgaacagaatactttcgaatttgaggctgggcgttatgagcaggatcgagactcaaccattggtaaaactcgtgattgccagccaaaatcttgtaaagatgacgtgagccgctataaacgtaataactattcgatttcccataatggcgtttatgacttcggtacaatgacttcttatgttcagagggatgaatcgcataaccctgagcgtgaaatgaaatataacgatacgttatttaataaccaaactacgtttatattagatgatcatacgttaagtgtaggaggacagtatcgctatgaagatttacgagatactggtaataaattaaattcagcaaaagatgttaataaattaacacgttggagttgggcattatttgcggaagatgaatggcaaatgaccaatgattttgctctgacgggtggtgctcgtttaaataaagacgaaaactttggagcacattggacgcctcgtttgtatggtgtatggcacgcagatgaacagtggacgatcaaaggtggtgtttctactggttaccgttcacctgaattgcggcaggttgcccctaattggggacagacaacgggtggtagatcccttaatggaatgattatagggaactcggatcttaagccagagaaaagtgttagtgaagaaattagtgttatttggaataaccaagataactttaacgtcggtgtaacagtctttaatacagattttaaagacaagatcactgaggttggagtgtgtgataaagatactgaaaatccatgtaaaccaacaggtgatattacttatgattttatcaaccagcgtacaaacttggataaagcgaacatccgtggaatagaagccaccctgaattgggatatcgtagaaaacttgtccttagcctcaagttatacttataccgagtcggagcagaaaagcggtaagtataaaggtcaggcattgaataaaatgccaaaacatatggccaactctaccttgaattggcaggtactaccagaaatggctacgtggactcgcattaatttcagaagtaaatcaacaaattatgtatatcgctctggtgtgaagaatggtacaccatcttacactttcgttgatttaggcatgacctataacttgacgaaaaacttgcgtgtattaggtggtatctacaacgtctttgacaagcgcgttactgagaaaacccacgatgcggtactagatggccgtcgttataacatcggcattaattatgatttttaattaatacttcggttttttattagtcattttaattaacatttaaatgtaatattaaatcaacctttcatcagttctatgatgaaaggttgagctttttgatgtcataattaccacaattaaatagcaaatagcttccttctgtgctaaaaatttattaaatgtcaaacaagggataggatagcgttaagtttccttacaggttcagtgaaagcctattccatcaggctctccggtattgtaaaaaataatgaatttttagtgtgatagctcttgctatttctaggtgtgaaatgcaaaatgcgtgcactaaaaaatagctggtgtgtaaatatacaccagttatttttttgctttgagttattttttacaacaccaagaggccggattttgttccggatcgatactgaccataagcggccattataagaacgggctgctgcactgaggaatacaaacatggagcaattattcacttttgcactcgtgccaattggcgcttgctgctgcaacgatgattatggggcatggcccaccgtcagttcgctgtcttctaataactcttctttcttttctgtctatagacagatgcgaagtctacccactaactatcgattaagtagttgcattagtacccagatcgaagttatgggaggtttcgctcatgtcgcataataccactctcacacttgacactaaccaaaccagtgccagcgatcgtgttcaactaagaagaacactgaccctgtttcaggtggtcatgatggggcttgcctacatgcagccaatgactatctttgacactttcggcattgtttccggattaaccagcggacatgttgcaacatcttatgctctcgcgctgatcgccattttatttacagcattgagttacgggaaattggtaaaacgcttcccatcagcaggatctgcctatacttacgtacaaaaatcaataaatccccatcttgggtttatggtaggttggtcatcattgctggattatctgcttatgccgatgatcaatattctgctggcaaaaatttatcttcaggctcttttcccaggcattgacccatggattttcgtagtcacgttgacaatactgatgacgattttcaacctgagcggcattaatgtagtcgcgaatctcaatggtgttattgtgattgttcaggttgccgttatgttggtactcgtcggtttcttggttcatggtgtctataatggcgaaggcgttggaacattactgagtattcaaccgttcacgtcagatgaagcgaagttgattccaatgatcacaggagcgacgatactctgcttctcattcctcgggtttgatggtatcagttccctgtcagaagaaacacctaatgctggaaaagtgatccctaaggcgatcttcatgactgcattaattggtggagctatctttattgcagtatcttattttttacagctttatttccctgatatttctcgatttaaaaacccagacgcctctcagccagaaattatgctgtatgttgctggtgcgctgttccagtacattattcttatgttctcctgtgttacggtagtggcttcagggatggcagcacatgcaggtgtatcccgtttgctctatgtgatggggcgtgatggtgtactgcctgaaaaagtatttgcttatattcacccaaaatggcgtaccccatcaattaatgtcatattggttgggattgttgctctgtcagcgggttggctggatttggtaacagcaaccgcattgataaacttcggggcgttagtcgcatttacttttgttaatctgtcagtgatttcgcagttctatattcgtgaacagcgtaacagcacactgaaagatacgattcactttttgattctgccggttcttggtgcagcgacagtaggtgtgttgtggatgaatctggagtcaagttcgatgaaattaggtctaatttggggaggaatcggtatgatctatatgttcttcctgacccgtagtttccgtcagccaatgcctcagtttactgaatcagtgtaatctttattcgcatacttatttataaaacagcatcttcgggtgctgtttttaattaaaataaaaaatatcaatagcataaaaatcaccaaaaggcgtcatataataaatactcactatgccatgcgtgatctcattaagagcctatatatctaacgctaagtagaggtaatagaaccattatgaatgatgctaaaatccctcacaaccagcaacttattgcaattctcactaatattgttggatctccccacattctcactgaatctcgaaaaacagaacgttatcgcaaaggctttcgctctggacagggaaatgcccttgctgttgtatttccggcttcattattagagcaatggaaagtgttcaaagcctgcgttttagccgacaaaattattttaatgcaggcagctaataccggattgacggaaggttccacacccaacggtgatgattatgaccgcgatattgttattatcagtacactgcggatggataaaattcaggttcttacatcagtcaatcaggtcattgcatttcctggcagtacattgtggcatttggaaaaagtcttgaaaccgttaggtcgtgagcctcattctgttattggttcttcctgcattggtgcgtcagttgttggagggatctgcaataactctggcggctctttggtacagcggggtccagcctatacagaaatggcgttgtatggacgtgtgaatgagaagggacaagctgaactgattaatcatttgggtatatggttaggagatacgccagaagatattctgacttgcctggaagaacagcgctatcgagctgaggatattcagctggatgaccgagttgcttctgatcatgagtatgcacagcgtgttcgagatatcaatgcagagaccccatcacgttttaatgccgatgagcgtcggttgtttgaagcttctggttgtgctggtaaattagttgtttttgctgtccgtttggatacttttcctgcacagtcgacttctcaagttttctatatcggcaccaaccaacctgaagtattgacagaattacgccggcatatattggctaatttccagcatttaccgattgctggcgaatatatgcatcgggatatttttgatatcgctgaagtgtatggcaaagacacctttgtcatgattgataaacttggtacggataaaatgccaatgtttttcagcctgaaaggacgtatggatgccatgtttggcaaaattccttttttgccatcacacctgacagatcgcgtaatacagggcttgaaccgtttattaccttcacatctgcccacacgtttgaaagagtaccgaaatcgcttcgaacatcacttgatgttgaaaatgtctggtgaaggcataaaagaagctagtgagtggttggaaagctactttaaacaggcagagggagaatttttcgcctgtacgccagaagagggtacaaaggcatttttacaccgtttcgcagcggcaggagcggccattcggtatcaagctattcatagcaatgaagttgaggatattttagcattggatattgccctgcgccgcaatgaccacgaatggtttgagcatctaccgccagaaattgatggagcattggtgcatcgtctgtattacggacattttatgtgccacgtattccatcaggattacattgttaaaaaaggcatagatgttcatgcgctgaaagtaaaaatgctgaagatcctgaaccaacgaggagcggaatatcctgctgaacataacgttggtcatttatatcaggctaaaccgcagcttaaacagttttatcagatgactgatcccactaatactttgaatccgggtattggcaaaacctccaagctgaaaaattggggaagataagatggaaagtgtgattgtcggctttccggccatcgacatggttaaaccataattatgctggaatgaggataaaaaagacaaaacagagaattttgtctttttctttttctgaaataagccagtatgatgcggggccgttagccagccagctgaactgcataatcaactagtgcttttaactggcggcacttttcttcatcagattggtattcaacaaagagctgttcaatggccgcaagatattggctgatattttcctgtgtcaatatctcccggcgatgatatagccagcgctgttgttcatcataattcagcgttgccggatagtttctggcgcggtaacggaacaggagtgttttaatccgtggatcctgaaatgttaaatccagtgccggtaagtttttgggtgcagtttcccggataatttccatcgcagttttatcggcatcactgaaaaaaccgctatatagcttggtatcgacattgtcggactcagggaattcctctggttgagaaaatagctcaaccactttttccctgatttgcggattactgcgcaatatagccagattttttgcacattgatcgcgattcaatcccactcgttccgcatcttctgtccgtagtgtattttcaggagcaataatcgggcatttattgatatgcatcaatttaatgggtactggagcttggcctggctgtagttcattacgtcgggtatacaagcgctcgcgcaattcgtctgcgctgagttctagtaacggggaaatatcacccgctaaatcacacatgatgaccgcattgcgatttgtcgggtgccatgccaaaggtgctataaggctgatattgctgcgcagagttccgaacattcctgatacatgtaccagtggcttcatctgcggaatatcaatctggttactgaccttctgtttgtttcttaattggaaaaagtaatcaaacaagcgaggttgggctttttttacccgttttgccatcgcgatagtggcataaacatcggacatagcatcatgagcctgagtatgttcaactccgttggctttcgtcaggttttctagcttaaaactgggcagaccatcctcattttctggccagataatgccttctgggcgtagggcatagcaggcacgtaatacatcaagcagatcccagcgggaattacctttttgccagctataggcataaggatcgtaaaaattgcgataaaagatatttcggctgacttcgtcatcaaaacgaatattgttatacccgataatacaggtattgggcttgctgaatgcttcatggatctggcgggcaaattcagcttcattgacccctttttttaatgctaactgtggtgtaatccccgtaatcatcacagcttcaggatcgggcaggtaatcgtcagcaggcaaacagtacaccaccaaaggatcttcgatgatattaaaatcactgtcggtgcgaattcccgcaaactgggcagggcggtctaaggcagggtgcttgccgaaggtttcataatcatgaacatagaaagtgggggttttatcgttactcaaggcaattctgcatccgttggttattggtttaattaatttaatttcaatgtattatcttatttttgtgtattgatcgtgttgatataagttttattgcacggcttagtttatgacaaattgtgtactaaatctttggtttctacgaggctaaacgatgcgaaaagatatggtaaaccatatcttggacaatctgaactctctaatgatatagggtgaaaattgttgattatcatttcgcatgtggagaaaaatctcttttcggataggaactgaaacctcttatggcagcggaaactcttggtcatcagatgctgggacgatgaaaatgattgattaaggaatatacttaaagtttatcatgtcaataaattgtcgaaactgacttgtctattcgttacctgaaattgtattgtgtagtcagcataaaaattatcggtctgattaaaaaaggtgtaaaaatggacaacgcaaataaaccaacattccataatgtactggagtttgtgcgtatatttcgccgcaagaataaattacagcgcgaaatagtagacaacgagaagaaagttcgagataaccaaaagcgtgtattattgctggataacctgagcgattacattaaaccgggaatgtcagttgaagatattcaaggaattatcgctcatatgcgcagtgattatgaagaacgtgttgatgaatatatcatcaaaaatgcagagttgtctaaagagcgtcgtgagctgtctaaaaaacttaaggcaatggatggcggagtaaaataaaatcttgttgcaaccacgccttttgggcgtggttattttgtcagccccagtgaggttttaactctggatcgactaaagcgtaaatctggtaataagtttcttcatcttcagccaccagtgccaattgctgtgcaacatcttctctgctcaccataccgtgaacttcaccttgatagcgttggcaatgtccagtacctgatttatcagtgagtccaccgggacgaatgatcgtaaaatccaatttgctggtttgcaggtaactttctgccagcgatttatgtctgattgattgcccaaataatgatttggcacgtggtgacaacgttttccaactatctccacatccgatggatgtaaccagtagcatgcgtgaaacttcagcttgttccaatgcatctatgatggacatattaccatggtgatcagcgtctcctccgccaatagttgagaaaacaatggggttttctccagcctgagcaatagctttttcgatactcattttgtcacaggcatcgccatgtatgacattagcacccattgcacttagctccacggcttgttgtagattacgaattaataccgttacggggcggtgttgtttcagtgctatagtagctaaatggcgtccaacgcctttgccagcaccgaaaattagccaagatttcatcgccggaatgttctccataaaaatcagccactttaaatgataatgataactatctaagtttattggaatcggagagtgaatgaaatgagacagacaggttttttatcatttttaatataaaaaaggactccatacaaaggagccctttttgatttttctggaaattacaacatccaattactattcgaatgactgtggttttgacatcgcagatgttgcgatatttgttgcagaatgtccacccgcgccgccttttccagcgaacggataagcaggacgttgccattcgttgataatgacaggctgtgctgctaagtctggtgctggtgcttttgtcattggggaagaagcgtgatgatttttttccacgataatcggagactcagcaatttttgtctcttccgctttaacttcctctgccttagcgtatatttccgttgtgacagttggctgttcttcatgctgttcctgttcagcgatagacgtcacaatgattggttctgctgtgtgacgtgtttcttctgtgtcatgtactaacatgtcatgtaaggcttcaggctgatattgggtgtcatggttaacgacgggttccaggttttccgatactaatacttcaggtttctcaggcacgggttctacgagcgggtcaccattggtcgcagacttaatatcatcatgagtaactgcattttgctcggcaacctgagtatcagcaacagttgaaactgataccgataccgattcagcaacagcaggtatcggcatgacactctctttctgctctgcccctattactgtttcttccacagtagatacttctggttcagcaggttgtgtcacaggtgtaacagggtagcgcacccaaactttacctgatgccagctctggcgatgcaactgccattaccagtggtacaggtgattgagtcaggttacgctcatcacgataacgacgacgacgctgaccactgacacgtaaatggcgtggtgagcggcgagaacggcgaggcatgatgttgtcttgctgctcattattttgcgcgattgagccttgtggtattgaaggctgattagctgcttctacattcgtatcgataatggctggtacagaaactttcttctcttcttctgtaatcgccggaatgatcgcctttgttacaacgggtaaagaggcaacaacaacttcttccttcacattgtctgtgatacgaattttctgttcaagctgacgacgctgacgacgaggcattacaggttgatgctcttcaacttcctcttctgtaatttcaggtctactcgtctgttgaaccttggtttccagttgctgctgacgtttttcttcttgacggcggcgctggcgttccgcccgttgttcacggcgctgttgctgctgtgcttcacgagcttcattatctatatctaccgcaatattatccggcgcgttgtttttctgctgaacattacgacccttacgctgttcatcgccgcgctcacggttatgattattgcgagtgtcattctcgttacgttcacgtctttgattctgacgacgtgaattgcggcgttctggggaacgtcggttatcgttactagaagatttattgctcttttcttgctcctgtttttcttcttcaccattgaatatttttttcagggcgcagaggaagcgactgaacagacctggctgttctatttgctgattattgctcactactacctttttctcttttgtttttgctgccacaggggcgacagtttctgcaggcagatcaaaagttgaaatagcaggttgctcaggacgcttgcgttcatgttgtccatcatcctgagcattcgtcatttctgcctcatgtaattgtggaagcagataactcagggtagaaatttcttcacctttacgaacacgtagaacagagaaatgcggagtttgcatctgatcgtttggtacgataacaacacctacatcaccttgacgatgttcaatggcgctgaccgccttacgtttttcattcagcaggtaggacgcaatctgaacgggaacaatcgcatgaacctgatgggtattttctttcagtgcttcttcttcgatcaggcgaagaatcgacagagaaagtgattcgttgtcacgaatggttcctgtaccgctacagcgagggcagacgtggtgactggattcacccagagatgggcttaaacgctgacgtgacatttccagtaggccaaagcgagaaatacggccaatctgaatacgggcacgatcttgacgcaccgcatcacgtaaacggttttcaacctcacgctggtggcgtacaggtgtcatgtcaatgaaatcaataacgataaggccaccgaggtcacgcaggcgcaattgacgtgcaatttcatccgcagcttccagattggtgttaaaggctgtttcctcaatatctcccccacgggttgcccgggatgagttgatatcgattgcggtcagagcttcagttgtatcgatgactactgaaccaccagaaggcagccgaacttcacgctggaaagctgattcaatctgtgattctatctggtagtgactgaacaggggaacttcaccactgtacagtttgattttgctggcgaaatcagggcgtccaagcgcagtgatatgctggcgtgccaaatcgagaattttaggattgtcgatcagaatttccccgatatccgggcgtaggtaatcacggaaggcgcgtacgataacattactttcctgatggatcaggaacggagctgggtgattatctgcggctttcttgatagcttcccagtgtttcaggcgaaaattcaggtctccctgcaaagcttcggcggatttgcctactccggcagtacgaacaataagccccatgccttcgggtaattcaagagaggagagcgcttcttttaattcgatacggtcatcaccttcgatacggcgagaaataccacctgctctggggttattcggcatcagaactaaatagctaccagccagactgataaaagttgttaaggctgcacctttattgcctcgttcttctttatcaacctggacgatgacttcctgaccttctttaaggatatccttaatgttaggtcggccatgagcatgataactactggggaaatattcgcgagcaatttctttaatgggcaggaaaccatgacgctccgcaccataatcgacaaaagcagcttccagactaggttcaatccgtgtaattttacctttatagatatttgcttttttctgctcgtgtccaggactttcaatatccaaatcataaagacgttgcccatcaacaagggcgacacgcaactcttcctgttgagttgcgttgattagcattcttttcattctaacttactcattatttttacattggtatagagctgcgagcaaaaagagatgcactactggtaaccgatggcctcgtgtcttttacaaagccgtcagcctcacggctatcgtttgtatagaggcgcctatattgtcggcgagtctgaatttcatttaaatacagtactctttattgggacactgtaataaaccggtacagatctcacccaatccagtaagctgcaactcgcagcccataaattgtttgattaaacattacgtcttacgccattgctgcgtttttgttcaatcaaacagataacaaacaatttcaatcttgccattcatagtttagtaaactgtggccagaaagcattattccattgctattggggtgatagcaaggtgactttatctctttagcggttttttatcaggaaatagcgataagttgttaatctttagtctttatcctaagacattagaaacaatgaaaaatgaaatcatggatgttatttatacatatttaaaaatgagtggcgctttgattgccggataattaaaatctcgcttatgaaaacaaataatccaattgtacagtttgtcacgattgacgacgatgaagccggtcagcgaattgacaactttttgctggcgcgcttgaaaggtgtgcctaagagtatgatctatcggatcttgcgcaaaggtgaagttcgagttaacaaaggaagaatcaagcctgagtataaattggcagcggctgatgttatccgtattccgccggtcaggatagcggaaaaacagcagccaccagtatctgccaagctgggtaaagtagtcgctctggcagaatgcatcctttatgaggatgactacatactagtcattaataaaccatcaggtactgcggtgcatggtggaagcggattgagcttcggtgtaatcgaagggcttcgtgcattacgtcccgaagcgcgtttcctcgaactggtgcatcgtctcgaccgcgatacatcgggtgttctgctgattgcgaagaagcgttccgcattgcgtacactgcatgaacagttgcgtttgaaacagatgcagaaagattattttgcgttggtacgagggcaatggcagtcacattgcaaagtggtgcaggcacctttattaaaaaatatcctgcaaagtggtgagcggatagtgaaagtcagcagtgagggcaaaccatcggaaacacgttttaaagttgaagagcggtatgagtttgcgaccttggtgcgcgcaagcccaataacgggacgtacgcaccagatccgtgtgcataccttgcatgctggtcatcctattgcatttgatgaccgctatggtgacagggcgtttgatgcacaactgacagaaacagggcttaaccgattgtttctgcatgctagttcattaaaatttactcacccatccacgggagaaactttgcgtttcgaagctcaaatggatgatgagttacggcaatgtttaacaacattacgacaaaataattattgataacataccgtcagtgggtttatcccttgacggatgagcatttctgtcagagtaatcaatggcagaccgattagcgtattgggatctctgccatcgagttttttaaataatgtaattcccaaaccttcacttttaaagctacctgcacaattaaaaggctgttctttgtttaggtagctgataatttcgggttctgtcagatctctgaaatggacatgaaataattcacagcgggtatcagtgtttcctgttttgctgttaaatagcgtaattccagtataaaaagtgacacactgcccactggcttttttgagttgtgcgaaagcgttctcaaaattgtggggtttacctgtaatttttccacttaaaacgcaaacctgatctgaacctataatcaggtggctagaataactcggttgtaatgcggtagcttttgcctgtgacagacgcattaccagttgtgtggggctttcattctcttgtgggctttcatcaatattgggagtagtacagacaaaaggtagccccattttttccaacaataggcggcggtatatcgacgttgatgataaaacaatcggaagcatcattttttccataaaatacgtagagaaatattctcaggcattttaaactatacgccgcttaataggcgaatatttggtggaaaggtgcaggtgtgtggcctttttctttgactatgttccattacaaagataatatgcgcgccttatgcagaaggtaaaattacccctgaccattgatgcgcttcgtgcagctcagaaaagattagactacgaaggtagttattctgctgaacaagcttctcgtctcgcagagtctgtggtcagtgtggatggtgatataaatagctcattatcatttcaaattgataatctgcgtctggcagttgtaaaagggcattccgatgtggatgtcacacttgcctgccaacgttgtggcagtaatttcagccatcatgttcacataacgtattgttttagtccggtcgtcaatgatgagcgggccgaggcattaccggaagagtatgagccaattaacattaatgaatttggcgaaatagatttgctggcaatgattgaagatgaaataattctttctctgccggtagtcccggtacatgattctgaacactgtgaagtgtccgacgcggaaatggtatttggtgtactgcctcctgaagcagaaaaaccaaacccatttgccgcattagccagtttaaagaaaagtacttaaggagtaaggtcaatggccgtacaacagaataaaccaactcgttctaaacgtggtatgcgtcgttcccatgacgcactgactgcaacacatgtctctgtagacaagacttctggtgaaactcacctgcgtcaccatgtgactgctgacggctactaccgtggccgcaaggtaatcaacaagtaattcggctaactattagcaagttgatatcttggctaatctaaccttagcgttagatgctatgggcggggattttggtcctcgtgttacggtgcctgctgcattgcaggcactggcatctaatccgcaattaaaattattgttggttggagatcccgaaaccatctcccctttgcttgcaaataaaaatgctgagcagcttagtcgtttgcaaattattcctgcggaacacgttgtttctaacgatgcaaaaccttctcaggcgatccgttccagtcatggtacttcgatgcgtattgcactaaatttagttaaaactggtgaagcgcaggcatgtgtcagtgcaggaaatacaggcgtattgatggggctggccaaattgatgctgaaatccatcgagggtattgagcggcctgcattgatgacgatgatccctaatttaaaacagcagaaaactgttatattagatttgggagctaatattaattgtaatagtcgtatgttagtccagtttgccattatgggagcagtaatggcagaggatgttacaggtgtgaaaaatccgcgtgtggcattactcaatatcggagaggaagaatccaaagggctagataatatccgcgaagctgctatgaccttacagaataccccaacaatcaattatataggttatgtagaagggaatgagttactgacgggaaaaaccgatgtactcgtgtgtgacggcttcgcaggtaatgttacgctgaagacgatggaaggtgcgatcagggtgattttatctctggttaaatcaccggatagccagaagaaaaaatcatcgtggttgaggaaaattttcaagaagtggttgttaaaacagatattaaaacgcttcggccacctaaaccctgaccagtataacggcgcaacactattaggattgcgtggtatcgtcataaaaagtcatggtgccgcgaatgaacgtgcgttcaaagctgctatagatcaagcagttcagaccgtacagaatcaggttcctgatagaatcgctgcccggctggatgcagtattacccaagagtgaataagcataaatgtatacaaaaatcttaggtacaggcagttatttgccttcgcaggtgcgtactaacgcagatttagaaaaaatggtggatacgactgacgagtggattgttactcgtacaggcattcgtgagcgtcgtattgcggctgagggtgaaaccgttgccactatgggattcaatgcagccgaaaaagctattgaaatggctggtatcgataaaacacaaattgatttgattgttgtagcaacaacaacttcatcccatgcgtttccgagtacagcctgccagattcagaattctttaggcattcaaggtatcgctgcctttgatgttgcggcagcttgtgctggatttacttatgcgttaagcattgtcgataaatttatcaagactggtgcggctaaacatgccctggttatcggggcagatattatctcaagagttgtcgatcctgaagatcgcagtacagttgtcctctttggtgatgcagcaggcgcaatggtagtaggggcttcagaagagccgggtatactgtcaacccatctgcatgcggatggtcgttatggcgatttactgtcattacctaatcaggatcgattgaaacggggttcacctgaatacgttacaatggctggcaatgaagtatttaaagttgctgtccgtgagttgaccagtattgttgatgaaacactggaagcaaacaatctggatcattctcagcttgactggttagtgccacatcaagcgaatttacgtatcatttcggcggctgccaagaaattggacatgacgatggataaagtggttgtaacactcgatcgtcatggtaatacttcagcagcatctgttccgacggcatttgatgaagcggtacgtgatggaaggattcaacgcggccagcttgtcttaattgaagcatttggcggtggctttacctggggctcagcgctagtacgtttttaatttaacaggaaaataaacatgtctgattttgcaatggtgtttcccggtcaaggttctcagtcacttggtatgttggctgatttagccacagaatttccgctggtggaacagactttcgcagaggcttctgcggtcttgggatacgatttatgggcattagttcagcaggggacagcagaagagctgaataaaacatggaaaacccaacctgtattgctcgcagcttcagttgctatctggcgtatatggcaggaaaagggaggcaagcagccttccatgatggctggccatagccttggcgaatactcggcgctggtttgtgctggtgtgattgaattccagcaggcgattaagctcgtcgaattacgcgggaaattgatgcaggaagctgtaccagaagggcaaggggcgatgtacgctattatcggattggataatgaatccattgcaaaggcatgtaaagagtctgcacagggtcaggttgtttcacctgtgaattttaattcgcctgggcaagtcgttattgcgggtgagaaagaggctgtagagcgtgccggtgctgcttgtaaagcggctggcgcaaaacgtgctctgcctttggctgtcagcgtcccttcacattgtgcactgatgaagtcggcagccgctcagttagctgttgcattgcaatcaattgtgtttaatcagccacagttccctgttgttaataatgtggatgtcaaagtagaagaatctgctgatgggattcgcgatgcactggttcgtcagttgtataatcctgtacgctggacggagtctgttgaatatatagcggcacaaggtactgaacaactgttggaaatggggccaggtaaggtattaaccggtttaacgaaacggattgttgatactttaaatgctgtagcagtaaatgatgtatcatcactcacagttgctctgaataaatgactgaggaaaacatgagctttgatggaaaaattgcactggtcactggcgctagccgtggcataggtcgctcgattgcagaattattggttgaacgtggtgctcgtgttatcggcacagcaaccagcgagaatggagccgaagcaattagtgcctaccttggtgataaaggcaaaggttttgtattgaatgtcacagattcagaatccgtagaaaaaacactctcgaatattcgtgctgaatttggtgaaatagacattctggtaaataatgcaggcatcactcgtgataacttgttgatgcgtatgaaagatggagagtggcaagacattattgacaccaatctttcttcgatttttcgtctgtcaaaagcagtaatgcgctctatgatgaaaaaacgttatggacgtattatttccattggatctgttgttggaacaatgggaaatgcagggcaggcgaattacgcggcagcgaaagcaggagtcattggtttcagtaaatcattggctcgtgaagtcgcttctcgtggcatcaccgtcaacgttgttgcacctggttttatcgaaacggatatgactagagcgttgacagacgaccaacgagtaggcattttatctgaaattcctgctagtcgtctcggtgatgcaaaggaaattgccagtgctgtagcgtttcttgcttctgacgaggccgcttacattacgggtgaaacattacatgtcaatggtggcatgtacatgatctaaaaatgagcgaactcgctgtttctgatgtattttttatacaaaaagacacagtttgtggttcgaccagccgggatttggttgcatcttttcctgtattttataaactacgaaaagg

SEQ ID NO: 14982 - DNA, 246503 bp, Xenorhabdus bovienii
  unsure (1)..(246503): unsure at all n locations
  Genomic contig Name=Xb4151_4152.C441
ataagttaccttactaagttacaggactgaatccgcatgaccgacaacaataaagcattgaaaaatgctggacttaaagtaacacttccacgcctgaaaattttggaagtgctacaggatccagaatgccatcatgtcagtgcggaagatctctacaaaaaactgattgatatcggtgaagagattggcctcgccactgtctatcgcgtgttgaaccagttcgatgatgccggcattgtcacacgtcacaattttgaaggcggtaaatcggtttttgaactcactcaacagcatcaccatgaccatctgatttgccttgactgcggtaaagtcattgagttcagtgatgagtttattgaagagcgccagaaagatatcgctgaacgttacgggatcaagctgtcaaaccatagtctctacttgtatggtcactgtactgctggtgattgccgcaaagatagcacaatgcatgatgaaaactcatgatgagaaagcacgacacgataagaagttctgacaattatccacttctgtgtctcatgtagtctgaataagctactgccgattagctcaagctaatcggcaggctgctttttaaaagaaatatcagagcgtgatttttacttcttcatctcggctaaaacgcttaccatcagtactgacagagcgcactttcacattattgctgacatgtggacgctgcctgtcatcgtaaatcgcccatgttttaccgccatccagcgaatactggatcgctagccccggcaaggcgatattggcttccaacgttccggatacaatccttcccccaggtactggcaaccgataggcgatgttagctttgtccaatttagccagctcatgttgtcccatcaaattggcaaaatctatccaatcattgttgatcgcattagtatcaacataatgtgttacgccgcccttatattccctgccctgctggtaattctgttcccaactcgcctgatgccatgcacgttccgccaatggcaacaagcgcgggtaaatcatgtattccatctgatcatcagtacgcacggtttcgctccatgattgccctgatagcccataagctcccggccaatgtttgttgctctgggtattgaagcggttgccgtcgcgatccaccgatgtttcagcattttgtggcatattgttcggcgcaaaactgaaaatttttgcttcatcgttgaagcgtgttgcccaatagtagccgcgctctttcggactaacttcatacggcatatcaaggtagacataatcagggctggaaacgaccactcgatagcccttattcgcccaatcattggcagaatcatagcctccccaatagagtgtatcccagaaattcactgccacatgcttggtggcgaaatcttttgccgacttcgcatgtttcaagccatcctgccatgcctgcattgtatcaatgccgtgagtattgacgatcttgctgacttcaatggcaaaatgactgtcaagttcactaacatctttaacaatgccctgcgctatcattttttggcaagcctgagattttgcccacggtttgtcttctatctttttgttgatgatccctttgcccggttctattgggccatctttgtcctgataccccgttcccaaacgaatgtttttcgcttcatcaccaccaaaatgccatgttttcaacggtaattccgcttctctgtgcattaaagcgatttcgctgataattttgtcaacaaaccgtttggaggaatccatacacggatttaaataactgcggcgatcgtagaactgtactgatgtcgcattcgtggtatcagtcgggtcaagcaggcgatattcattggcctcctgctctttcccctgtgccatcaggtttttgtaacgggcttccatcgacacaaccgctgcacgagcgtgagcaggggtatcaatctcggggatcacttctatctggcgcgctttggcatatttcaagatatcaatgtaatcctgacgactaaaatagccacttcccatattattgctatcaggccctgatcctaattgcggcaacaaacattgagtttcactcagatcatgacagcgtttgctcccgacttcagtcagctccggcagaccggggatttccagacgccagccctcatcatcgctcaagtggaaatggaatttgttcagtttataactggacatttgatcgagcagacgcaagacagcttccttactgtggaagttacgcccaacatctaaaaatatgcctcgataatcgaatctgggcgcgtcttttgccgtcagtgtggcaattgtaggatcaccattggcagggagcagagataacaatgattgcaggccataaaacacaccggattgatcaaatgcgacgatttgcgttccttgagttgtgatattcagcgaataagccccttgcactcgccaagtgcccgtaaatttgtttgcgttgatctgtgccgcaatccgatagccattatctgttagcttgatattgtgagaggcaaaacgttctcgaataacgttgattgatgcgttgctcaacccgcccaactccagtttcacaccacgggacaggtttacatcttgtgaatggatagtcagcgtttttggcgtcggaataacctgtccacgcagtttatccccgctgatttttaccatctgctggttttttacaaaacgagtttccggagtcatcagaatattgttatccagcgtagtccgtttccactgctcatctgtaaaatcagataaaaacgcactcagatcttccgtatcggtattcgccagtattttaggcatcgcatcaccggaagtggcataccagcgtggcataaaatctgtgctgtaaatctgccagtattctccaaagatcggtaacaagattttttcattggctttgataccgatgaatttttccgtcggctccagcttatgtaagtcacccgtgatatgcgtgattttgtattgctcatgatcgactttcaggatctggcgaatactgtgaaaatagatcgcccagtcagaagagtcgatcgcctgattgccattagctaatgtgatatgaacccgattacaggaagccccgtccgcgcctaaaatggcacaatcggttccatgtgctcctgcttgattatccttaattttgaaattcacttttaattgactaagcgaatccactatctgctgtgacgtcatttctgcatgaacacagcccattaatccaactgtcgtgatgagtgctgccaaggtacgcaatttaacgcttttcatgaatgacctcgtctgaacttattattcttttataccctgcaacttcagatttatcgggtatagctgggtaatgctgcttctgtcagtcaataccgcgctataacaaacgcagaaacagcgacgacagtccataaaagatgctaattggcacagttacagtaaatgtaatattttttccgcccagaagaacaggctattttttataccaccagttatcaatagcaaataaccctacataaaataggactataaggcaatttttaatctttagtggggagagtcaattttcattacaaatattttaaacataaaaaaagcgcgataataatcgcgcctttttaatgttttggttataaaaattagctctggttattcctgagagatctttgtccaagtatcacgcaagccaactgtgcggttaaataccagatgttctgcactggagaggccgctatcagcacagaaataaccttcacgttcgaactgataagttctttctggctgtgcattcaccagccctggctcgacaaaacctttacgcacgaccaacgattctgaattgatagtggataggaaatcatcttccgcccctgggtttggcacactgaacaaacggtcatacaaatagaattccgctggcacggcatgtaccgcactcacccagtgaatcacacctttgactttgcggccgtcagccggatctttgttcagtgtctgctcatcatagtggcagtaaatggtagtgatattgccttccgcatctttttcaacatgctctgccttaatcacataagcattacgcaggcgcacttctttgccgagcaccagacgtttgtactgacggttagcttcttcgcggaaatcagcacgatcaatataaacctcacggctgaatgggacttcgcggctgcccatttctggcttgttaggatggttcggcatcgtcaggatcatttcaccttccggcatattctcaatcaccagtttaaccggatcaagaaccgccatcgcccgtggtgcattttcgttcagatcatcccggatacaggattccaatgcggccatttcgacgttgttatcctgcttggtgacaccaatgcggcggcagaattcacggatagccgcagcagtataaccacgacggcgcaggccggaaatggttggcatacgtggatcatcccaaccgttgacaatattttcggtcaccaattggttgagtttacgcttggacatcaccgtgtattctagattcaggcgagaaaattcgtactgacgcggatggcagtcaatcgtaatgttatccagtacccagtcatacaggcgacggttatcctgaaactccaatgtacatattgaatgggtgatcccttccagcgcatcggaaatacagtgggtaaaatcgtacatcgggtagatgcaccatttattgccggactggtgatgctcggcaaatttgatgcgataaatcaccggatcacgcatcacgatgaatggagatgccatatcaattttggcacgcagacacgctttaccttcagcaaattcaccggcacgcattttttcaaacagggcaaggttttcttccacactgcgatcacggtaaggactgtttttacccggctctttcagcgttccgcggtattcgcggatctgttcagggctgagttcatcaacataggccagacctttattgatcaattcaatggcgtattgatacagcatatcgaaatagtcagaagagtagcgaatattgccactccagtggaaacccagccactgtacgtcagttttaatggagtcaacgtactcgatatcttccttaactgggtttgtatcgtcaaaacgtaggttgcattgcccctggtagtcttgcgcgatgccgaaattcaggcagatcgacttcgcatggccgatatgcagatagccattaggttcaggcgggaaacgggtatgtacggatgtatgtttacccgttgccagatcttcgtcaataatctgacgaataaagttggtcgggcgggcatctgcctcactcatcattttattcctcaatgcaaaaagcgctttaacataaccttctatattctaataagctgaaccgagaaacaactctttgttagtgggaaatggggttcggagcaaagttaatgcggaaaagcgggaagacaaaccccttcccgcgacaattaagagaaaatcttactttagttcaacattcgttacgtatttttgagcaacaaaataagctgttggtttaacgctcatcaataaaatcaactcacacgatgactgttcaatacggcgatcagttgatccgcacaataaacaatatgttcttcatcccaagtagggtgcagatacaagctgatggttctcggcaataaagaacgtgcagtttcacagacaacatcacggtaattgacagattcaggggatgtgtattctttcgaatgaaaagggaaattggctgaaccaaacccacgtagatctctgaacactttctcaccataggcttcaggccactggattttaaatgccggaatacctatctttttcaaatcactcaggatgatttcagcagtgcaatccagtttggcaagatcaaaaacaatgggatataaccagtacgcattgcatctgtcttcattattcaatggcaggccgtggatcaagtcgatatccgcaaatttttcatcgtagatcttcgcatatctcttgcgattgttcatattccaatcatcaaatcgctctaactcgttcagaccgataatcgattgaatttcagtcatacggtaattgtaaccgattcgattatgcacatgccatgaaacttcttctaaagcgagaagatcaaattttcttctcacatcaaacccatgatcacgataagcccggcattcccaacctatttcagtattgttggtcacgaccatgccgccctctccccccgtagtaaaatgttttgactggcagaagctaaacgtaccgatatccccaattgtaccagccgattttcctttatattttccgccgagacattgtgcgctatcttcgatcactttgaggttatgctggcgggcaatcgccatgattgggtccatatcagatacgacaccataaagatgcacgacaataattgctttcgtgcgcggtgtaatcagtgcttctatcttagtgggatcaatggtgtgctcttctgtcgtatcacaaaaaacaggaatagcgccacattgtaaaacagcaaaggaagttgcaataaaagtgtaagaaggcacgataacttcatcgccggggccgatatttaatgcgccaacagcaatatttacggcagaagtcccggaattacatgaaattgccatttctgcgccaatccaatgcgcaaatttattttcaaactccatgcctttttttccagtccaataatttacttgaccagataacaggggttcttgaatatctttcagtgttttttctgtaaaacttggccattgtgggaaattcataattttacaccttaatatttttaaaatagataaaattaatcctataaaataaatcacataactaatcaatcagattatttcaatgtttctttatcaattttgtatttgctaccataattaatgcaccaatagctaatatataaaatgctgtctccagaccagaactctgggcaataaatcctattaaagctggcccaatcataattccaaaatatccaaatgtgacaatagaagcgacagcatggctaggaagcataactttttgcgttccagatattgaacataagattggaacaatatttgatgatcccaacccaataaagaaaaacccaatcatagatagattgagagttcctacattaacaacgataagaaatccaatgaagatactgagtgtaccaacaaaaaatactttcccccttcctatttttgatataacccgatctcccatgaatcgtcctattgtcatcgctgctgcaaaggcagcatacccaaatccactgaatgaaatatcaatattacgctcactaactaaaaatactccactccagtcaattacagaaccttcaataattcccattaaaaaacaaagcaaacttgctacaataatgattccacgaggaaaaacaatttttttactatcgctatccccatgatttttatgacgactaatgagtccagaaaaagaaaacaaaaataacacagacaatataaaagatataattaagcatgctgcaagcgctgagaaattcaaataaagtaatatcgatacaccagcagcaccaaagatcccccctagactaaaaaacccatgaaatcctgacattaaatttctatttgtatttttttcgacctcaaccgcctgaatattcattgcaacatccactgtaccaatggatgcaccaaatataaaaagcataaaacccagttgagtgacattaggcgccaatattaaaagcggtaaagaaacaatagcaaaaattcctgaagatataataaccttacgacaaccaaataaagtggtaagaaatcctgtaatcggcatcgaaacaattgagccaaagccaagaaaaagtaataaaaaacctagctctcctgcatcaatatttaaatcagcctttaccaagggtataagaggagcccacgcagcaattcccatacctgctgccaagaaaacaattctagtagaaataacattattcattaagcatctcaactataatatttatataaaataattacatttcagttaattataaatgtttaacagtaaataatttcaaatttacatttataaattcatattgactctgaaagaattaatgcccatctcagtaatcttaatttcattccagtcattaattagacctataactgaatcaaacattttttcttttccaccaatctgtatgaccttacaccctgctgctaatgcgctttgtaccccagcatgagcatcttcaaaaactaaacaatcttcagccgcaatattcaaacgttctgctgccataagatagggatcaggatagggcttaccattcagcacatcatcagaaccaattatgaagtctggtatcttaagaccacaaattgccatcctatgatatgcaactcgttggctggcagaagtgactatagcccacggacaagccgctaaagaaatcagaaattcttttgccccaggcaatgcctttgcagtatcagaatatttaatttctaaatcatctaatagctgtatttgttcttccatattcaaatgaggagcaatagacgaaataacatctctggaacgaacaccatgacaaatatccaacactttttttatggatatattgttcaattcgcaccatatagaccaaatagcctcaacttctgaaagtgatttaactaaagtaccatccatatcaaataaaatagcttttatattaataacttccattacccctccataataaaatacacacattacaaacactatttcatgttcattaaggtgaattataattaattataaaaataataaatcagtggaaataaattaaaaccaacgtcaaatcgcttattgacaaataaactcagatcactttaggatcattgatatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtatatatctatagtgattacaagtgaattcgactttaataattatttaattatatcttacaaaattaattacatgatggattatgtgttttgtgatttaacgccccgtgcttaatgagtaatttttgcatttcttctaaattacgctcacaggcataggttaatgcgctttgatcataagaatacatacttttatcatccgttatcgtaaatagattcagattcgcaccctgctcaaccaggtattttactgtctcaattctattattgcttgctgcgatcattaccggtgtttcgccgtcatcctcaatagtttgatcatttaaatcaagttcatgtttcattaggttatgtattttcttcactatgttggtatttttacctaaaattgccgattttaaggtatgatgaacatctcttgtgtctgtcgcccacaaattagctttctttgatattaaataatccactatatcttcataaccaataaaggcagcccaacccagtgcggtttgatttaagctaccggtatctttggcttcaatatcctgaccactctcaaccatttttttgacggtttcaaaatcaccttgcttaatagcatcaaaccacttgctgttttctccggtagaaggctcttcataaaaaactctatacgataacctttctgggttagccagatcgaccatctccacataatccagcctgaatttcttgtacttatccggattattctcatttaatacttgagcattaacattaatcgaagtaaatagtaacgtaaaaatcattattatctttttcataatttcctcattatttaacctaatttcacgtttaaaagagtaaagtacaacaataaaaatatattattttttctactgttattccttattatcgttgagttacaattctttaatatcttacactactgattaatcttatcaatcgttaccatgatggactgtggtgagtgactctgatatattcatgacatctacaatggtatttcataatggagtatgtatggcggaatcagtaaaattcataagttcaattttttgtgattatatttttttattttgtttcttttggtgcatttctgttcctgtaggactgatttttacagctatggcatgtgtattcaaaaaagcaacctacagaatttcatgttcaatattggctatattatttttatttccattaatattcacgcttatgtatattgcactatctaaataagtcattaaattaaataccagcctcgcaaatgagggtgttattaccggaacaacagaaaaatattatggcacataacgaatttcttgagagttttattgatgtaaacactcccattgtatttcctgtaaacatgaaaaataaagatgggatgaccgaatgtcagttcccagatgtggtcataatgaaagcatggggattctattattttcagaaaccccattgaaaatggctatcagctaaaaaggctaaacacagcaataccaaaactaccaagaccgactaatagaaccatcaaattagaaaaagaacgatagggtcgtagtggttcaaccaagtatgttgatagagatggtaaaacaaacaaaataagcgcaatcataggtccagtgatgcctgcgataacgttcagagtattaggattccaaatagtaatcattaaagtaaggacaaaaacgatagccatgccgatcaacttatcacgcactttattttctttatgatggagaatcttactctccaatgctccgactaatcctctgaccccttccaatgccccaaagtaagttcctaagaatgattttgtcatagcaataatagcaacaggggttgccgttattgctatccaatacaagccttctttctgcgcgattgcactgagaatggtaatattgttgtctttggttgcctgtatttcctgaggtgataacgttaaaacacaactaaatacaaaaaacaaaatgactacgcaaattagcgcataagtgggtttcacaatctgtttaatgtgatattccgcatctgttttataggctcgtttacagtggttagaaaaagtagacatgattggggtgtggctgaaagagaataccataactggcattagtaaccaaagtgctctcactgaatcccagtcagtatgaatattgctgataagatgtttaatgtttgcactatcccattgagatacaagcgtcacagataatgtcagcaagtaaagaatgagtggaagaactaacactcccatgaatttcagtgtaatttttttacccaataagaaaattaagtgtaaccctagaactaccataaacgctattaatgtgcgtggaaactgaatcttccaaaattgctgcaacaaaatgttaacggaattagtgatagatattgcataaacaaaaataataagcaggaaagttagtgcataaaaaaagttgatgatacgagctatcctgatcccataatattgtttggttgcactgagtagtgtgggagaatcggaattgctggtaatgatataacgtgcaagacccaggtggggataataggtaaatgggaatgctatcaatagcataaccaacatagcaagtggtccggatagtcctaattgtatagggagaaacagagttcctgcacctactgccgttccgaatagtgcataaaaccaaatattgtattcattaatccacttttgttccatcttcaagtacgtctcctactaagtttatagtttttcatgttttcctaaaccaggataaaaataaatcttttcaggaaaaacagtgtgccaaccaccgccaccacactcactgcaagccatgcaataaaccgatattgcagtcggctgttaacattttccagtctgtcacaagctgctttgaatcttttatccagtgcatcaaaagatgcttctgttatctccagccgttgcgatagttttttgccaaacgtttcattgagcttatcaaagctgctctgcatacccttggtaacttcaccctgcgactattcaggcacgttgtggcctcacagacagtttcgtgatgtctgccttatagaaagtctaaacgggttgtttcaggctctacaatgttgccagcatctcccgagactgtttatgcagcaagtctgtccggctgtcattctccggtgcatgaaggtgttgcattgccgtagcttttcatcacgagtctgactgccggctatgatcagtgcctttgtcgttttctggatttcttccacgatgcgtttcaggcgcagtgcacgttcaaaatgcggattgcagatattctgccagttctcacgaaactgcatcagacgtgctttacgggttgcaatgatccgcccggaataggcttctgacagcctcgtgttcgggatttttggggttataacgtcggaaatactattcagagtcactgcgaatagcatcattgatgcggacaaaaaacatcaggtgacagtgtagctgcttccctccgtcgacggaggtggaaacgtgaatagatcaacgcttcaaaccccattaagcgcgccttctgcattactgcattttctggaaggataacccattatcagcaatactggaagttttgttaaattatcagactggtagtggggaaaaatagctgttcatgtatcagtttatcttgacggtcgattagtacggtttttatgacttaataggctggattttaagtaattctcagtctgctatatgacgcaaattatgtcatgtgtgctcagtgcttaccaagcgcagtacttacaacgagtttaagttattttcataatatatgtcatacttagattcgcctcataagtattttcatctatcaatacatctctatcatatattttttcctccataaaccatttatttacatacttccatattacacaaatataaatatgtccatcgcaaattactgtgtcaactatatactctcacctttaagaaaagattgaaccaatatttctttattatcaataccaaatatatttttatttttcaaaacaacttcacaagcatcaaaaacatccctttcgtgaaaataaatggtaacaccatcagttgacgctgaacttaatggttttattacaaatgaatacccacttttactattaatccaatcaatactatttttgtctgatgatttaatttgacaagccgctttaatattatttttatgaagtatttcactcatatcatatttatctcgccctgtcccaatagaaggtatttgatattatagtcagcctattttcctacagttaggggattttttcatgaataagaaatcaatagcccaatggttcatttctgatgaattctgacagaaaattgaatccttactccctcctcataaaacccatcatcctttgggctgccatcgtcgccgtgtcgataatcgagacgagatgaatgctatcttttttgtgttacgaacaaacagaccgcaatccaatagaccggggaaaacaaggcgtaaagcaaagtttgctcacagatggacaggacttgccattagcgattgccgttgcgcccgagaatattcatgatatcagatttgtcataaccaccctggtctgtaaaccgaccagggtggttatgacacccaactccatctggataaagtttataaggcggaatgactgtaaaaagcaatgaataatttcggtgctctggctatctgtgccttgtcaccagaggttaaccactcaagggaatgagtaagggaatattggctttagtttcaggtgttgaccaattgttgagcgttattggattattgttaggtggagctaatattattaagcttattaatttttcgataataacgttacatgtggagaataatatgaagaaatatattctttcttgcctgctggcaagcactacgcttttagcttcaatgcagtcttatgctatagcttgtaattttttccccccagatagtcaagaatggaaagcttgcatagaagtctgcaaactgctgcccattagtcccaaaatttgtttataataacatcaagtaggacggttcattactgccgtcctactcctagcttactgcgctgactcctaacatactccttgcaaccccagaatcatttgctctgcggtagtaatgtgttatttactatctgattgttgcctataatcctaatcactaggccgcctttcgtagctatcttcatagtctgaccgtcctgtatctggtcaaatccaaatgctaaagcttgttaacagccttctgctttcgttcttctttacggcgattgtcatagtaggcatcgttacaacaccggaatatgtcaaagattcaatcaaagaagccattgaagaacacgctgcaagccgcaatcacccatacgcaactcaggtagaaccgggatttgtgacactaaataattagacagacagtgataacgagataaccgttgcaacctataaagctgttaaaaaagcctacgacctagccaataccgccaatcaaaatgttaactctcggttggagaaaaatcaaaatggtgaagacattcccgataaaactgagtttgtaaaaaatatcggtttatcgggaacggtggaattagcaagaaattcagtgcagggaaaacaatatatttatgatttaacgtatgccacggcagcttggataaaaattgctgaagtgacaatgggagtacccagcactatcaatattaatctcatcggcggctctgggtacaatgtagggttctttggacaatgtgctatcaccaatatagttttaaggacaggaaataacaatcctcacggagtcaatgcagtgatgtatacaactaatagtggtgcacctactgacttagagtctatcccaataggattatattccagacaattaaactacaagccaaatgaagcatggcttcataattttcaacccgtttttcccaacggaccagaatccgacgaaaacgattaagccaactgtgtgtcctttcaacaacccaacggttcactttaaaatcctcttgttcggccagcgcatcttgttcttcttttcttgattgtatgcaggggacgtatccacgggtttttaattctttttccagccattccgcctcataagctttatcccgatggagtttggttccataaccccggcatcctgtctgtaaaccgtccagggtggctataacaagtctgatatcatgaatattagcgggcgcaacggcaatcgctaatggcaagccctgtccatccgtgagcaaacttcgctttacgccttgttttccccggtttgttgggttgcggcctgtttttttgagccggccaggggcgctttagtcaaacagccatccagtgccaatttgccccagtcgatagcccctattttttcactggcgagtaagccattttgccagagtcgctcaaagacgcctcccgccacccattcctgaaaacggcggtgagcactgcttgaagaacaaatccctgtggcattgagggcattccactggcatccggttcgtaacacaaaaaagatagcattcatagcggcccgattatcgacacggcggcgatggcagcccaaagggtgatgggttttatgtggagggagtaagggttcaattttctgccagagttcatcagaaatgaaccattgggctattgatttcttattcatgaaaaaatcccctaaatgtaaaaaaacaggctgactataatatcaaatatctcctattgggatacactcttaatgcccgcgcccctatttcaggatcaatatcatcatccgcaccttttccgcctaaatcacttctttctacatctgatagcggtgtaaaattggtcattcctcgtctaacagcccacctatgtgcagtcttagagtatgttaatatgcggataccaattgatggcacttgctttgaaatatctgcaattaaagaaagccaaacatgaagcggtacttcatcatgaggtaatttgccaattttggggaaaacatataactcaaaatagcgcaatacatattctgcgttaacctttaagccttgcattgttgttttctaccactcccgtattaactcttctacagtcacggcactcaaggcagatcctttccgaacacgtttaactattttgggattgcggtgctgctccagttccccgcgataaaaaatcacggagtcgcgagtatcttttaaacttgttgctagatatataccaatgtcaatgcgatcacctttacctccccacctatatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtatacctaaactgaaatataatttttcccaccaactatgtatccactccgacgtaatgcatcaatcgatacattaggaagcgctattatcgacttcatgcttttattaattttctcgataatctctattttggggccattgatccaactatcgctgctataaaaagcagtcaaaatattattcatttcatcaaaatcactaaaagcacgaatcagataatatgaatcagagttgtgcaatgaattaccataactaataacatctatgccagttttctcatgcaatggcacactaatttctgtcattattcgatgaaactcctttcctgttgctgcttttaactcatattgcaatatttctataatttttttatccatatggcaccatatgatttttgatcagaataatgacaaatcttgtccatttcccgaaagaaaaaaagcaaattatcttttttattcgtgcattgtcacaaaattatagaaaaccccatcaatatccgatagggttttttatttaaatcttatttagcttcagacaatacggcattggctatttttgggtgtagcgtatacatacctccattgaggggatctacaatcaaccagccaatcaagccaccaaatacaaaattacccccgatataccatccgttaggctttgctaccagcggcaaagtgaaagatttaaaatgttctttcacaaaagttatctgatagttctttttaccaaaataatggccatttgatttttcaagcatgacattttggggtgtatttccatgtgcaaccactttgccagtttcatctttgattgaaaattcggcgcctgaaggctggctattgacttcaataagttgatttttttcaccaatgatggtggcacaaccactgcacaacatcacagcagataataataacgtacaaattttattcatttatagtccatgaaagaaaaaattatcaaatgtgcggcgaatagtaccagaatccttcttttatatacaataattttaatatatttatattggttattaatataagggatagataaaatctactatttaaaaggaaaaataaaaaatcaagatagtcaattcatttaaataaaaacatttcattaatttatttattgatgtaattaataaataaattaatgaaatgtttttatttattgatgtaattaataaataaaacgatcctatcttgcatgcaatcatgaaaataccaagaatactttatgtaatataatgaattttgtgacctgaataattgacgatataagcgtaaaaatatagttttctctattgccaattttaaaaaataatttgaggtaaggaatgcgtaaattatctgtaattgctttatccgtactggcattaactggttgtaaagtcggtttagatacagaagtaaacctcagcgatattcttgctcaagaacacaaaatcgtgcaaggtaacctgaatgttgaagtcacttcttgctcaacttccggcgattcccgtcaagagtctaagagtttgatcgaggcgaaaaaaaagatcccgactatttttaaaaatgccgaatttgtggaatgttatcgaaaagattttgattccttcgctcatttcaccattccgattgatgtcggcagtgcacaagatcctattaatcaacaaaataccgatgtctatatttattcaaataaaaagcagaaaattattgctgaattgaaattaacagatgctctaattggccgtattaacaaagcgaaaaaagatttaagctcaatgaaatttaatttctctgtgaaaatacatagaaccaaagaaccgattaatgtaaaagcccttggtgtatttatgacaagtgataaaggtcaaaccacccccatggtttatgaagactttgaatggtctaagtccaaatatgctacctttaaattatctgatgttgccgtcaattcgttgttagctaagggtaaacatccgttattattagagattgattattttgagaaaaataaataacatcgcaattcataattaaatttgacttacagccctgaaatgccagggctgtattcagttataaaaaaacgccgaattaaaataacgataaaacactttaggtatttcccataaaaacacctaataaattaaaattgtagcacagtaacaagtgaatcaattatcaggagcaatataaccaccaatataataaatggagagggaatatgaaaagccgcataataaagcaatactacaccatctatgctttaatagcgggtgtctttgataggatgtttaccgtatcagaaatcagtcatggcggagggtttgatattggctgctcacatgcactcacaagtgagattacgcaattatcggaaatagcaaggcagaaaatcctgcctgctcttccccttaatgtttttccaaaatgcctttggatgtgaaccacgccgtgataataccttgccctaagagcactcccacaatagtcagcataatgccaacaagttgtggcaaacttggcgaatttcccatcattagctgtattatcagggcaaaaataggcacaaagttaaagaatatcgctgtcttccctgctcctctaagcgcaacccctatgttccaaaaaagataagctaaaaatgaacccgcaatccccatataagcgctcgctaaatgactctcaaacgttcctgatcgcattgaagaaattggtgattcaacaaaaaaagcgatcatcgctaatatcaccactccaaaaagcatcgtccaactggttatctcaagtggcgtagcattggtaatgaatttacgggttcccaccgtataaatggcccagccgagactacccgcgaaaatgattgcatctcccgatgccatatgaaccataccgcccaccaattgaccattagtgatcaccaaaacaacacccagtaagctaatacccattcctaacacacggataagttcaggaaaacgacgattcatgatggcttccaagatattggcagaaatgggtgtcgttgccatgatgagtgcagccgtgataggactggagctttgaaggccaacaaataacgctccgttgaatccagccacaccaattgccccaagacaaataaatgccagcaggtttttcctcagcactttgccatgaatgccactttttaatgccataaaaataaaaatcggtaagacagcaaaaacaaagcgttcaactgaggctgtccacggaggcaagctctctagcgcaaattttgtcacttgaaaatttgagctccaaaaaaatgttgcaaataacgttaaaacaacagctgactgtggtgtatttcgcatagtaatgaccttatttttaattctgcacacgttagactggattgcttttatcgagatcattgtggcatatttcaaattcggaatatgcagacaaaaatagaaatcgattttccaaaaatgaaaaataaaacagcgcaatcattggtttgggatgatatccgtgtatttctggcgatagcacggacaggcacattaagtcgggcggcagatgttctaaaaatcggtattgcaacggtctcacgaaaaattgagcgacttgaaacgaccttcgggatgcctctatttctccgccatcaggctggctatcggctcaccgaagacggaaaagaactgctggaaaaagccaaagcgatggaaatagccgccagctcttttctgcttgaagccgatactcggattgcaatttcagggaaagtccgactcgccaccacagaaacattcgcgagtgacttagtaataccgagtttaccaaccttacagaaaaactatcccgacctcacattggaaatcacaacggatattcataccgtagatctacatcgtcgggatgcggatctggcacttcgtatcgtcaggcctgaacgagggcatgttaccgtccgtcaattgggaaaattaggatttgggctttatggcaacaaagattatttggcaacttgttcacctgacatactgaggggtaaatatgaaaaggcacgttttattggttgggcagagacctactcgtaccttccttcattccgatggactgagaaaaacctcaaaagccgaccgttatctgtggctacaacttcactgaacgcacaattggctgccgtaaaagcggggctggggttggcggtactaccgcatttcattgttcaatatactgaacttaaatgcatttctcatgatttgggaatagatcaatccatctggcttgtgattcaggccgatttggcacactctcccagaatacgtaaagtcgctgattttttagcggaaattgtttttcaaaaccaggggaagctttcaggacaaactggaattaattctgtgatattacctgattaagtgtaatcagccagaaatataaggaagaaggaaaagcgaccaaaggaacgcttttcctctgcctacttaaacaccataaatcattcagtgtcataataattaattttttattatagacatagccataacatcacaatattggccatttctcagggaagccttacgtaaaacaccttccttttcaaagccaaatttggtgtatagggctattgctttttcattatcggtaaaaacttccaactcaattctaaccgcagccagccaattaaaagcataatcaatcgcgaattccatcatttttgaaccaatacctttgccagaataatcagcatcaacactaatcccaactcctactacatgcctgcgtcttggattatccagagtaaataaactcaccttacccacaaccttaccgtctatctcagcaacaaaatggatagttcccctagttttattttccttaatacgttcccgccacatttcacgcgaagggcatggaagttgtaatgtattcggatacacatcggggtggctaaaaattcgttgaaagtgctcggcatcttctgactcagcggccctaattataatttccatatgaacctctttttcaacttgacccttttataactacctgataaaaaaataaatgtaaatagcatatttaaaatttatttaaataataacaaaagtatcgtcaaaattattcttacatacctgtctattctcggagccgtatatgcatcaaaaaaattcagctatttttgaattactcaaaaatctcgaaatcagcctgcataaagaaaaaagaaataatatcgattggctaaacactatcttgcatgatgattttctagaaatcgcaaaatcgggttatgtttattctaaaaaagtcgtaatcgatgaattaaccacagaatttaaaatggtcttgccaatattttcgcaggattttaacatcaaatggctggataaaaatattgcactgattacctatcaatcctacgaaataaataaatcaggccatccattcaataaagcgcttcgttcatctatttggcaattatctgtatccggtacatggcaacttaggttccatcagggaacaatcatggcagcccaaccgctcagcaatatcacgctgtaggtaaaaaaatggccctggatccgggccattgattaattaggattgatccttactcagcgataaaggcgagttctgcgttttttcacaatctggaacccgatcactaaaataatgaaccagactggtgtggcgattaatgcctgtcgggtatctggctgcaaggacagtaataccagtacaaaagcaaagaaagccaaacacagccatgacataacgatgccaaaaggcattttataaatagatgccttatgcagcgcagggcggcgtttccgataaaccaggtaggaacacaaaatcatgctccagataaacatgaacagagtagcagaaacggttgtcaccagtgtaaagacccgcatcacatcaggaataaaataaatcagaatgacgccaaaagagaggcataagcaggtaaagatcaatcccgatgcaggaaccgaacggcgggataaacgactaaactgcttcggtgcatccccttctttcgccaaaccaaataacatccggctagtagaaaaaaccccactgtttgccgaagatgccgcagaagtcagcactacaaaattcacaatgctggccgcagccggtagcccaatcaggacaaacagccccacaaacggacttttatccgtaacaaccgaacgccagggcgtgactgacataatcacaatcagagccagcacatagaatgtgataatccggatcggaatggcattaattgcttttggcagggatttcatcggatctttggtttctgcggcggcggttcccaccaattcaataccgacaaaagcaaatatcgcaatctgaaatccggcaaaaaacccactcagccccatcgggaacataccaccatcattccagacgttggataatgcagcagtatgccccgcaggagattgaaaatgggtgccaatcaaaataccgcctatgacaatcagagcaacaatcgcaacgattttgatcatggcaaaccagaattccagctctccgaacaattttaccgtcgcgagattcaatgtcagcaatatcaaaacgcacaatagcgaagttgcccactcaggaaagtcaggcgtccaataactgacataagaggtaatcgcgacaacatcagcaacgccagtaattacccagcaaaaccagtaagtccaacccacaaaaaaaccggcccacggccctagcaagtctgccgcaaaatcactgaacgatttatagtgcagattggagagtaatagctcgcccattgcgcgcataacaaaaaacaacataaatccgatgatcatatatacaaagatgatcgatggccccgcaagagagatggtcttgcctgatcccataaacagaccagtccctatagcaccaccaattgctataagctgtatatgtcgattagtgagacttctctgtagatgcgagccttcagtttcaggtgtgtgggtagattgtattttttcttccataattgtatcccatttattctcacagcatggagctagacttaatcccctcaggctgtgtttaagctatcattgtgacatagacagccaaggaattaacagagggatttcaattgaaaagagagatgctgacatttcaatctagggaatctccaaaaacttttcacagcgaccaaattgagtaaaatacagactgcgttgtattagattcatattatttcctgagattgacgataaaaggtgcgtcgttcaacaaacttgaatcaaggatttcccaccacagagattgctcggtgcggattttttcccattcgggatctttgcagagttttgacaccgcactgcggtactgtccccacgcggcttcgtcggcgaatgtaacgtaatgttccagacaatggacgttatcgccaatagtgcggacataccaacggcgttctccagtcatttctagtgtacggtagaaccattcgtcgcgtttttccacccaatgccaaaatgcggtcatatccaaatgggctttttgtgtcggtttcagtaaatacatcagatgcagcatcaggttctccttcaatcaagcagcgcccagtcgtgggtcaggtgtgtgccgaattgttgttggtaatgttggtaaaaaaggcggttatagtcttcacattcacttattgatagagggacggcattttcgaacagcaacagcgcggcgagcggctctatttttgcaccacgccgcgttttggctctaagggcggagatggacagccggcattcacggatcccgtttttcgccgcgtaatctaatgaggagtaatagttcagcacgaaataacggaagtcgttatcgtctatctgataattcgaaccgtaataacgggcatgaagggtttcaccaaaacggtagaagatggttacccccaggatctgctcatcgcgtttggctacagcagccaccgcggtgttgatgactgaggattttttttgtccatcaaatatgcgctgcatccagtcaataccttgatggctaccgtattttccccggttattagcaataagttctgccgccgcctccagtagataatcgtccagtcggcaccattccacccggtttcctaagcgggcaaaagcagccagttccgcgttggctcttaccctgtggtgggagcataattgttgtaattgcgaatcaagccccccggccggtaccgatagggtcgcttcccctgaatgcatcaatacccgagcatggggatagtaacgggcaacctcgagggcctgatgcagcggcataaaaggcataatcgttgcgtaatatccccgggtcccggccaactgggcaagcatttcagccatggtcgacaatgtttcaccccggcagctcccctgcacgcaggggatttcattgtgcgtggaacggcgggctccgccccacaagaaggggtattgccaaggaccgtccaatccggggaagtagtctggcagatagaacagcccggactgatcttcgccaccccagagtgcgcaaccgcctaacaatcccgcattgccgtacagtgtaaaaacgtctcccttgcccaaggcgtaatccagtccacctaaccagccgtgactgtgaaaaaagtcattatcggaaaccaacgcatcccactcatgccggtcgatatgctcaatgtcggaaactaaaggggagaaggcggactggccaacattgattaacatgcatccccccttatacattcaagaatggcggcatgcgggcattgaacgtaggatgaaagattcgggatcagggtattgaccggcacattcaacgatttccagtttaccgtctgaaaaccgacctgttgtagcgtattttccagtgtcggacgcgaccaatagtaggcctgtatattgatatcgtaaggtggctggcagatatgaagccgaagggcgctaccgtccgtgcgcggctgctcttcaatcagacgaaagccaaaggggcgataatattcgggatctgaattgaaatcagggtggatagggagtgtgagcagccgccctcctggttttaataccctggccatggtttggctcatcgccattaagtccgcgtagttagccgcataaggcatcacataaacagcaaggactatatcgaaatatacgttataatcttcattaatctttgaaatatagtgaattctgcgctggtctttttcctcacgtcggcgggcataactaagcatgccttcggaaatatcatagccgacaatgcgttttgtgccccgttcattcaaccaacgtgaaattacgccaggcccacacccgaaatccagaacatttaaactggagagatctccaagtaattttgctaacgttggaagctctaattcctggcgataaggccaagaagtcattctttcatagagttctgcgtacttatcaaacgtggccgggttaaatttaggtaaattagcctgtttttccctgacagataaagagtccgaagatggagctaaacgcataataattcaccaattactcgtgataatacaataaattaacagtttaatctcttacgacttcgcctatttttgctcaaggcaaatatggactggaaagagtaaaatctgtcggttctgtcgcattagcggaacatcggataagcgcctctgtttttgagcaaatccagaacgatgtccctgatccgaaacgcatttaaacgcctccattactctgtcgatatcatggcccaatgctgtcctacgctctgagcctgcgcaatctcgaggaaatgaggacggagcggggaattaaggttaatcacgataccgtattaattatgttatttaatgaatataaggaatgtcatcaggtgatatcattaaatttacttttttcaaagttattttactttcacgaaaacggcgacattccatcataaatttgtaattttttcatcatcatgtggtgaattgcactcttggttttccatactaattacatagttctcactataaataatttaatttaatttaatttaaatagaaatttcattttttattattttaataactatttatgatggttatccatataaaataaaattttctaataattatttaagtatcttcagagggttctgtcgcattaaggtgaggtcaggtaatatggttctgttgcattaacagagaaagtctgagtcaatgtggagttggtttgctttttattcagccaatcgataaaacatctctgccggtgacaatgtcatatcttcggattgtgagtattgtcctttacgcagcatcgaaacgagttctgtcctcaggggttacgcatgaaattttggtaggctaaaattgattaaataaccgcgcttccatgtagccattattccacccggctgatttccttcggacactcaaactcaacttacttatgattctgctataactcagcgatcacttgaagggaactcagtccggtttttgcgatctgattaatcgccaaatcaaaaaaatcccaaaatagactgagtgatgccaatcatagcacccataccccgaagtgaacgacgtcagatgaaaaaatttattcataaaacctgggataaagattatgcacgccgactcatggcactcttaatgttacatgaaggaaaaaccgtttctgccctctccagagcccttcattgttcacgtttttcggttaatcgttggataaattggtttacgttgtatgggctggaaggattaaaaagtttaccgtcaggaagacctgcgatctggaatttagcgccactttttttagtttgctgtcgttcttattacagcactccccgcagtattttggctgcctgcgttcacgttggagtattgagctgattacttggataatcagagagatattgtatggtacgtaacaatcttcaagatcaaaaaaatagtttatgaagcatatgatatgctttgtcacgcaaacccaaaatcatatattctgaattataagaaaatatttcgttgattataactctcatctaaatcttaaaacacatcaacaatttttaacccgcagtctcccgcgagttaatcattcctttactttgcctgtttacccatttcaacaccatccacctcattctgcttcaaattccacaccagctctgtcggcatctggacacggacgtctaattaatcttttaggagatcagccccacgaggtagcatcagccataagctgattcctcaaagattcattcctttaaccaatcaagggaatgggtaaagaaatattgactttaatttcaatcattgactaattattgaacgttattggattattgttaggtggagctaatattattaagcttattaatctttcgataataacgttacacgtggagagtaatatgaaaaaatatattctttctggcctactggcaggcgctacgcttttagtttcaatgcagtcttatgccctggcctgtaatatattccccccagatagcccagcatggaaagcttgcacggaaatctgcaaactgctaccccttggtattccaattccaatttgtttctaataacatcaagtaggacggttcattcttaccgtcctactcatagttcaccaacacagccccctaacatacttctgcaatcccagtatcatttgttctgggtggtacttgaggcctgtctcatccccaatatatcgccggaagtcactcatagtatgaagcagatagtggcgcatgtatttggtgatcgcagcaggaaaaaaatttactcaacgtattgagagaactaaattcacccttcgtattcggataaagaggctgaatttaaaaacggtaggctattccaaatcactatcaatttatatccacaccaaacttttgcataagcattctttttccttgctccgtcaatatcaattcacggctatctaattgtctaatcgcccattttttctgtaaaaatgtcttaaacaacgaggcacccagaaatccgccaatatgaaaatgccgttcactccaatcaaggcaagaacaggcaaatttacgccttgacgaggattcagcatcacaacacacgccaatagaaagcaaaaaatcgttccccctctgcgtcaattgataatcacgagtcatccaatggttcgtaagcagactgttatggatttttaccgcaatttcccctgccatatggtcatagcaggttcggaaaaaacgcagtgattttggtgtggaaattatggcgatattcctgtgattgcgattggcaaagtgcatcatgctttccagcaatgcagccacttcttcgctgtgaattttaaaataacgatgccgtccctgtttaacgcagatcaccagtttcccttctgccaatcgatttaaatgaacactggctgtcgaaggtgcaacatcagatgccgcacttaattccgttgcagtataagcgcgaccatccatcatcagaaacaacatacgggtacgagtgcgatctgcaagcaccgccgcaatcatcgcaacgctttcttcaaggttaaagtcattcatatttcgttaattaccgaagtaataatgaaaccagcaagatatcttagcgttttctgtccttcaaggagataatcatgttagctgttatatttgaggtcgaaatcgcagaaaaccaaagtgatcgctattttgataccgcagccacattcatatacaggatcttaagcaataacgcgttattttaggtagaaaaaaggcttcatttatgatctgataatcgtcgccaaactcatatcaaaaccacggatgaagcctgtgacgattatcgctataaaacaccagttaatgcaattcttcagtgacatttctttgcaacatattgccttccaatgtgcgtttatgaaacgcatcagaaatatcgagccccacgtgttgatcctcagccttatcgctgcactgagcacgggtaaaatcacgtctattgcccagttacaccaaaaatttaatggcctgtgcccggataaaaagcaaccagtcagttaccgccccttttataaccagctccgtaaagcggcttttgtcgaatttgtcaaaatattggtcagatttgccatggcgcaatgggtggagaaacaggtctcctcaccccaaaaactcatgaaatttaaacaggttattctccaagatgggagttcgttcaaagtccattctgccctggccgatgtttttccctatcgcttcaggacaacgggggccgcggtggaatgtcacatgacaatgtccttgctgactcagtcaccggtaaaaatgaccgtgaccgcagataccgcccctgagcgggcttacctgcctgtaccggcgatgttacgtgaccaattattattggccgatgccggttatgtcgactttgcgtattttgagcaagtgtcactttccggtggttcgtttattgtcaggggaagcatgatctgaccccaaaaagttagacatatattatatccccataatggattgagttctgtgctcaaccggactcaatccattcaatttaattttgattccgtcatgattatagtaataaatataatcggttatcgtcttttccaactcatcgattgagctaaattccactccgtgataacactcagatttcaatattccaaaaaaactctccatagcggcattatctaaacagttacctttgcgagacatgctttgtatgagcccgttttctgttatttggttctgataatgaatcatctggtactgccaacccgggtcggaatgaatcaggggtttctcatgtgatttcagcttttccattgcatcagataacatatttttaaccaaatcaaagaccggcttacgggaagttcggaaagcaactatttctctattaaagagatccatcatgggtgacaggtacagcttttccccccggtggttaaattctgtgacatctgtcacccatttcatattaggctgttctgcttcaaattgacggtgcaagagattatccgcaacagagccggtttctcttttgtatgaatagtattttttagcccttatccgcgatttcagccccatcgtctgcattaaccgctgcacgcatttatgatttaaatgaatctgttgttttctcagtgctaacgttatccgtctgtacccgtaccgacctttatgctgatgataaatatcatagatatggatttttacatcagcatatttatctttttgctgagtctttttctggtggtagtaggatgtactgcgtgatatctctgcaaccttcagtaaagttttcagcgggaaaaattgcctcaattcggtgataatttttgtttttgctgatatgtgtttttttccttccgaattaaggcggtgagcttttttagataggcgttctccgcccgtaaataagctaactcatccaaaagttcagggggcgattttgcgctttttgtggactccggtttatattgggtggcagcgttgcgcgtacatgcttttctgctccttttgcggggcttcagtagctcaatgcccccttttctgtacaaagccaaccatcgagatatcatccctgtatctttcagtttaaagcgtttcatggcttcagataatgaaagtccttcgtgttggatggtcagtacgacatgctttttaaattcaaaagaataagacctgttcaatgattttttcagtccatgctcaccatgaacgcgataaatatcaatccacttgtttaccaaattacgatgcagtccgaaaagtgatgcggttcgactgtatccgcaatctgggtgtgataagtagtgcagaaccactttcagcttgaatgtctgagaatatcttttcttcttcataaaaagcaccccttaagttgaagtatagcgtccaacttttggggtgcagatcagcaagtcccttaatcctcagatagtggtggcccgcaatggtcaggggaaattattgtccaagctgctcaataagccgctgaaatccatcactcgccgaaccaaccgttccgaagtgctggatctgatttgtcggcgtaatggctatgaatttcgcttaattcgtcgctggtttgccgaagaaaaacgcttttgtctctggttgagcaacttgtccgtgaaagaatttacggctaatgacatcatggatatttatcgttgccgctggcaagtagaactgctgttcaaagagttaaaatcacacacaaactggcatcgatttgccacgagaaaagaaacgttagtcacgggcctcatttggctgagtttgctggctctgttgctcagacgttcgctggccagcagattattccccgccgtttcattgctcaaagcagcccaaaatacggaagtctggctgtggcccataatcgaaaacctactccaacgggcgtggtcggaaacctgtttttggctggaaaaagcccaagcgtatttatgtcagaacgcgttcaaaacaccacaaagaaaatcatgtaagtacaagacattggatgcgtgttttgaaaggcttaatgcttaagagcctgtatatgagttgatactacaacatgtagattgcctttcagggcaatctactctatcgcttattaattggcttattgcgaccattactacttacagataatcaacacgttggagacgtcatcaatctatattataagaattgtttttatacttgtattaagtcatgtatttctttttattttggtaagataattgctttagaaccgtggagcacatccctattgtcactttcatgccgagatgtgaaattacctattttttcttctagaaaatcaaaccattttctgcctaggttatctataaattcaacaaatgaaacttcagctctattgctataattaggtgaccaaattaactgtggttcattcgaattagaaatctctatatatctgtttaaagtcatatatacaaagcaatctattgatgaataagaatgtaacagagcatcacaagctatatcctgaactaagttaggtggaaccccagtaaatccatcattaacaaagaataaaaccccataagcttcgggagcatggaagtgtttttttgtttctttaatctgtgtgttagctttttttaaaatccttgttattcctggtctgaataatcttataagttcacttttaaaccattctgggtagaagttcccttccttaagagttgattcccaatctggacattcttcccgaagtttctccatcattattccgaatttttttttcgctcctttttgattaagaaattcagtctcaacttctttcaattcaccaaatacgccattctctttaaatgaataatcagcgtttttaaaatcaggatttcccggcaatgcatcagaaataacagacccaccatatcctcgaacgaacgcatgaaaggtatgttcaacaggtaaaggtgagtgtgggccaatatcccaaaagttttcatacttgttcatattgatatctacctaatagttacattttcacaacacatgacatggtaaaatagcacacaatggaatattacaaccataaggattctctctgtcagcatagttgcattcattgtcaatagagcgcttaaaaaatctctcttccggtacttgttttgtctccaagacatgatttattttccccgtagttaatataccaaaggtcaaattttggactttatgatgttgatgtcggtagctgatcgtctcaaattgcgactaatacatgtaaataatctttcatcaactcatcgagcgctcgtcatcaatattctgaataactgtaaagtcagtaaatctgtaaataacagagttagggttgactattatttaatctattttataaatattgaaaatttatggggggtcggaaaagcgttacaaacgttacaaaattaaaatagtcttttatcttattgattattaataaaaatatagaaacctaaaaacgttacaaaagcattactttgccgttacgtgtaacggttctgaaaggttacaaatcaaaaatataacctattgatttataagggtgtaatgttttactccctgttttgtaatgctttgtaacggttaaaacgttacatgagaattgtttatcatcagtaggttatagggtgtttttgggggttgtaacgcttttccgaaggggtcaggtaaatcagcaatcaaattcaggcataacgcaggtaatacactgctattgtgagggtgtgatctgtcacgaataacgataaaacccgctgttaccgtgcgggttgtttatttttatgacttcataattgacttcactctttctcttcattaatatgacttcattatttgaagtcgtggtgtattggaatatgaacaaacagatttccgcgctccgaacgaggcaacaacgtaccttagaacaaatttttaaaacgccggtatcgtcgggaattaaatggtcagatattgaatcgttaatcaaggcattgggcggtgaaatcaaggaaggtcggggttcgcgttgtaaatttttgctgaatgggagtattgccaattttcatcgcccccatccgtcacccgacacagacaaaggggctgtggcgggattacgggaatggttggaaagtataggagtcacaccatcatgagtaagcaaaatacgaatattatggagatcgccggactctcggcggtgattagttatgtccctgaactcggtatgtttcgggggaagtttttagggttatccggttattgtgattttgtggctgacagtattgctgggctgcatgctgaaggacgattgtctttgaatgaatatctagaagactgccgttccgccaatatcgagccttatcagaaacgtgaaaaaacaaaaacgtttactttacgttatcccgaatcgtttggcgaacggttaaatcaggctgcaaccgaacaccatatttcggtcaacgcgttcattttggagacattgggtgagcgcctgagaaacatctaatcagtaagataatggcatgattgacgatccatgcgttgttgcacctaaagccatttttctttcatccacaaataaggcgggattatattacccgcctcttggtgttaagtttcagcttaaaaaccgtcaaattcatccagttcttttttcatgttaacgcccttacctatcgtgcagcttcactgaatggcgagtcatgatgaaaacttatctcacagagcatctgccgtcaaataccggtgttttttgcctgtaaaatcgcatcacaattttgcgtaaaattgcacaatttttcccggcataactaccccgcccaaggccagtgcgggcaaggtctccgcgccgatgcacaactgcacaaaaacacgccctttttgtgtgcgggcgaggcgggggagcaagcgcccgcaatgggggcggatggacgcgtttaatcaccattgtgaagcattgctaagactctatttctcaaatactggttttggtctataccgagagttagcacgttactcatttattcctcctacactctgtattaacgtaatcctgcaaatatttcagttttgcccggtcgttgatgatgtcttctcggatatcgagaacagttgatccagtttctccagagagttcgacggtggttgcatcgaccatgctgcgggaggaagtagtttcagacacgggacagatggctttgatgcgcaacttgcgacggccagcggcaacatcagcccgaagagtgtcaatttcagtcttggcattggcgagtaccctacgccgagtcaggccgttcatcaccttaccagccgccttattccatcggggaaattctgacgctgcacctgcataatcaccggcattgattttctttagcaaagtagaaccggagaaattgccggtaccgcaattgaagataaaggagcacagagcatcaaactagccttgagtcagtagcatcttaaccaatcgctccagtgtggcgtaagcgggtatgaggtcatcatgcaagaaagcttcggcctgctgctctgtgattacttgaccgggcttcacatctttcgtatggccataaccaatcgtccacgggatgccacctgttgccgggtcagggtaggctttcagctttagtccttcccattgctggatgaattccagtcctttattgctgattttcatcagaggataactggatgcctccccgagtgtttcgtgggaggtctgcgtacgaattcaagcacccagatggtcgcacaatacgtctatgtgctctgatcgtcgataaatccgttgtatggaaccattatgagcagttagtgaacgaagaaaaagccacgtttacttacggatcactggtagatgattttttacattcagcggattttattgagctggcaaaagatacgcagagtgactatcggaagtattcaaaaaaggtcgttccggttttcggcaagatgaacccaaacaacattagacccgatcatatccgaaaatacatggataagagaggattacagagcagaacacaggctaacagggaaaaatcttttatgtcgagggtgttccgctggggatacgaacgcggattggtgaagaaaaacccatgtcagggtgttaaacagtaccgagaaaactcacgggaacgctatatcacagatgcagagtatcaagcgctttatgaagtatcccctactgttattcaggttgcaatggagatcgcttacctttgttgtgcaaggcaaaaagatattttagcactgagtaaatcccaactcatggaagcaggaatttatatcaaacagcacaagacagggaaaagtcagataaagggatggtctgaacgattaaggaaagctatcaagctggctaattctttgccactgaaagaaggcctgcacagcctgtatgtcatccaccaagccaacggtaagatatattccagagatggatttaatagccgctggctcaaagccaaagaaattgccgcacagaaatatcctgaattacgtttcaactttacctttcacgatttgaaagcaaaaggcatctctgatctggaaggaacgctacaagaaaaacaagctatttcaggccacaaagatatcggtcagacagctaggtatgacagaaaaactgaaattgttcccgtggtaggtaatcagaaaaaatgactggctattcaatgaaaggaaattatcttttgaaaatgttctgaaaggtgatttgagtcataaaaaaagccacctttacggtggctctttcttaacgctaactcgctgatactaaagcaagtttttatttggtcaggacgggactggaaaataaaaataacttattgaataaattacatttatttttaactaatttctttagtgcccctttttatgccccctaaatattttgttaccttccactgtattaatctatttccttcgtcgttatctgatatccccataatcaatgaagtgaggtcaatacactaaatgtactgagctaatgactgacgacgaatatcgtattcagtgagtaggttggtacgtttaacgttccgagctatagaagtcgcgacgaatttcgtcggaacctattgagtgattgagctgacagctaactgatagcccttccagtaagaagcctttcccataacagtgatcgcctgacctttctgtaacagcatcaccgagagcgccatctcattaaagcaatggcactcaatgggtaatcactgcgcttttacatagtagcgttacctgtctggcactttatacgcttggaggcaacggtaatcttccctgtaactgtggtgactatcgaggggcattcttctgtcttcgtgctattttccacagcctttaggtgatctggttttttcatcatgataaaaatcaatcaattatacgaaaatgacccactgcgaacgtaatacgtactcagtcactcagttacattaagtaaccttgtgctggacggcttaaactcaagccctcctgtattgtgattttcacaatacagatttagcgaatttattcaaaaatcacgcctcagcgaaaaaaacgcaaaataactgcgctatatctgtaccacgcacacgggataaatgaccaattgcaactattacgatttccgtgatggttgattaactcattgatttgtccgaggtggtcactttgaccacccgagacatatcttccgtaaattcgtctttatttcaacggttgggaaaatcccaatggttactttatgtgctggacaaaacgaattaaccccttgtttttgactcactcttttgtccacacctcttattgagttgtgcaaattttgtgcgtaaatatcatttacgctcaccgtcatttgcgagtaactatcagttacgtacaaagtccgattatcagatattgggttttgcataccgacattatcgtcgctcaaattataagcagatcccagaattcgaggtctgcttaaatatcaatatcttaccaccaaatcccgaattagggctttgctctgccgtcagatttgtcgttagtcattaagttacatgagggaaaatcccgtatgtacaaaagcatcaactgcaaaaaattttcagttgtgagaatcccacatgagcagttgaaaataatcaccatgtatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtatacatctgatgtttttatcattttaatgataatttaaaaaacatttttccacttgataacatattttcgtcttctctataaaaacaggttatacgattttctttgctcaataagaagtagaacagagcacctgagggattcctcaggtgctcacgatcatataacagaaaaaccaaattcacgaacaagaaaggaaaattcaccctacgatgttaaactgcaattccccttccaattcttcttcggcttcttcaaacagtaaaactaaagccgcaaaatacactcgtttttgcgacgaaaagtggataaaactaatctcaaccggcaacccaatgccccccgttaccgcatcccacagggcgtccaagtttgcaccaaaatgatcaccaatatcgaaactctccttaaattcgcaatagaaggtttctacgtcagggatacggtcaaaatcaaattccacttttttcatatcatcactccaattttttaaacgtgttgtaatgatccactgtcagatagatcaggccatcattagaatagagcaatctatcactgcctcggtgcccacagctataattcacatccgcttcaaaccactggcgatcacgttttttcggtagcttattttcacgattggaaaaccgatctccgccaatcgccgtattcggcgagacttggcataaattgcctttacgggcatcccaaccaagattacgtgcctgtgccttcgtgaggtaataatcgggaagtctgctattgttatgttcgcggagatactgcgcaacacgtttcggtttagtcagaacgccaatcggttcagaagatacgctctccaatacctctgtattttgctgtgatttttctgcgccaaccgactcagagccttgggcaaaagtgatagatacaaaagccaaaatcaataagatacctgctagtatgctctttttcataatgacctcacgtttagtttattattatatcactcaacaaattatcaagcggttccccccacggtcagattatccagtttcaatgttggctgcccgacacccactggtacactctgtccttctttaccacacactccgacacccttatcaagagccaaatcattaccaaccatcgatattttttgcatagcttcaatgcctgaaccaatcagtgtggcacctttcaccggtttggtaattttgccgttttcaatcaaataagcttccgatgttgagaatacaaattttccggaagtgatatccacctgaccaccaccgaaattcggtgcatacagaccactatcaacactggcgataatttcttccggtgtagattttcccgccaacatataagtgttggtcattcgcggcatcggcaggtgtgcataggattcacggcgaccgttaccggtcggagccacacccatcaagcgcgcattaagcttgtcctgcatgtaacctttcagaatgccgttttcaatcagtacattgtactgccccggtacgccctcatcatcaacagataatgaaccacgacgcccttcgatcgtgccatcatcgaccacggtacacagttcagaggcaacttgctccccgatctggccggagaagaccgaagtaccacgacggttaaaatcgccttccaaaccgtgacccactgcttcatgcagtaaaacacccggccagccagcgcccagtacgacgggcattgtgcccgcaggagccgcaacagcagaaaggttgaccagtgccatacgaaccgcttcacgggcaaactgttctgccagaacctctccgtcagccgtttgcaggaagtattcgtagccataacgcgcccctcctccgctggaaccatgttcacgcttgccatcttcttcaaccagtacgctgacagagagacgtactaatgggcgaatatctgcggccaacgtaccatcagtcgccgcgaccagcatttgttcataaacccctgtcaggctggcattcacttcctgtacacggggatcttcagcacgcgcaatctgatcaacccggtgtagcaaggcaattttttcttcccggctcatactctgcaaggggtctattgctgggtacagccctttatgtgtcaccgcccccaatgtacgcacggtaccattacccgcttcccgtacgatactgcgtgctgcctgagcactttgttgcaaggcattcagcgtgatttgatccgcataggcaaagccggttttttctccactgatcgctcgaactcctacaccttgatcgatattataggagccatccttaataatgcggtcttccaaaatccatgcttcgtggtagctagattgaaagtagagatcggcgtaatccagacggcgctctgccaattgtcccaatacagaaaataaatcctggtgattcaggttattagcagccagtaaatagtcactgacaaaagttaaactcatagtaattactcttttaccttaatttgtattcttttttatcaaagaagtcagttgtggacggaatcgattatgtttcgcgactttgatctgctcacgcatgtgagtcaaactatcccgccggatgttgagctgtaatgcactgacggtcagaggatttttcttgataacttccccccagccactcaccgccattgaatgcccccatgttctgcgagtaccatgcaccccaacctgtgcgggtgccagaatgatgcactggttctcgattgcccgtgctctcaggagaggttcccagtgtgccttacctgtcagacgggtgaaagcagcaggaacagatatcaattccgccccctgttcacgcagtgcctgaaacagtccaggaaagcgcagatcatagcagatagccatccccaaacggccaacaggcgtatcgacaacggtaatgtgctccccgggctgataaacagaggattcactgtaggcaccatgttcatcgttgatattgacatcaaacatgtggattttgtcatagcgtgcacggatttccccttgatcatcaaacaacaggctgctgctcgtgatgcgagtcggatcttcccggctgatcatcggcattgaaccaatcagcaaccagacaccataacgctgtgctatttcactcacagcctgctgtaatgggccacttccctgttcttctgcatacttgcgataggtatcagcgtctgcaaacagtaacgcattttccggggtcagaaccaattttaccgtatccggcagttgtttaatctgctgttcaacttgcgctaaattatgtttgatgttcgcaccactgcataattgtaaaagtgcaacattgacgtttttcatgaccctttattctccttaagctgacgtaaaacttcatcaattttaggttgttcgaagctccccgtgagccggtagcgaatgaccgatattttactccacagaggtcccaacacttttgtcgctgcaaaaacagcagcacctgccacaggattaaccgcaaaagccgtcgccacaccaaccgttgtcgagatttccggtgtaatcaccaactccatattgatttgtcgacgaaccaagtctgtctgaccttctgcatcgatgtccgccgccagcccatcaatatggaagttttcggtatacatgacgccattttttatcgttgtgtcaccacgaatggaatcaaagttgaaatcattactgaatgtgtcactgaaatccaattgtaatttacgcagcaatgaatcaaaactgatcagtcttaataattgccccgcccggccaccacccaatttggctatagcgccttttttcgtctcacccgtcagtgtaccatttaacgttttaatctcaggattccacggagtcccccgccaacccagatcgaaatcaaatttaaacggcgcatcgactattgggacaataaaccccagataagccgccatctcatcgaatctttgtcccgataattgccctttgacctgagtataatttccaatatcgttttccccccagcgcccagacaatgtcaatttacctgcacggttctccagtcgtccatttgtcaaaaccagtgaatcaccttccggcatcaccgttccggatactttgccgagtttcagcccggcaacccagcactctgcacacttaacattcagtgacggccaatggcgcaagccgtattttttggcctctgaggtgtctgacgttaacgtattggagccagccgatgaatcttcaggaaattgcggatcataataaaggtaatcgattgaggcttgccacggctcatgacggtaaatcaacagattacctttgagcttttctcccgtcgcgctgaccttcatgccatcggcctgttgaacaatattgaagacgagttgattccagcgctgaccgccaatcttcagtgacggcatggaaatttcgaacattttcggccataacaggccatcattttctgatgagccagacatcaatggcgctatcagcggcaaccacttttcgccatcaatctcaggcagatttaacgccagcagcggcttctcgggtagtatggggatgccattaccctcgctatttataataccgcgttgcagtcgggcatgcgtttttcccaattgccattgggtattgaacgcatattgttttcccagtgaacctttaatctgcatttggttcgtgttcccctcagcaagaacatcaataccctgccattcccgtagcaacccggtgtccaatgcagccaatttactgttgatatgtgacaaatctgcattgatcgaaacacggtatttcacgccattttgttgctgtttagtgtgtgaagatgtgttttgtgcaggtatagcgatgttcactttcccctgccaatccaacgttcctgatagttgacggcgaatttcggcgggaacttccggtaatttcccggcagcccactgcgcattcagatctacatccacctgataatgtttcggtaaatcctgcgtggtaaaccgtagggacagaggatgtcccaaccactgagcggataatgtatcactttgcagtttgccattatcaaagcgaaatttcccactcacatgttccattttgctatccaatggcttgatgaacagtgtggtatcttgcaatacgacctctccactcgcattgactttgccatcctctaagggaatatccagatggagcttaccatcaactttgccatcgagttgcaactcatccagcgtactgccgatagactccgccaatgggctgtgtttaaaataatcgtggatatttttaccactccccgataatttgccatcaatcaagagcttattttttccataatcggggatcacagcggtcagttgagtggcatcgacttttcccaacttcgctttcggtacctgcatccacaatccgttattttggaaattcagatcgatatcaaaatcaaacaaggcaggccagtcaggttgatattgaaaggttgcatggcgcaaaggaacccaaacctgaaattggccattgttctgcttaaacgggaaatcgtggggattgccttgaaagagcagagtggcattctcgatctttcctttaatcagggagtgggtcaaatagtccgccaatgatgctcccatcagtgacctgggaaaataacgccatgcctctcccgcatcatcaacacgaattccagcgagcatttccagcacaggcggctcattcttgggtaacaaatagttaaaagccccattgaaccataatgatttggcctgtaaatccagatcccgcccccacactttcaacccatgacggtcatttctccaggtaaaatgacctttactactcgtaatgtcgaatggtgtctgaaacaagctacgataatcaacggtactgtttttcagctcaaatttcagatttccccactgcttactgccactcagcgttccactgaaatggttgacagaaggcagatcctgccagcgtaaccagctaacatcctgccatttgatggcaattcccattgagctatccggtaattcaggcgtaatatcaagggcaaagtggttgagtattcctttcagctgccgatgctgccaacctttgacaacattcggggttacagaagagaataatggcaatattccatttagacgttcaagttgaatattttcagcacggagacgccagtgatcttttccttggtatttgtccgcctgcatgacatacagtgccgcaatacgtcctactggccactgctgaccattggttttcagatttgccagatttgggatattaaacagccagccttctccctgccggcacatttgcagaatgaggtcattgaccgcaagctggtgtttttcactaccaacataccagttggcttctccctgcttcagttgcagacgcccgctgtcaattcttccccctttcagggtaatccagctcgccagactgaaacggctgctttccagccctgtgttatctcttaaccaacggcttaaccacaaccgcatatcaatatcatcagcctgtaaataaataaccccattatccagaaccccattaatatctttcaggtcaaatttcacctgaacaacgccttcctgaccattaatcgaagaaagattgacgcttccctgtgctcgatggcgatcgtctttattcagccatgtcagttgtggcagtatcagttgtgctttttcacctgatggcgtctggaaggtcaagcggctgtcatacaaatcaaaatgattcagttgttcaagaacaaaggaagagaggctgtctggctcagaaagtagattttcatttttcccgctagacaggggcttaacataattgacttccagttgataaaaagacaagtcacggaaatgccagcgccattgtaaaagcgaacgccagacattcagggaaagcgttacctttttagcctgaaaactcgcatcctttgttttggcgctgatatcacggatttccaaactggggccaaatgactcccaatggccgttgatataacctatatggataggtatatccgtcacggcagcaattttttccgccacttgctgacgataatcattgatatgtggcaggaaaaaacgtaacccgctgacaagcaaagccacaatgataacgactattgcggctgtcgctaataatatccccggcagtcgcctcacgcatttctccttggttgtcagcgttatttctctgcaaacccggtggttttacatcatcacaacgtcaaattgctcctgactgtagagttgttctgtctgtaccttaacctgtttgcccacaaaaatttccacctcagccaaggcgtgagattcatcccctttcaggacttcgctcacagcaggagaggcataaaccagaaaacgatctgcatcaatgaggcgatgaacacgcacaatctcacgcagaatttcataacataccgtttcaacggattttaccgtgccacgtccctgacaagtcgggcagttatcacataaaatatgttcgatactttcccgtgtccgcttgcgggtcatttccaccagaccaagctgggaaaaaccattaatggttgttttcacccggtctttgctcaatgcctgttctaaagaagccagcacacggcgacggtgttcttcattacccatatcgataaaatcaatgataatgatcccacctaaattacgcagccttagctgacgggcaatcgactgagtggcttcaatattagtattaaagatcgtttcttccagattacgatgcccgacaaaagcgccagtattaatatctattgtcgtcatggcttccgtttgatcaataatcagataaccacccgactttaattctactttacgttccagcgcgcgctgaatttcattttcaacatcataaatatcgaatataggctggtttccctgataaagctccaacttggcgttcatttcaggaatatattcgtcgatgaattcctgtaattgaaggaatgtctgacgggaatcaacccgaatacgattaaggggagcgcccgcaaaatcacgcagaacacgctgtgccagtgccagttcaccgtatactttatttttggtgatattacgtttcttacgttcaatcactttaccccacaggcgctgcaaaaatgcggcatcctgtacgagctcttctgctcctataccttcggcggccgtacggataataaacccaccatgctcattacagtaatccatcacgatggatttcaggcggtcgcgttcttcttcactctctatccgctgtgaaacaccaacatgagaggctcccggcataaacaccagataacgggatggcagggtaatatctgtcgtcaatcgggcaccttttgtgccgaggggatctttcaccacctgcacgatcaaatcctgcccttgatgaaccaactcggctatatctctgacttggaaattcttcttctcttcacccgcaatacattcggtgtgaggcacaatatccgaagcatgaagaaaggcggctttctccagcccgatatcaacaaaagccgcctgcattccgggcagaacccggctcacccgacctttgtaaatatttccggcaatgcctcttctcgcttcccgttcaacatgtatttcctgcaaaataccgccatcaatataagcaacccgcgtttcggatggcgtgatattgactaataactctgctgtcatgaataatgcttcccatcagctaatactaaaaatcgtgtgattaattcacatgtttccaccagtggtaagccgacaacagcatggtaactgccattaatttttctgacaaaacaaccgcccttaccctgaatgccataagcgccggctttatccatcggctccccagttgcaatatattcctgtatttcctgttgggataactggcggaatatcacatctgtaatgactatctcactcagggtgtgctgactgttcgataaagctacagccgtcataacttgatgactctgtccggacaaagcactcaatatttcagcagcatgttgtggattacgcggtttttccagaatacggttattcaatacaacaatagtatccgcacccagaacaggaaagtcattcggtgctattgccacgcccgcctgtgctttttctctggccagtcggctgacatattgctgcggtgattccccttcctgccatttttcttcgacctgtggtgtcagaatctcaaaattaaaatctaacattcccaccagctcacgtcgccttggtgagccagaagctaaataaagggttttcatcgtgagtcatccttaaagcatattgcattggaggctattaatatcagtccatttaaaaacaggaaactgcctttaacgaactgaaaattgacgacggattttccgcattaataagaatagccaaggccagagaataccattgaccaggccattccagaacacttctggatggaaaagcgtctttggtatcaaagcatgagccagaaaaatacagagattcatcagcgttgaaagcgccacgacaaccagtgcttgctgccagagcgccatattacgaattaactgaaatttgaacaccaccagaaaactaatgatgctgaaagccaaagcatgtgcaccgagaacactgccttgtaataagtcagtaatgatgcccaatacaaagcccgtacccacactgacgcgatgagggatcgcaagcagccagtaaattaagcacagcaccagcaaggtaggccggaacatatagaactgctccggccacggcataatctgcaatacgattgcaatcaggaaagataaccagatgacccagcgccctcgactacgatattgattcattgacgatttcctgtagctgaagacgagggctttgttacagacagtgttttattcccctctatattgcctttttttccttcacctgaatcctgcgtcggaagctgcggtttttcttcaagtggattcggcagtacctcaggtaacatctgcatcaagcgttcatttgctgcgcgatgtactgcggaaggcggcaacggttccgacggatcgttatctgatccccacaacaacagcagatagcgcaggcgtcgtaattcagccagtgggcgtgcacgaatgaccacatgagcccgctgattgtctattttgacggaagacaccaccgctaccggatacccttcgggaaaacgcccacccagacccgatgtcaccagtacgtcaccaacacgaatgtcggtatcacttgccatcggctccagatgcagatcttccgtacatccggctccggcggcaatcatacggagatcattgcgcatgacctgaacaggcaacccatgagtcggatcacaaattaacaatacccgactgctcaaatgactcactgaaatgacttgaccagcaaccccccgatcactgatgacagcctgcccttcatacacgccatctttagcccccttatcaatgactatctgatctcgataaggatcaatgccacccgaaatcacctgcgataccatcatgtgttcatcacgacgcaccggtgatcccagtaattcacgcagacgggagttttcatgtttcagttgccccagcaagagaagtttgctgctctgtaaccgcagctcattgcgtagggtattattctccatctcaagatgcttacgggtagccagagattcagagatgccatccagaaattggcgtggcccattggccagaaaataaaaaggactgactgccgtatccatatagctacggactttattaaaaaaaccgaaacggctgtctaccacaaccagaataatggcaataataacagctaaaaagagtcgtacttgcagagaagatccactgctgaaaatcggcttcataaattgcgcattgttaagctgtgttgtgtcataaacgatcaaactcccgaacaaacagcaaggaggccccgataacacataaccgccccccagctcgcagagttacgttcagtcttcgctgaacagatcaccaccatgcatgtcgatcatttccaacgccttgccgccaccccgggcaacacaggtcagaggatcttcagctacaatgacaggaatgcctgtttcttccatcagcaggcgatcaagattacgcagcagcgcaccaccccccgtcagaaccatgcctcgctccgaaatatcagaagccagttctggcggacactgttccagtgcgaccataactgcgctgacgataccggtcaggggttcctgtaaggcttcaaggatttcattggaattcagggtgaagccacgcggtacaccttcggcaaggttacggccacgtacttcgatttcatggacttcatccgttggataagcagaaccaattccatgtttgatacgttctgcggttgcttccccaatcagggaaccataattgcggcgaacataattgataatcgcttcatcaaagcgatccccgccgatacggacagaagaggaataaacaacgccattgagggaaataactgcaacttcagtcgtaccaccaccaatgtccacaaccattgagccagttgcttcagaaacaggcagaccggcaccaattgctgccgccattggctcttcaatcagaaagacttcccgtgcccccgcgctctgggcagattcacgaatagcacgacgttcaacctgagttgccccaacaggtacacagaccagtacgcgtgggcttgggcgcatgaaactgttgttgtgaacctgtttgataaaatgctgcaacattttttccgtgacataaaaatcggcaataaccccatccttcatcggacggatagctgcgatattacccggagtacgccccagcatttgttttgctgccgaccctacagcggcaacactttttggtgaaccggctctgtcctgacggatagcaacgacagaaggttcatcgagtacaattccctgacccttgacataaataagggtattggcagtacccaagtcaatggacaaatcgttggaaaacatgccacgaaatttctttaacataacgaaaggataatcctgcaagctggggacggatattgtccgtctactctaccaaccacatgaagcagcgacaaggcgcatcactaactacttttactacttcaataaaagtggctacgttattattcatatcagacacacaatattctacgttacttttctctaacggagcagaaaaaaactgcataaaaacgggttaatttcaccgataacctcatcactatgccctaaaatgatcaaatgcctcaaaaaccaacattatagtgcatatcgcgatacaactacccccgattttactgcttctatgttgacctgtaatcacttctgcaagttcaaccaaaacgtgttttttctcaacattctgacctccccggatagtgcattgtcaaaaagaacgtcaccatcaacggtaataggtaaaaataaggattattctgagcaaatcaataatgtcattttcctgattgttaccctgtgcatttgatcttttacattgtcatcttgaacaaaaataaataatcccggttttgccactctccatcacaatattgctgctcgtccgtttcagcactttcaattttatctatattgtgatgatgtcaaaatggtgatggtgtcggatataaaaaccccatcaagagagaataatgatgaaagccttattacttgaacaacacgagacattatcagcctctattcaaaatattgatacctcgcaactgccctctggcgatgtcgttgtagatatccactggtcaacactcaattacaaagatgcccttgctattactgggaaaggcaaaattatccgtcaatttccgatggtgccgggagtcgatttttctggtgttgtccatcattctgaaaatccccgctttcatatcggccaacacgttttgctgacgggctggggcgtaggtgaaaatcactggggcgggctggcagaacaggccagagtttctggtgaatggctgacaccgttgccacagggattaagcgccagacaagccatgatcatcggcacagccggttttaccgccatgttatgtatcatggcgctggagcaaggaggagtgacaccggaaagtggagaaattgctgttactggtgccggtggaggggtcggcagcacagcaattaccctgctgtcacaactgggatattccgtcgtcgccatcagcagcaaaaccgaaaaccaagattatttactttcactgggtgcaaagacgatcctgcctgtcactgattttaatcagccatcgcgttcgctggagaaacagcgctgggccggcgtcattgataccatcggtggcacagtactggcaaccctgctggcacaggtgcattacaacggcaccgtcgctgcttgtggcatggcgagtgacagccaactgtccacgacagtgatgccgtttattctgcgcaatgttcgcttacagggtatttcatcagtcaccgtgcctgccgtaaaacgctctgatatttggcaaaggttacagaaattattacctgacgccttttatcaacaggccaccactgaaatttcattagatcaagtggtcgaatacgccaataaactgataaacaaccaaatgactggcagaacgttggtaaaggtagctgataagaccagtatttagctgctaaatgccacgatatgtttataatgtcgggctttatcgccaaatttacaaataatggtagcagaaaaagatgacaaaccgttgacatcgagttatcttggtcgattgttgacagattgccggagatacccgcacaatggcagacaagtttcgcattttactcttgaatggccccaacctgaacctgttgggaacgcgagagccagagacctacggcaagttaacgcttgatgatatcgtcagcaaactgtcaaaagaagctcaccaatcgggagtcgaattatcccatctgcaatccaatgcagaatctgaattgattgagagaattcatacggcgcggggcgataccgattttattctgattaaccctgcggcattcacacataccagcgtggcactacgcgacgcacttctagcggttgatatcccatttattgagattcacctctccaatgtgcatgcccgcgagccattccgccatcactcatatctttctgatattgccgttggcgtgatctgcggattgagtgccgatggttatagtttcgcattacaggcagcggtcaaccgcttgtcaacattcaactcatttacctaagagtacggaaccacattcatggatattcgtaaaataaaaaaattgatcgagctggttgaagaatccggcatttctgaactggaaatttctgaaggtgaagaatcagtacgtatcagccgtatagcagcagcccagcacatgccaatgactcagcaatatatttcagcgcctgttcaacagtcagtgcaagccgccacaccagccattcctgctgctgaaaaaccagcggaaattatcggtcataccgtctgctccccaatggtcggcacgttctaccgctcaccaagtccagatgcaaaagctttcatcgaaattggccagcgtgttaatcagggcgataccctgtgcatcgttgaagcaatgaaaatgatgaaccaaatcgaagctgacaaaaccggcgtggttagagcaattctggcacaagacggtcaacctgttgaatttgacgagccactggtcgtcatcgaataacgaggcgttccatgcttgagaaaattgtcattgctaaccgtggtgaaattgcactgcgtatcctgagagcctgtaaagagcttgggatcaaaaccgttgcggtgcactctacggcagatcgtgatctgaaacacgtcttgctggcggatgaaaccgtctgtatcggtcctgcggcatcagcaaaaagttatctgaacattcctgccattatttctgcggcagaaattacctgtgctcaggcaatccatcccggttatggcttcctgtctgaaaacgccgattttgctgaacaagtagaacgttctggttttgttttcattggccctaaagcagaaaccatccgcttgatgggggataaagtctccgccattaacgcgatgaaaacagccggtgttccctgtgttcccggttctgacggctcattagggaatgataccgagaaaaataaagccattgcgaaacgcattggctatccggtgatcatcaaggcatcaggtggtggtggtggtcgcggtatgcgcgttgtacgcagcgacaaagatctggaacaatccatcgctatgacccgtgcagaagccaaggccgctttcaacaatgacatggtatacatggagaaattccttgagaacccacgtcacgttgaaattcaggtactggcagatggtcagggtcatgctctctatctggctgaacgtgactgctccatgcagcgccgtcaccagaaagtggtagaggaagcacctgcaccgggtatttcagcagaattgcgtcgcactatcggcgagcgctgtgccaatgcctgtatcgaaatcggttatcgcggggcaggtacgtttgaattcctgtatgaaaatggtgagttctactttatcgagatgaacacccgtattcaggttgagcaccccgtcacagaaatgattactggcgttgacctgattaaagagcagttgcgcattgcctctggcctgccactgtccatcaaacaggaagatatcgtgatcgaaggtcatgcgatcgaatgccgtatcaatgcagaagatccaaaatccttcctgccaagcccgggcaaaattacccatttccactctccgggcgggttcggcgtgcgctgggaatcccatatctatgcaggatatactgtaccgccttactatgattccatgatcggtaagctgatcacgtacggcgaaacccgtgaagtggcaattgctcgcatgaagaatgcactggccgagttgatcatcgatggcatcaagaccaatatcgatctgcaagtagcgattatgaatgacgagaatttccagaaaggcggaaccaatatccactatctggagaagaaactgggtttgcaggagaagtaagatttcttactgatgttcagacgttgttgctttgaatgattaaaatcccactttaaaaggtgggatttttttataactgaactcgatgacggcctaagcgctcaccttaataaaatcgtaaacaaagtttcttgtttaaatacaagaaaccatatttatatcacttggtccattcttacctattttaaaattatccaaggcgtagcttgacttcaaatgtggtccttggttgggggcatcggtgtctgaacgataccaagaacggctcgacacagtgggccaaccgtatgtgggagtaaattgatatttatcctgtaccaaacctcccaattcttgcaattcacctatttgtggtgctctctttcctttcgcctgacataaatttttaaaattttcataattgtatgctgaccaatcttcattattttcctgaacaatcccagttgagagatttggatagtatttttgtacttctttgctcaataatggccgtgaaaatttgcccgcattgatcgggagctcctcaaccatatgcccccaataattggccaaatctgtatcaggactggtaatcacagtaaaaataacatcctgtgttttagtctcagttttagcacccgtaccttcattcaccgttatcgacacggaagtttttaaaccgatactattcctatcagtggccgtcattattaattcaccatttttgtcggtaaaacccatataagtgtcaccactcttgtaagttttgccggtaatttccaactgcacagtaggatcgacccgctccgtcttggctcggccagtggctttccccagttcaaccttaatcggcactccccttatggcattgccacttttcagggtttttacggtaagtgtgatgggttcttctctcttcactttaggcgctttctttccattgcttaaatcctcctcagtgcccacattccatgtcacatcaaaattctccgcgatccccagtaccgtaccctgcgcccggacaatacttcctatattccctttgctattctttggcctgacagtcaatgcaatgattttacctgcatgttgatcggtcagtccgaaagattccgggatataaccgcttttgtctatggcatcattggaattttctatagcctgtattgtcggatcatcctctccgggttcatacactccccacgcataaagggattcatcatccggataaccattgttatcgtcaaaggaataggtcgccgttatttttttacctatcaccaatggatcaattaatgccagatgagtaataacaggatctttgtccggatcaataacactgccttgatcatttccgccaccggtatggtttccttcctcccacttcatactggtgttgatcgtccgggtatcatccgctttcacgcccaaagcattttctgcccgaatcacaaactccacgatccggttgacatctttagcctccagtaaataatccacttcactgacctgaccgactctatcggggccaataccggcctgacaggttgtgccatcgggctggccattcaactgcttgcggcaccatgtataccccgacttatccgttatatcacctgctcccgactcaaagacgtattttgccgttagtgtttttcccttctccagaataccttccagcttaagctcattgatggcaggcttgcctgccggatcaaaaatgctacccggcttatctcccggaggagtaagggttttattaccgtcctgttcactcatgctggtatccacggtacgaagttgacccgctatgccttcaccgttaatcggtttaacagaaatcgccaacattttaccagcatcttcttgtttcagatcccgagttaatgttcccgttttcgtcttactatccttactgacggcaggtacagattccaactggtcatcagtaaccagtgcattcttatcatgccacgtatattttgagtcatcagtgtcattaccgctattaccgtcaaactggtaagtggctgtcaggcgttttccaactgccaaatcaccgctcaacgtaagtttggtaataaccggggcggcatctgggttagtgactccgccttcgctaccggtgttgatcgtccgggtgtcatccgctttcacgcccaaagcattttctgcccgaatcgaaaattccacgatccggttgacatctttagcctccagtaaataatccacttcactgacctgagcggctctatcggggccaataccggcctgacaggttgtgccatcgggctggccattcaactgcttgcggcaccatgtataccccgacttatccgttatatcacctgctcccgactcaaagacgtattttgccgttagtgtttttcccttctccagaataccttccagcttaagctcattgatggcaggcttgcctgccggatcaaaaatgctacccggcttatctcccggaggagtaagggttttattaccgtcctgttcactcatgctggtatccacggtacgaagttgacccgctatgccttcaccgttaatcggtctaacggaaatcgccaacattttaccagcatcttcttgtttcagatcccgagttaatgttcccgttttcgtcttactatccttactgacggcaggtacagattccaactggtcatcagtaaccagtgcattcttatcatgccacgtatattttgagtcatcagtgtcattaccgctattaccgtcaaactggtaagtggctgtcaggcgttttccaactgccaaatcaccactcagcgtcagtttggtaataaccggggcggcatctgggttagtgactccgccttcgctactggtgttgatcgtccgggtatcatccgctttcacgcccaaagcattttctgcccgaatcgaaaattccacgatccggttgacatctttagcctccagtaaataatccacttcactgacctgaccggctctatcggggccaataccggcctgacaggttgtgccatcgggctggccattcaactgcttgcggcaccatgtataccccgacttatccgttatatcacctgctcccgactcaaagacgtattttgccgttagtgtttttcccttctccagaataccttccagcttaagctcattgatggcaggcttgcctgccggatcaaaaatgctacccggcttatctcccggaggagtaagggttttattaccgtcctgttcactcatgctggtatccacggtacgcagttgacccgctatgccttcaccgttaatcggtttaacagaaatcgccaacattttaccagcatcttcttgtttcagatcccgagttaatgtccccgttttcgtcttactatccttactgacggcaggtacagatttcaactggtcatcagtaaccagtgcattcttatcatgccacgtatattttgagtcatcagtgtcattaccgctattaccgtcaaactggtaagtggctgtcaggcgttttccaacttccaaatcaccactcagcgtcagtttggtaataaccggggcggcatctgggttagtgactccgccttcgctattgccgcctgtcgtcttattcccctgcattcctttgcgcagaacgacggtttctggggggaagtgagaaatttgtattgcgttggaagccagtactgacagttccagtactttacccactgcggtctgtggaatggtgtattcaggtacaagacctttttctttcacgttacctgaggacgtaatcccattctggatttcattgggagggggtacggtttcttcaatgcccgtcgctttggctagtgacgttactttgtctgcggtagtgctttctgctccccaggcaaagaaggagtggtctgtatcattacccccattggcattaaactggtaggtcgcactgagttttttactctgttctatgacccccgcgacgatgagatcgctgattgtcggcgcattggcaacatcaaactgaatttccgtaccatgtttcagtggcttgtcatccaccgtgacaatgattttccattcgccaggtttggtgccagccgtggcggtaacttcataaataccgctcccttccgatacttctttaacttcggtgcccaatatagggtttttaccttcgcctctcaggctattgagatcagatatgaacgtgatattacctgcgacaccagtgacgggtttgccattgttgcctatcagcctcaaccggagtatggtttgggtttttccatctgctgccattgattgatgaggcagctcaaaccccgagtctttaagatcgatagctaaagagatcacctgtatctgtgtttccgcccgttcagaagcattgccctgattgtcataggcaatcccggacaggatgtaggtattgttgcccttgttatggaacggtggcaaagtcagccgataatgctctcccccccgcactggcgtatccggtttctccagtttgccgccgccagccaccagatttgccatatcccagacaatttctttcagtccatatttactactgacattaacattcaacgacatgacttgtccgccgtgcccgctaatctgtttttccatcctcaggcgtatcagctcttttttccggtattccagtacgatttgattattacgttcgaccaaatcataacgcccaccttgcaaactacgtttaaaggctaccgcatccgggtcaatctgttttgaccacggcgtcccaagtacatagttcaggccaaaattaaccagagtttcaccgtggccctgcgcactttgtttacggtcaatgcccaatgtcaccagcgggatcggggtatagctggcacccacagtaaaaacggacggatttttttgtcgacgttcttcactcagcaggccaacctcatcaccaaaatattgctcatagatcagcttaccccctaattgcggataggcaggaatgtaaccttctgcacgcaaatcaaaaccattggccggacgttcttcgtaatctttcattttttggccatctttccagctactagcccggaaatagccattcgccccgaatttcataaaatcacgggcgtactcggtaccaatgccgaaacgagtatgatcacgggtaatgtcatggtcaacgaaagcgttatagccaaacatgccggtattaagaaaatgacgttgccccagaccaacattgacggtagtacggttgtcaatacgacgcagaccaaactgggtaaaggccatctgtttttcgcgatcatagagcggtaataacatatcaaactgactgccttctaagcgcccacgatcatccacattagcctgcaatttgatcgtgccatagcgttgcagccagttttgcacagcctgattggcttcattgacggccagaccgtgtaattgacgtttagcgctgtccacaatattgttgtttttcagcatccccgccgcatgggaagctgcattcgccagccagcgttcagtggtattttcagaaggttcagtggcggaaatttgcctcaaacgatccgccaacgctttactggagagcggttttgtgaggtcagtttcaccccccccttccagtttcgtcatcggtttgctgagggaacgatcttcctgtgcaaccggatgcgttttggcagccgccagcacaggagtaaaagtacccgccatcagaaatacaacctgggaaaaaatattcacccaagccaccagcttaatccgatgacgttgtttatctgtccgctgcctgttttgttcttttagcatgtttaccaacccttgaaattaacactattgacctcaagcaatgtcatgcgttgataacattcacgcctattttctataatctaatagactttaaatgaagtcagatgaaccagataatttttccatcaatgatggtcaagtcatttaataggcaagataaaagacttatcaaactttctaacacgaaaaataattcagctaaataatgaaaagttgccaaaatataaaaaaaccttctccatcacttttaattaaaaaccaaataaaaatcaaatgacattccagagaaaaataaaaacaattatatttctccaaaataaattttaatttaattaaaaaaatcaataaattaaaaacaaattaaacaataaaactttcatcatttcttatcaaaatagcgattttgagttaacatttctcgtcaaaatgtaatctgtttttcgtttcaatccttggcaaaaaatggaaaaaaaagcactcataaaaacccataattaataaaaaacgcttttttacatttaaaactaaatctttttattatcaataattaaattcattccaccattgttaacaaaaagacaaaataaatactgatttcaataaaatattattttgttgaaaattaaaacattttttttgatttttactctgatttttcacggcacatttttctcctgaataaatctgtacattaccgtacaattctcctcatattgtttcatagaagttacccggagaacggatggacagacgatttgttcaatcccacaaagaagcgcgctgggcagtatccctggcgttggcttatcttgttggttggttactgtgtgcctatttacccagtgatgccatcggcttaactggattaccccgctggtttgaactggcttgcctgctgctcccagccttatttatcatcctctgctggttgatggtgaagtttatattcaaagaagttccattggaggatgataatgcaaactgaagtgatcttacctctggtagggtatttggcgttggttttcctgctgtcaatctatgcttaccgtcgccgtcaaacaggcgaatttttgaatgagtattttctcggcaatcgctcaatgggcggttttgtactcgccatgaccatcacggcaacctacatcagcgccagttccttcattggcggccccggtgcagcttataagtacggtatcggctgggttctgctgtccctgatccaattgcccgcgatatggctctccctcggcgtgctggggaaaaaatttgccatcctcgcccgtcgctacaacgccgtcaccttgaacgacatgctgtatgcccgctatcagagccgttttctggtctggtttgccagcctgagcctgctggtcgcctttgtcggggcgatgaccgtacaatttgttggcggtgctcgtttgctggaaacagccgcaggtatcccctacgataccggattgctgatttttggcatttcaatcgcgctttacacggcatttggcgggttcagagccagtgtcctcaacgatgccttacaggggctggtcatgctgctgggaacggtattattgctggcaggtatcatctacaaagccgggggcttgtcagaagctattgccacactgcgcgccattgatcccaatctggtttcaccccacggtgctgataacatccttacagggccatttatgacgtctttctgggtacttgtctgctttggtgttatagggctgccacataccgctgttcgctgtatttcctatcgggacagcaaagctgtccatcgcggtattatcatcggtactatcgtgatggcaatcctgatgttcggtatgcaccttgcgggggctttgggaagagcgattattcctgatctgaccatcccggaccaagtgatcccaactttgatgatcaccgtactgccgcctgtcgctgcgggtatttttctggcggcaccgatggccgcgattatgtcaacaattaatgcccaattgctgcaatcttcggctactatcgtcaaagatctctatttaaatctgttcccccagcaaatcagacaagagaaaaaactttctcgcatttccagctactccactctatttttggggatgctgctgctgctggccgcatggcgcccacctgaaatgcttatttggctgaatttactggcgtttggcgggttgcaagcggtattcctttggccactggtgctggggctatactgggaaaaagctaatgcatatggtgccattggctcaatgctcatcggtgcgactagctatacattgctggccagtttcaatatccagatttttggcttccatccgatagtaccatcgttgttattcagtttactggccttcgggatagggaatatgattggcagccgtaaataccaacagatcgccgcatctcaatagcggcgatataatttcatttccataagaaaatgattcacagaaagagaatttttatgccttggatacaattaagattaaacaccacgggacaacaggccgaagccctcggtgacgagttgatggaaagcggcgcggtgtcagtaacctttcaggacagccacgatacaccgatttttgagcctctgccgggagaaacccgcttatggggcgataccgatgttatcgggttgtatgatgcagaaatggatatgaaagccgtagtcggccaactggagcaggttccacagcttggcaaagggttccttcataaaatcgagcagttggaagataaagattgggaacgtgaatggatggataacttccatcccatgtgtttcggcaaccgcttgtggatttgcccaagctggcgagaagtgccagaaccggatgccgtcaatgtgatgcttgatccaggtctggcatttggcaccggtactcacccaacgacttccctgtgcctgcaatggctggacggccttgacctgacaggaaaaacggttatcgacttcggctgcggctctggcattttggctatcgccgccctgaaactcggggcaaaacaggccatcggcattgatatcgatccacaggcgattcaggcaagccgggataatgcggaacgcaacggtgtatctgcacaactaacactctatttgtcgaaaaatcagccagcagacctcaagtgtgatatcgtcattgccaatattttggctggcccattgcgtgaactcgcgccgatcattggctcactgcctaaatctggtggattcttgggtttgtctggcgtattggcaagtcaggcagaaggcgttgtccaagcctataacaatgaatttattatcgatccgattgcagaacaggaagagtggtgccgcattactgggattaaaaaataatcacttgatgcctattgaaaaacgagattatccactaaaatgatcacctagggggttaattggtggtaatccgcgctcttcatcatgataaatacaggtaacgataaatttcttaaataatatctaacttgatgttatttaagagtaattaacaaactttaaaaaaatcaactggaaaaattccgttataaatatcgattcgctcaaagtttggcctttcatatcttgtgaaaaatgcgtaatatacgcgcccttagttaatcacagttggccactctttcttcgcctatgcgtatcggacaataccagttgaaaaactgtcttattgcagctcctatggctggcataacagatcgcccgtttcgatcgctatgctatgacatgggtgcaggaatgacagtatcagaaatgctttcttccaacccacaggtttggaagacagataaatctcggctgcgtatggttcatcgcgacgaatctggagtgcgttctgtacaaattgccggcagtgatcctgatgagatggcggcggcagcgagaatcaacgttgccaatggcgctcagatcattgatatcaatatggggtgcccagctaaaaaagtgaatcgtaagctggcaggctctgcattactgcgttacccggaattggttcaagcaatcctttctgcggtagtcaatgcagttgatgtacctgtcacactgaaaattcgcactggatggtcaccggaagagcgtaactgtgtagaaattgcccaattggctgagcgttgcggtattcaggctcttacaatacatggcaggacgcgatcctgtctgtttaatggtgaggccgagtacgacaacattcggacagttaagcagactgttgccattccaattattgctaatggcgacattactgacccgcttaaagccagagcagtgcttgaatacaccggggctgatgccctgatgataggccgcgctgctcagggaagaccctggatctttcgggaaatccagcattatctggaaacaggagaattgctgccaccgatgcctcttggcgacgtgcagcatttaatgagcgagcatgtacgagaactgcatgacttttacggtcaaggcaaaggagttcgtattgcacgtaagcatgtatcttggtacctcaaggaacatgctcctgatgaccagtttcggcgcacattcaacgccattgaggatgccagcgaacagctggaggcgttggaggcatacttcgaaaatttttgcgtaaataaagaaaagagctgacagaactatgttcgaacaacgcgtaaattctgatgtactaaccgttgctactgtaaattcacaagatcaggtaactcaaaaacctctacgtgactcagttaaacaagcactgaagaactattttgctcaactgaacggtcaagatgttaatgacctgtatgagctggtactggctgaagtagaacagccactgttggacatggtgatgcaatacacccgtggcaaccagacccgtgcagccctgatgatgggaatcaaccgtggtactctgcgtaagaaactgaaaaaatacggcatgaactgatcctagtcttagatcatgttgttataaaagcactttctcttttaggggaagtgctttttttgtttaggattaccccaccgattaccccaccaaaaattcctcaacataaagacacgttgcaaagcataagtaccagaaagaaaaatgaagatgtttaaaatcgaagcgtattcatagcaatagagggttgcgaagcatttcgtcgaaagttattgagaagctgaagtgacggctaactatatttctaccaatcagaagagttccctgtaacggttatcatctgaccttttcgtaataatatcaccgatagtgtcaccccatcaacgccaataatattctgtgagcaatgaaatgaggtgactatttccctgatgtttttctggcattagaatgattattttgatgatttatcgcgaactttcctttctaataattctccggtataagaatcaaaataacggctaggccagatttcagagggatgtatttcgagatagttagcaattatccattcgcctttcggccacggtctgctgagagcatttgccagtgagtcctgcttcacgagaaacagctgctaaggttgtaccacgcttacgtaatgcagcaataatatcggcttgatgccagtcatttctaacgttattcattcctgctaccccttccattaattaaaattgatggtggcgattcagacaggattagcactaccgggtgtcgtcatgacgtcggatttaatcgccgtctcataactttgaaaacgttctttcggattggcacgcagtaagtcggcagtatcaaattccacctgataacgaatcccccgcttcggcaaagtcatcagcaaggcggccttgatttgttgttcaaagttggcaagccacgggcgcatggtgatagtcagaaaagcgcgagacgcttcgctaaaattactgtaagtgctgtttgaatattcttgcaaaaagatcgggctgacattgaacatgcgggcgatatcatcaatggtaaaacggcgggagaccagccattcggcatcttggttactcatgcctaactgctggtattccatcgcaccttcaaggatcggcttttttccggcattacgcgcacctttataacgttcgagggcttccagtgccttccgtattcagcgtgtcggactggctgcgcagttcgtcgaactctttggcctcatcgctggtgagtgaacgtttttcgtttttcgctttggtgagaagcgagtgcatttgatggggtaaatcggatttttgttgacgtatgacgtagttcgagtaattttttcatggtattttgtagttaatttatttttgcaaaaaaagtttttagcaccatgaaaaataataagaaagaatcctgattatgttgagaaagtataaaaaatggcgaattaaatcgccattcttatagtgacaattattcccttacttttatagtataatttttattgaactctttccctgcgtacattgtacctaaagtaaaccctactatttcaatttttatcaattctatcttctttggggtacctgttatatttatatgatggtaatcttttcttatttctttttttccaccccataggaaagaactatcttttggattccatgttagtcctgagccagtaggatgaatttttacccaaacgcttttttcattcaatgcacctcctgtgatggtaattgatgcctgatatggttcatttatcactgcatcaggaagaaactctgattttggtaaaacttttggcgttggattaccacaaccataaagtaaaaaaataaaaacaattaatatttttttcatgttatttcattgggttaaaaaccaaccctccaaaaatatggttgagtacataatctaatgatttgtttattttaatttgatgttccactttaccccatgaaaacagatttaaatttacatattgattcagatctgaattatttgtgatattttctttctcatagttttctactactccttcccaaactatccaatgattttttcctgatgtttctatgtcaccaaaatcggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcgtaaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccccaaaatctgataacattcctgctgaaatcaaagtaacaacatgatatcctttgttatagtaatcactaagagttactatgtcatctatattagaatgggataagccgacattactaaatactttttcataccctgatttttcaaaccattctgtcaattttccccacattgtaataccagctaattcatcatcaacctcatcataactcataatcatattttctgaatctcttaggcttgccaatgtcagccaatctaacccagatattctggtcatgacttcaaagcgttaatttgatattcttgtactttttaatgggatatcatcatgactgttacgatagaagtgacttgtcgatattgcgaccaagcagaacctgtacgcaaacacggaacaggtaaggctggcttccctcgctactattgcaaaggttgccaaagaacctttcaactcaactatcgttacaacggccataaaccgggtatgaaagaaaaaattgtggatatggcaatgaatggctctggcgtgagagacacaggccgtatattaggtctcggtatcaatacggtgatgcggacattaaaaaactctcgccaaaacaagtaacatcgtgacagatcgcttatgacgatatcacacttatctgtgaattggatgagcagtggtctttgataggcaataaaaaacaacgtcattggctttggtataattttgatactaaaaggaaaaaaatcatcgcccatgtctttgacccccgaacagatgcaacctgccgaaaattgctcaacttattggcgccttttaatattcgtttcatcacgaccgataactggggaagttatgccggaaaaatatctggtaggcaaaatttttacccaacgtatagagcggcataatctcaacctgcgaattcatatcaagaggttggcgagaagaagaaccatttgttactcacgttcgatggaaatccacgaaaaactcattggcgcatatattgaaaaacatcattacaaccctttggagtcattaccgaatattggaggggagttaaacagaatattaggggattttgagaccctatttacgattttgtggaatctccatctcatttaaaagtggccgtttaggctgtcaccgaattccatcatgaagcggatcatcgttatacgccagccactgagcagtattgtctacttttttggatgcgccctgaatggtcagccaaactaccttttttcactgaatcatctgatgggaagctttgacgtttcttgatggcatgacggatactgttcagggattcaatgacatcagtttcttttggtaaagctagcaaattctttgatctctggaaggattgtcgatatacaaagctcttaatacgggttcacaatgatgagtttggaatttttttccagccgcttatcgtctttatgaggaaaattcaggaaagtaaaatcattggatagtattttagaaagaatataattagcttactttattaattactttggattggtaagaaatgaatttgtgactgtatagtcataagagttgtgaactctaagctatttatcttaaggataaacatacttaataattcgtgttaaatatattttataaattgttcaatgtaggattattcgccatgattgtaaatttatattaattatttaaagagccatggcgtgttataaagtgatgatccgtgattatataaatatttaaaactttcatttaggaaaaagggaaaatatgagcaaggttactgtttttccgagttttggcctgactggtgaagtttttataccatcatctaaacctcatattcagcgtgcattattactagctttactgaatgaaaatacaacgaaaattgttaatatatcttggaatgtagaaactgaaaatcaaattaatgctctgaaaaaatttggtctagaaatattgcataaagatggaacaacactgttacttcgtggtgtaggtagaaatttatcgtataatggggagatatatgcaggtggttcaggtatgttattcagaatgtgcgcagctttagcatctctcattgataatgaaaaaatagtaataaaatgcaatgaatctttatttaatagagagagtgtgtttgacgaagatttctgtaattatttagatattcatattgaacgtattgaaaatgaaaagattataatcactaagagtgaaactaatataaaaaaaccattgactgttttgaatagcactcagttcattacgtttgctctatttgtcactcctttcagcaaacaaaatatagtccctatagttatggacggcagtaaaatgggctatattgatatgacgataaaatcaatgtcccttctagggagcatggttacatatgaacaaaagcactttaaagtaactaaatatatacctaaagatattgaaataaaaataccctctgatttcacatcattaagctatatagcatcttctatattaagctcaaaaggtgttagtgatgtattgataagaaattattattttaatgacacaataaatgaacgtgatttatttaaattttatcaaagtataggtctaattattaagtatgattcaaattggaataatttgagaatattcaggcagtcgattaggttatgggatggtgaattttcattgaaagagcttccttccgtagccgtaaacataattgctgcttcatctaatttgaaaggaaaaaaaatttttagtggggtaaggggaataaataatcataaaagtcaacgagcatttattgttaatgaaaatataagaacaatgggagggagtagtgttctaatattcgatagagtaggaatgtttgagtcaatatatattgaaggaaaaggaccgttgaatggaggagttgaacttaaaagttacggtgaccatagaatttgtgctgctaatctcatagcatcgctcggtgctgagaaagaatccataatatacgatatagataaattaaatgatggatttcccgattatatcgatacgctgaggaatttaggcgttcatattaaatagttaaattatttctttgagggtgaaaaatgtctaaaagaattgataaagatagtaaatttgttgaggtgatttattcgaaacgtttacagggtacacttaacttaccagcttctaaaagttcctcaactcgagcccttctaacttcttccattacttctggaaaaagtattatcagaaatattgctactggttttaataccatagcgatgaaatctaattgtgagcgattgggggctgttttcaaagaagataaaggtaatttgatagtaaatggaattgacgtgagttctatcaaccagcctttagagttcaatccaggtaactcaggggtagtattgaggttgttgatgggggtagcgggtttcttaccagagacaaaatttataaccgattatcacgcctctcttggatttcgttctcaaacagaaatggttaatgcgctatgtatgttgaatgttcaatgtagagcattgggagaagagcatcgacttcctatcaggattaagtctgatagaaagttaaatgattatacagaggtatcttgtagaaaaagctcacaatttttaagtggattactatatcttggagcagtgatggataatgacttaactataaaggtagtcgacaaaataacagctccatcaatggttcacacaacaattaataaccttaagaaagcgggtattagaatcgaatatgatagtgattttcgtgaattttttgtacatggtcgatgtcgattgcaggcaagtgattttacagtaggttctgatccagctagcactgctgcaatccttgcgctttgtggctccctagaatcagaagttcaattgaatggtttcttcgaagaagaactgggaaatggtgctgtgattcaatatctaatcgatacagggactaatatcgaatttattgggaatgaaacgataataattagagggagtacagaaattcgtcctttagattttgacggttctttggcccctgatgcagttcccgcattagcggctagagcttcattagcctctggtacaagtattttttataacattgagcatatccgttataaagagtctgatcggatatctgattttagaaaagaattatcaaaactaggggtaaaatcagatgaaaaacatgatcaactcattatccatgggaaccccaaaggatataaaggcagggtggttctagatggacattacgatcatggacttattatggggctcacaacaataggccttcattgtagtgagcctgttattataaaagaaccatttcatgtagggcaaacttacccagaatatttttctgaaattcgttccttaggtgcgaaagttaatgagctggctaaattaaaataatcctattttagtaaaggaaaatattttatgtgtggaattgcagcaatttttacgacaaaaaaaattttaattgaacaattggataataagcttttctctatgatagaaaggattaaacatcgaggagatttatctcgttttaatgaacacctagttaaagaatacgttgggcttgccacaaatcgcttggcaattgtcgagagagaaaccgcgactcaacctgtttcagacgaagaaagggatattcatgtcatccttaatgggcaaatattcaattataaaaaaatacgtgaaaaacttatcaaaagaggacacgaatttaaaggatatggagatgcagaggtaatattaaaggcatatattgaatatgatttagaatttgtaaatatgctagatggaatgtttgcatttgtcatatatgataatagaaaatcaaagtttctgatcggtagagatcacgtgggtataaagcctctttactatgcaaaaaagaatgatgtttggtatgtggcatcagaaatgaaatcttttctagcacttgatgttgaagttaagacacttgagcctgggagtctttatgatggtaatgagctttataagtatactcgttatgataaatctatagaaaaaagcaaggattgttatcttgtagcaaaacaaaaagttcgtaagttgatggaagaggcggttgagtctcaagttgacactgatctgccggttgctgttatgtttagtggtggaatagacggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattatcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgacctataaaatggcatgccataaaaaataacacgttaaaattatcattatattcaattggttgtgattgttttttatgataatgctcatataacattaattgttaatttgatatcgttattagatataatttatggttataaaaatgttgcaatgttgttaggcgatcaatatcatcacattaaatccggatatttaattattaattattgatggggataatagaagttgaggatttctttaatctggaaattattttttcttttagtatttaatattaaaccggtttagttatgtttcagaatatttatcggatctgtttgatttttgttttaaacaatttactgcaagtaactaaaaataatatcacatagagaaaactcgatttctctgctacacgatagaggataatgtatgcaacattttctcagggcattgcaagagtctggattacaagtttctctttcttcttctgaattagctgaactagaaaataaaaatacagaagcgggaatatctcctctcacacagcagattcacgaaatgctttgcagtgcattgccactgaatatgactatccccaaaacgttatttacaaaagagtctacaacagacgattttccactgacggatattcaatatgcttacctgatcggccgtaatcctggattggaactgggtggacggacgagttgtctgtataccgaatgggatgtcaaatccttagatatcaaggtactgaatgacgcgctcaacatggtgattggataccatcccatgctgcggactgcgttatcttcagatggtcagcaacgggttttatctgaatcattggcctataccatttctattcaggatggcagagcgtggccggcatcagaaaaagataaacaactggctgatattcgtcagaaaatggaaacacagttattacccgtagataaaaccccgtcatttgatatacgtgcaacgatactcagtgatgaaattacccgtttgcacctttattttgatttgatgttcatggatcttcatagcgtcagattggtattacgggactgggggcgggtttatcagggctgcgaattgcctgaattaggtgacgaagcaaattttcataattatatcaaggctgaacgttatctacaggggcaaccacaagggcagtatgataaaacttattgggaacaacagttcgataacttaccgccatcccccgaattgccattgaaaaacgcccctgaattgatttctccaccgatgttcaaacgttacagtcggaaaatagcgacagaaaccttatccgctcttaagaaaaaagcagagcagcaaaaactgacgcttgaaacgttgttgttgggaacttatgcagaagttctccgtcagtggtcaaaacgtcagacttttacgttgaccatcacacagctcggtcgtcgtccctatttttcagcggttgaaaatattgtcgggaacttcctgcaacctacattactggcaatacagggaacagaaaacgatagtttcaatgatcggttagtacagcttcagactgattttctgatgaatcgttggcattcttcctacaatggtgttcaggtcttgagggagctgactcgtcgcagtcatggcagtcgcgcagtttctgcaccggtggtattcagtaatactctgacagcccatttagacgatgttgtcacggatatggactgggctgacacagtacaggtttatagcagtaatcaaacccctcaggtatggctggaaaaccaaatcgttcgcgttgatggcatcgtccagattaactggaatacggttagtgagctgttccccgatggtatggttgaagccatgctggatagttatatggaactcctcatcgtctgcgcagaagacgattctgtgtggggcaaaaccggatcattggtaaaacttcctgcgtccgatagggcagaacgcgccaaggctaatgcaacggatattgatcttgctccccggcttctgcatgaaatggttttgcaggccgcagagaaattccctcactccattgcccttgtgcagggcggaaagtactttacttatgctgaaatggtcaagggtgccagtgaagtcgcaaaatctcttcgtgcgtcagtccagattcatccgaatgatattgtggcggtttctctgccacaaggcccggcattggtgcttggggtattgggaattctcatgtcgggagcagcctatgtcgccattgaccctcaacttcccgcagagcgtcggatgaatttgctcaggcgctgctccgccaaaggcatcgtcactgagagcagcctttctaatgaggatgaatcggctgatttattccggatcaatctggatgagtgccttatgtctgaggcaatggatacagaacagaaggtctctgctcatttatcttccgtacaagcgttggatgatttggcatatgtcatctttacctcgggttcaacgggagaaccgaaaggagttatggcttcccatcgcaatgcggcgaacacggtactggatatcaatcgcaaatttcatgtgacagaaaaggacacggttttatccgttgcgcctgccggatttgacctgtctgtatatgattatttcggcgtgctgggggcaggaggaaaggttgttttttcaacctctgaagcggctaatgatccgaaaatctggtttgagacgctggttaaacatcagattactatctggaacagcgtgcctgctcccgtcaaggttttggtagaccgaaatggtggcgatctggctcagacaccattaaggctgatactgatgagcggtgactggatccctatcgatctgcctgaacgtattcgggaaaatctgcccgatacggcgatcatcagccttggtggcgcaaccgaaggatctatctggtcgatatgttatccaattgaagatattgataaaaattggaaaagcattccttatggcaagccattggcaaaccagagattccatgtcctgaacaattggctttcaccttgccctaactgggtgacaggtgaactctatattgggggagagggcgttactctgggttatctgggtgatctcgaaaaaacggcgcagcgattcattacccatcctgttactggcgagcggttatacaagacgggagatctgggacgctatatggctaacggcctgatagaaattctgggtcgtgaagataatcaggtgaaaatcaatggataccgcattgaattaggtgaaattgaagcctgtctcctgactcacgaaaacgctggtcacgtcgtcatggatgcccccgtccatgccaaaacaggtcagcggcatattgtggcctatgtggttccctctgttgcggatacatcagaagatcctgcccattttcaggagcagttgagggaaattgcccgcaatatactgccgtcctatatggtgccgagctattacgtgttgctggctcatatgccgttaaccagcaacggtaaaattgaccgcaaggcgctgccacttccttgggctgatagcgaagaacacacagcaatcgccgtcgatccggccaatgagatagaaacaaaaattttacaactctggcagtcacagctccagcatgatgacttcgatgtcaccgatggcttcttcgatattgggggggactcactgcatgccgttggtctgcttagcgctctgcgacaggaatttaatatcacgcccgccggcgagcaggacattatcgaagggttgttcatgaactccaacattcaggcattctctcggattatcgagacgattatgcaatctcaagcggtgagtgacctatgaccaagacatacgattacatcgtggtaggtggcggctctgcggggtgtgtggctgcatcgcgcctgtctgagaacggtacgaaatcggtactgttgcttgaagcgggtcacgcatctgatgttaatgatccggccagcccgctccgggatgcgtcaaggctggtactggaagggtataactgggattacgaagcgaatgtacgcagtgaagatcggttcgccgatctcatttcgccttctcattacctgcaagatgaaaaaaaacaagagcacaaacaccggggaagaaaactgttcaattatcgggtgggaaaggtgcttggtggttcttctgccgttaatggtgccattgccttcaggggatttcccagcgattttgaacagtgggtgaaaatgggttgttctcgctggtcttgggaacaggttctgccgtggtttaaacatctggagaatgacgtcgatcgcacgggtgatgataaccacggttcactggggccaatgtgtttgcgcagaccgcaacatgaggaaatccatcccctcgatatggcttttgcccatgcttgtgagcagtcgggtgttccctatgtggatgatcttaatgccggagagtctcccgccgtagggcctgtacctgccaacgtcatcaatggggctgaaagagtggatgtttatcgctcatatcttgaacctgttcttcatagaaagaacctgcgcgttatgacggatgtgctggtggcacagatcatttttaacggaacggtagcggccggcgtaaaagtgattcaggccggagaagaacagatttatcacgcagagcacatcgttctctgtgcaggcgcaattggttcggcaaccctgttacagcgttcaggtgtcggcgatcccggacatctgcgtgctttgggcattccggtgattgcggagttgcccgccgttggccgaaatttgactgatcacgcttcagttgtgctctggtcattgccgaaaaccggcgtgtgtacaacgggtttaccgtggcggcaaattgctgcccgcatcagcagtggctatgacacaaaagttgatgtgcaaatcgggctgttgaacaatgttgccagtgagacggtgccgggattcaaagatcgtgtcgcttatcccatgctggttggtgcttccgtgatgctgatgcggccacaggctctggggcgtgtttttatcagtaccgccgatcctaccgtgctgccccagattgacctgccactgacccgcaatcctgcggatatcgcccgtcttgtcggtggtgttcgtaaaatatgggaagtcctgcggcatccggaagttgatgcgtttctggatgggattcagttttggtctcattccatgatttacaacgatgaaatcatgaacagtgcgattaagaaccttgttaatccgggctggcatgcgtcaggaactctcagaatgggagctgactctgatcctgactgcgctactcaagaggatggacaagtgtatggcatcacgggagtgaccgtagctgatgcatcgctgtttcccaccattccttcgatgccgaccaatctgacgaccatcatgaccgctgaacggattaccagctttctgatggagcgagaggcagtgatagcacggagggaaaatgaacattaattgcagacgggtcatttatgcctttccacatgcaggggcgacaacggccatttatcgtccttggctgaatgctctggcggccacgaaagccgcgatcttgcagcctgtggcaatccccggtcgggggcatctagccaaagagcctgaaatccatgagttagagccgttggttgatcggctggcctcagatatttgggcggattttcagcagaagcaggcgcaggggatcacggagtggattacattcggccacagttttggtggtgtgctcagtgttgcggtgggtcagatactgcacgagcgctacgggcttacccctcagtttggtgtggtgtcctgctcggtgccgcctcaacttcaaccgtatgatgagcggcatgaatggacagatgaacaattgattcagaaaaccagagaagatcagggaacgcctgaggcgattttgaacgaaccggcgctgataaaacccatcatcaggcaattacgcaatgactacctcatacgtagccaatttactcagcttggcaacatgcaggtggattatccactggtgctggtttcagccagtcaggacatacatgtcggtttggcagatatgcaggtctggaaaaatcacacttctcacaagacctcactcatccgtattgaaggggatcactttgccgtctaccggcactgggatgccatcaaacaaatactgctgagtgacagtgaaacgcaacaataggctgacaaagaatttggagtgaatatgcgtattgagattgataatttcgacgattaccggaaatcttgtcgtgaatttcttgagagtgagatcgttcctgaacatcaggcttgggaatataatggtctgatggcgcgttctttttgggagagattaggtaaggctggcttgttgggtatcagtgtcagcccagaatacggcggcttgggaaaacatgattaccgttttgccgtgattctgacggaagagcttatcagagctggcgttacagtcccggggatcgtcgcccataacgatattattgccagttacatttttgccctcggcagcggagaacagaaacaaaagtggctgccggaattatgcctcgggaagcgagtcgcagccattgccatgactgaacccggcggtggttctaatacggcagatatcaaaactgtggccaaacggcagggagatcactatctggtcaatggcggcaaaacctatatcaccaatggtatcaatgctgatctgatcgtggtggcggtaaaaacagagcagggtcagcaaggtcaggggatcagcctgctggtgatagaacgggatatggccgggttctccagaggggagccaatgaagaaaattggctggaacggcagcgacacggctgaactgtttttccatgattgcaaagttcctgttaccaatctgattggccgtgaaaatctcggtaactattacttcatgtcggcaatgccacgggaacggctcagtatctcagcggtggcggttgccagcgcagaacatattttacagagtacgctggcttacgtgaaagaaagaaaagcgtttgaccagccgattggctcctttcaatacaaccgttttatccttgcacagttggataccgaagtaaaaattgcccgcatctatcttgataacgccgttgagcaatttagcaagggtctttttagtttggtggatgctgcccgtatcaaatggtggacaacggaactccagatgaaagtcgcggatcgatgcctgcaattatatggcggggcaggttatatgcgtgattctgttgcgggcaaaaactggctcaatagccgcgctcaaactatttatggtggaaccagtgaagttttacaggaaatgatcagtaaatcgatggggctttaataatcaacggttattgtttgaataatgagcaaggcagggcttattcctcactaccgtactttcaggaagtacaagggcaatgtcataccaaaaggacgtttggataaattaagggccattgcttctctggagttgggttaattagtaccaaaaaatcgtcatagtcagaatgacgacgtcattcatgtattcatatgagaggtatgttatggcaaatgaaaagccaaccttattcgaatggatggggggcagagaaaaactcatgcaccttatggaagtcttctatgccaaggttgaaaaagacgaactgcttgaacccctgtttaaaaatatgaaagccgatcaccccggccatgttggcatgtggctggaagaagtactcggtggagaaagccgctataccgatgagcgcggtggtttcaaagtcatgctgagtcggcacaggggcagaagcatccaacccgagcaacggacgagatgggtagaattattgatgaagtctgccgatgaaatcggtcttccgtcagatcctgagtttcgttcagcctttgcggcctatatcgaatggggttcacgcagggcagaagccaattcccagccggatgccgcaccatcacgccgcgaaactgtaccaaaatggggctggggggaagcacctccgggaacgccctgatttttctgagaacttcgtaatagtgaggtgagatcatgctgttggctgtcagtgacttacatgtatcccatgcagcaaatcgggcgatagtcgattcattcagaccatcgacaccggacgattggctcttgttggtgggtgatattgcagaacaggagtcagactttacatgggtcataagtacgctttcccaacggtttgcacaggtaatctggacgccgggaaatcatgaactctggtgcagtcccagagatcctgtgaaattacccggtgtactgcgttatgagcatctggtaaacatctgccgacagcacaatgtgctcactccagaagatgaattccaacgttaccctatgggggatggtacatttgtaaccattgcccccatatttacgctatacgattattcattcagaaatgcgaccgattatacggcagatcaggctatagaacgcgcccgtcgctgcggcatcatcagttccgatgagtttttcctgaaaacctatccctataaaaatattatcgaatggtgtcgggaacgcatccaatataccgaaaaacgtttgaatcacattcaggatggcgaaggtattgtgctcatgagccactttccgattatccgaaaaccgaccgaatctttgcgcaataccgaattttctatttggtgtggcagtgaaaaaactcgccagtgggcatcaagaaaaggggtacacatggtggtatatggtcatttgcacattcccaatatcgaatatattcatggtgttgctcatgtggaagtctctttgggatacccacgggaatggcaggagcgtggcagacatttctgtctggtagagctggatgagtggctggaatatgccagtgaatatcgctaacaacctattctgatcatcaagaacattctgataataaaaggccaatttacccatgaaatatgatgaaactaatcaaaaaataaaaccgaggattttaattggagccacgggatcagtcgatattgtcctccttcccagatatctttcggctattaaggcggcgattgactgtacattgacggtattgatgacaaacagcgctatcccctttttgccagcggaaaccattgccctctatgctgatcgggttatcagcggagaaaaaccacaggattggccaaccgataagccttctcgcattgtggctgatcatgatctcatggcggttctgcctgcaacggcaaacacgatggcgagtgctgctcatggtgcgactcccaatcgtttgacaacggtcattctggcttccacgtttccggtactgttctttcccgtaatggggagcgtcatgtgggaaaaaaatgcaacacgtcgcaatatcagacagttaaatgatgatggttatcatgttattgaacctgtttggcatgaaaactttgacgcatcactgcaaaagatggttgggcatccttccctgccggatattgaaactgtgatttcactgctgaagcaatatttgcctaaataatttactgaaatcgatgggatatatatggggagtactcaggtattctgacggtatttaacatatggactgcgtactcttcctctttcctacctatctgctgacctcgcattaaaacaaggatgaatccctgtgttatcagaataaaatcactgacaagttgcagaatagatatcttaaaatatcgaataagtcttatttttatctgttttaaagtctggtagggttattagtggaaatcatagaatccctattttataactataaatcggtaacttatgtcgcaacattataatcgtgcgttaaataaacaagattacaaaactctgtctttggctgctctgggtggagctttagagttttatgacttcattatatttgtcttttttgccgttgtgctcggcgagctatttttccctgcggacatccctgtgtggctccggcaacttcaaacctttggcattttcgcggcaggttatctcgctcgtcctttaggggggatcatcatggcgcattttggtgatttgattgggcgtaagaaaatgttttcgctcagtattcttctgatggccttaccgacattgatcattggaggattacccacttatgatacgattggcattgctgcccctgttttattattactgatgcgcattatgcagggagcggcaatcggcggagaagtgccgggtgcctgggtatttgtggcggagcatgttccccataaacgcatcggttttgcttgcgggatcctgacagccgggctgaccattggcattttgcttggctcgctggtggccacgatcattacctccatttataccagacaggacgttttggattgggcatggcgtctgccattctttattggtggggcttttggcttgtgtgctatgtatctgcgccgttggttacaggaaacgcccgtcttcagggaaatgcaggaacgtaaggcattggcggacgggctgccactgaaatctgtgatcttgaaccataaacatgccatcatcgtttccatgttgctgacatggctgctctctgcgggcattgttgttgtcattttgatggcaccgacctatatgcagactgttttccatctggagcagtcactcaccctgaaagctaacagtctggcgattatcatgctggcaatcggctgtatattagccggtcatttatgcgataaatggggcgccagtctggttttagtggccggctgcgttctgctcgctgtagcctcatggtttttctaccataatatcagtgatgaaccgggcagattattcagtgcttatgctgtggcgggattctccgttggcgtacttggagcagtgccttttgtcatggttcagagctatccgccggaagtgcggttcagtggaatttcattctcatacaatatgtcttacgccatttttggtgggctgacccctattttcgtcaccctgttacaggtctatacccagtttgcgcccgcttactatattctggttttatctgttgtaggtatactcttggggttacatttgcgcgtcagaaaaaagtgacacaaaaaaacaggatgagcgatggctcatcctgtttaatcgggttttgctagcgttgcttgcttgatattgtcaggcgtgtttcacttcgccaatcggcagaacagtacggccatattgttcattcagaacctcagccatagccagatagaaagcacttgccccgcagacaataccttcataacctgcgaaggtcaggaggccggtattgcctgtgatattgctaattgccagcagtgcgaacagcagcgtcaggctgccaaacacaaattgcaggacccggttagctttcaacgttccaaaaaacataaacagagtgaaaataccccataaggcgaggtaaacaccgaagaattcatggctggtggcatctgccagacccattaccggcaggaacaacaaaccgatcagactcagccagaacataccgtaagaggtaaatgcggttgcggcaaaggtatttccttttttgtattcaataatgcccgccagcacctgagccaaaccaccataaaaaattcccatgctcaaaatggccgatgccaatgggaaaaaacctgcattgtgcaaattcaacaaaattgttgtcatgccaaagcccatcaaacccaacgggcctggattcgccaactgattagaatgcatatttcctctggaaaaaacaaataaaacaaaatattaaaaaggttttatggcctctgacagcgccaataaaccataaagggcggcgcataataatgtgatggcatcaactaaacaatgggctggaaaagaatttttttattaaacttaatttttttcaacgcaacccttgatgattgaatgaatgacccccatttaagtctcaaccgcggttactagcgacatttcggtgtttagccgaaagtttaaaaatgaggaatttcaggcaatcagtgccattgaaaaacaaacatccgtcctcatattgttaagtaacttgacttatatatgaattctttgtggaggcgtttagatgggtaaaatcattggtatcgacttgggaactaccaactcttgtgtagcaattatggacggcacaactgctcgtgtgcttgaaaacagcgaaggtgatcgcactacaccttctatcatcgcgtatactcaggatggtgaaactctggttggtcaaccagctaaacgtcaggctgtaactaacccgcaaaacacattattcgccatcaagcgtttgattggccgtcgttttcaggacgaagaagttcagcgtgacgtttctatcatgccatataaaatcattggcgcagacaatggcgacgcatggctggaagttaaagatcagaaaatagctcctcctcagatttctgctgaagttctgaaaaaaatgaagaaaacagcagaagactatctgggtgagccagtgacagaagcggttattaccgttcctgcctacttcaatgatgcacagcgtcaggcaaccaaagatgctggccgtattgcgggtctggaagtcaaacgtatcatcaatgaacctacggcggcagcgctggcctacggtatggacaaagaagtcggtaaccgtactatcgcagtttatgacttaggtggcggtacttttgatatctctatcatcgaaatcgacgaagttgacggtgaaaaaacgtatgaagttttggcaaccaacggtgatacccacttgggtggtgaagacttcgatagccgtttgatcaactatctggttgatgaattcaagaaagagcaaggctttgatctgcgtaacgatccactggcaatgcagcgtctgaaagaagccgcagaaaaagcgaaaatcgagctttcttctgcacagcagacagacgtgaacctgccatacatcactgcggatgcgacgggtcctaagcacatgaacgtcaaagtgactcgtgcaaaactggaatcactggttgaagatttggttaagcgttctatggagccgctgaaagttgccctgaacgacgctggactgtctgtatctgacatccaagacgtgattctggttggtggtcagacccgtatgccaatggtgcagaaaacagttgcagacttcttcggcaaagagccgcgtaaagacgtcaacccagacgaagccgttgcaatgggtgcggctgttcagggtggtgtactgtcaggtgaagtgaaagatgttctgctgctggacgtaacgccactgtctctgggcatcgaaaccatgggcggcgtgatgacggcgctgatcacgaagaacaccactatcccaaccaagcacagccaagtgttctctactgcggaagacaatcagtctgcggtaacgatccatgtattgcagggtgagcgtaagcgttccggtgataacaaatctctgggtcaattcaacttggatggtattcagccagcacctcgtggtatgccacaggtcgaagtgaccttcgacattgatgctgacggtatcttgcatgtttctgcgaaagacaaaaactctggtcgtgagcaaaaaatcaccatcaaggcatcttctggtctgaacgaagaagaaatccagcagatggtacgtgatgcagaagcgaacgcagaagctgaccgtaagtttgaagaattggtgcaaattcgtaaccaagcggatcagctgattcacggtactcgcaagcaagttgaagaagcaggcgacaaattgactgcggatgacaaagcagggatcgagaaagccgtttctgagctggaagttgctgtaaaaggcgaagacaaagctgaaaccgaagcgaagattcaggcactggttgaagcttctaagaaacttctggaaatcgcacagcaacaggctcaggaaggtgctgctgaagcgggcaccgcgaaaaaagatgacgacgttgtagacgctgaattcgaagaagttaaagacaaaaaataatagcccttagcgggcaaagtaacagggcgcctgttacttgttaactaacacgggcgttgaggtaactctacgcccgtgtatgtgtgtttagggtaaacaaaacaatggcaaaaaaagattattatgaggttttgggcatttccaaaaccacagaagagaaagagataaaaaaagcctataagcggctggcaatgaaatatcacccagatcgcaatcagggtgataaagaagcagaaagtaaattcaaagaaattaaagaagcgtatgagatcctgacggatgcacagaagcgcgccgcttatgaccaatatggtcatgctgcctttgaacaaggtggtatgggtggtggagcaggcggtttcggtggcggggctgattttagcgatgtctttggtgacgttttcggggatatcttcggtggtggccgtcgtcagcagcgttctagccgtggctctgacctgcgttacaatatggacttgacactggaagaagcggtccgtggtgtgaccaaagagatccgtattcccactctggaatcctgtgatacctgtcatggcagtggcgcaaaagcgggtaccaacccagaaacctgctcaacctgtcacggtgcagggcaagtgcatatgcgacaaggattctttacggttcagcagccgtgtccgcaatgtcatgggcgtggaaaagttatcaaagagacttgcggaaaatgtcatgggcatggccgtgttgagaaatacaaaaccctgtccgttaaaattccagcaggcgtcgataccggtgatcgcattcgcttgggtggtgaaggtgaagcgggtgaacacggtgcaccagcaggtgatttgtatgttcaggttcaggtcaaggcgcatcatatcttcgagcgtgatggcagcaacctttactgtgaagtaccgattaacttcgcaactgcggcactgggcggtgaaattgaagtcccaacccttgatggccgtgtcagcctgaaaatccctgcggaaactcagacgggtaaattgttccgcatgaaaggcaagggcgtgaaatccgtccgtggcggcgctcagggcgatttactgtgtcgtgtcgtggtagaaacgccggtgaagctgaacgacgaacagaaagacttactgcgcaagctgggtgaatctttgggtggcaagagtggtgaaaccaatagcccacgctccaagagtttcattgacggcgtgaagaagttttttgacgatttgactaagtaatttaatgtttttataaaatcgttggtattagttcccttgattatctttttgaactgataatcaggggaatatattcagtagtcgttttcatctcaatcttaccccttacttttgtcatagaagcaggaaaaattctttttcactttagatattatccatctacaaattaatttaaaaaatgcgcatacagataagtcaggaaaatgtaatctatagataattttctttttttatatcattaaatatgaaagcttccgtaactcactattttatatacttattattagaaaaaataacaataggaaagaaatttaattatcaaatataagtcattagttaattttttcatggagagggagttcatgtgaatgtattaaaatcctagtgattagtagtattttttccagataaattaaaattatagcatattggataaaatacgataaaaacttggattcacatattaagcgcaacaccgtaatggacgaagtaaatgagagggtattcctttaaataactcattcggtgttttgtaatctcgtgttttacgaggacgattatttaatcggtttgccacaaggttaatctcccgctctgacaccttattaaaatcagttccttttgggaagtaatctctgattaatccattcgtgttctcatttatccctctttcccagggggaatacgggtgagcaaaataaatttttgtctctaaatttttactgatcagttcgtgttcggcaaattcgaggccgttatcaaaggtcattgttttaattttatgttttatcagtgataaatgtcttgttgccgcttttgcgaccccttctgctgttttattttcaagtttaattatgatagtaaataacgattttcgttcaactaatgtcaataatgcacttttatgatttttacccacgatagtatctccttcccaatcaccaatacgctgctttttatcaacaagtttggggcgcttatcaatactgactctgtttttaatttttcctctgcgctcataacttccatagcgtttacgatacggttttttcgcaatcctaagatgttgccataaattaccatcattaagtttatccttataaatcaatcgataaactgtttcatgatgcaaagatattatattttcccttttgagataaccgactgtttgttcaggacttaaatcttgccaaattaactgtttgatccacatttctatctctggtttcacttttactgcttttgtagcacactgtcggcgcgctacggccttaagctgagcttgttcaggcgtatatttctttgcctcccgatttcgtctcaattcccggctaatcgttgatgggtttcgattgagtgactttgaaatctcccgttgtgaaaaaccggcttctttcaggctgaaaatctgatatctttctgtttcggtcagttgtttataggccatagcgcattttcctttggcgagaaagatgcctactatagcaactgaccgcctttcttagaaattgcacttattatgcgaatccaagatctatcaataattaattaaaatatatcagataaaaatattctatattttagtaaattctactgattaaaagatatattttccgtttagagagttggataatcgatagctagtttgttatagttgaaaagcagaacatcgagtcaaaaatattctactaaatccaaatgaggtctgaatcatgttagaagattccccaaaagatgcccaaaaagactctactaatccccttaaagatatgccctacgaacaaggtaagttattgaaatcaagatgtatcatgatatctggcgaaattaatcaagcactagccgaaaaggtaacaactcagctattagttttacaagaaataaataatgatccaataaagatttttattaacagtcaaggcgggcatgttgaggctggtgataccattcatgacttgattaaatttataagaccagaagtctttataataggtacaggttgggttgcaagtgctggtattaccatatttcttgccgctaggaaagaaaatcgttattctctccctaatacccgttttatgattcatcaacctttaggtggatatcaaggaaaagcatcagatatagagattgaagctaaggaattcttatttatacgcagccgtataaataaacttatcagtgatgctacaggacaatcgatagaaaaagtagaaaaggacactgataggaattactggatgcgcccacagcaagctattgaatatgggattgtcggccgcataataactaaatgggacgacatccaataatgtaaatggaaaatagggtgggcagaagttcacccattatttcatatataaattcattatcgctttaaaaattttggtgcttgccattcattatgtagaattgcatacatatacatgtcactccaaattccattaacacgttcattttgtaataggtgagcttcttgacgcattccgagtttttcaactaatcgtttagaaccaagatttaaaacatctaattttgcataaatccgatggcatctaaaatattcaaaactaatatcaatcagtgcccctaaagattctgttccaatggactttctttgataaaatgggtgaaagatacaacctatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtatatatatcaatatattaaaaaattaaaataaaaatttctttcatttaactcagtgattatttactgaatgtcatataaatttgtaggtgaaataaattaatcgtaagttgatttattgtaaatatgatgccaaattatgttttgcgaggattatctcgtaatattaaaatcatttaattaataaaacacaacaactctatattatggaggctatatgaatagttctataaaatccggtgttcgtcctgatgccttaaaatccggtgttcgccccgatgctttgaaaacaggtgttcgttctgacgctctaaaaacaggtgttcgtcccgacgctttgaaaacaggtgttcgtcctgatgctattattgactaaatcaataattagttatgtaagccagcttatagctggcttattgtctatattcaaaacattcacaaacgaaatggataaaaatatgacaattgattttcacaaagaagtttgggaaggatttgatcaaaaaacaaattatggaaagacaccttttcttttccagtcagttcttcctttaaatgaggggttttccaatcatgaaactgttaaagatgcattttataatttatgcagtaaatctaatttactaaaaactgattgccgcttgcgtatctatgatggtgaaaaacgtcgtgatgatcttgtcgaaaaattatcatctgaaaccatattatcggatgaaacgttgacacatttcatgcaacgattaagtggaaaagagcgtttcagtttagtgattaataaccttgagcaatcttgtccaaagctagcagctgatttcggcttatttgcgcaatctttctttgcttataaaggtattcctattggtggaatagaacaagcaactttttgtggcaattattctggtactgcttttggtatacacgaaggttttgaacatgcatttttgtgtcatttaggaccgggtattaagtatttttattgttggtcaagagaactttatttggaaataactggctcacgcgaacccacgttctcagattcagaactatatgataaattaatagaaaaaggaacgctttatatacttaagccgggtgatgccttgtatttaccagcatcagtttatcatgtcggtcgtcaagaagaattttcggtatcaattgcactgccattttatacttatccattgtcgcgttttatggcattaaaaatacttcctgctctcagtgaacaatcgcttccctttgatcaagaaggcatgtcagaattaattaaatttgataataatcaatttgatatagaaccactctcaactcttttaacagaaacaataaataaatggttccaacaagatctaccgaaatacttacactattactggcatcgacttcgtagtaacggaggatgggaactacctacgactataagtgcagatccattaaaggaacccgaacatcaaaatgatttaatcattaatcctgattctcaagtatcattacaggctccatttattgttagttacgagcatggattaaattgttcttctgatgaaattcgcgtatttattgcaacaaaaagtgtaatattacctgccagttctgagactttaaagcttttggatacacttaatactcgacaacccattacaatacattctgaagatgtttatacctcactgaaaatattaataggcacaggtggtttattctgtcattaattaataaggaataaaaaatgtatagaaatttcccagcattagtggatgattatctgaataaaaatatttctactgcaaatttaattaatagtattattagtgaaggaaaagcaaaaattgatggaaatgagctaattgataaacatttagatcctatgattacaattatttataatcaaattaaagatctcataaacccatcaaatcttagtcaggaagaagcaaaattatatattggtgagctttctgtatttgctcgttacaattccactatgttattaagagcagccgataatattcgtggtttttgtcctgagtttgctcaagaattaacacgaaactttttggaagaaggtggagaacgaggaaagttacctgcccactatgttgtttttagcggagcactcattgcggacgtaaattttagagtgaatggctggatgccacggacttcttcaacacgtgctcttatttctttaatcgacatacttacgtggtctcattgcccttcaacggtactgggcatgtattatgcaaccgaagctattgctatcgcggaaactctacttttacaagatattaccaatcgtctaggacaaattactggtcgaggaacaggaaattcattaaaaaaacttgatttttattatcgaatgcacttggatgaaactcatagcgctgcaactgataatgtagcagttgaacgcgggcatcaagaaggtattgctagattcatcagggatgcagatctattccattttcagcaaccccagattgtggatggcttccttcaaatgcttactccttttgttgatcagtgggttgagattcatcatttaacccgaacagatcactgttacagtcattaacattttagggtaattatatgaaaaaaattgaattttctggtgggtgtctttgtggtcatatccgatttatagcgacaggtgaggctggtaatcctcatacatgttcttgctctatgtgccagcaacattctggggcattgactctatgttggattgaatttccgaaagccgcagtccactggaatgggccgggtggcgttccctctgtatttcgttcttccgactattctagtcgtgctttttgctcacaatgtggaagttctctaggagcaatagacgatggcccaacagtcggactgctattaggtaattttgatagtaaaaacaaaaaaaaccttcgcccagtttcacattcatttatatcgtcacgcccccgttggtggaaaatcgatactcaatcctaatagagagaaaagcaaatgttgaattctccaatattatataaagcggcgatgattcgccgcatacgcacttttcttgattctcagaaatttattgaaattatgactcccgttatgcgccgttattctggtgatgactctcgtccacgactctcgctacataatggaggttggctaagagagtcttcggcttttgccttacgctacaatcttcaattctatgatcgtatctatgaaataggtcctagtttccggcctgatacagtggatgatacacacctaccagaatttacaatgcttgatttatataaaaaagattctactcttgatgaaatgcttcaacttgcacaatcaataatagaaatattttatcaagggaaaataagtgtattatcgttttctgatcatcttaagcaacggtttttagttgacttttttgaagattgttccgctcccgaaatatttattgattgtttacgagaaatgtattgtgacaaaaaaactcccccgctaaatctaattgatcgctatattattgagaatattgaacctctatcacaacaatgctgtattatcgtaacggattttcctttgctcaccgagatacgagcaaagaaaagaacaggaacaaaaggaatcgtcgagcgtttcgaaattttgattgatgggatcgaaattgttcatggttatactgacgaagatgatgtagagcgttttgaaactcaggctcggaaacgtaacatgtttgggtctgaagatgaggtgatgtgtaccatgatgagaaataaattggtatctccttccagcgctggatttgctattggtatagaaagattatgtcaagttgcattaggagaaaaacaaatatctgcatttgcaacttcgcgtccgttttctcctttttaattttcaaataacgaaatatttatcggaaatcattatatggtgacattcaatgaatggtttattatggccttttctatcgcattggttttaatcgttcctgggccaacaaatactttacttttatcagctgggttacagcaagggttaagtaaatctcttattctcgttattgccgaagccataggatatacagtggctattgcaatttggggattttttttgctatctctgacacagacgttgtcttggatataccagtttgtgaagctattgtccgcgatttatatattgtggctagcttttaaattatggatgtatagcttaaaaatagattattttacagataatcagatgaatttaataaatatttccgcccataaaagtacaaatttccttgatgttatggtagccacatttttgaatccaaaagccttattattcgtaagtacttttattccgataagcacttttaaatctatgaatactttttttcctatgcttggtatttttttgttaatcttagtaccaataggtacattatggatatctatcggaagcttaattcattcctataaatacttacgtagatttactgccatttttctgcggatatcatccgtaattctgatactattttcattctcgttaacttattcaggaatagcaaaggctgaaagttcactggttttgtacaattggcaaagttatacaagtccagagatgctccaaaaattcaaaaaagagcataatatcagcattactctattagaatacaaatcaaatgaagaagcattagaaagcattcagcttggaaaaattaatgctgaccttgctgttgtagcggataattttttgcttcactggataaacgccggacttctgcaacctattaatgttcagtcaatgacaaatttcaaaaatattaccccccgatggcgctcatctcctgctgatccgcaacggacttatggtattccttggtcttggggcgttgttggcactgtcgtccatacagatgttcacgatggtgatattaatacatggaaggttgttttagaaccgccaacatcattatttggtactattaatgtgggttcagacatgaatgatcttatttatgcggccattcgctatcatgggggtaaaatatgtgactcaaatcctaaattacttgaaaaagttaagaagaccttacttgaagcaaaaaaacattgggccgcaatggaatatggtagtgtcaatatgatggcttcgggaaaatttaaagcaggtattgactggaatggtgcagcgttgcgtcaacgtagaattaactctcatattcagtttggctttccgcgtgaaggtgtattaatattcagtgataatcttgtcattcttaaaagatcgaaaaattatgaaaatgccagattatttcttaattttattatgcaacctgagaatgccgcattgaattctgcatttcatggctatgacagtaccatagaaggggctgataaatttttaccctcatggatgaaaaatgcacttgaacttaaaattcctgaacatgtattaaaaaattcagatcattcgatcatgtgcccaccttttgttcaaaaaaagtatcttaatatctggcaacagcttttaaaataagtttattgttgtttccgtgacagtgtcacccatattaattaaaccggacgtcttgccattagcggcacattttttcgttttctggttcggtgtgctttccaatattaccccgccgccggcagcgacggcttcgatggagattggaagcagggcgagatctcacattttgatggggttatttatgttaaataaaaatcagggcgtgactttttataagcatttctattattaaaacagtaagatcacattattccataaacagtgatcttaataatgagtatttttaactttatcaggaagatagatgacccacgttctgacatcaataaaaaacatgagctaatggatgtgattttcttagccttttctgctgtgttatgtggggcttctggttggaaatcgattcaagaatttggtgagttacaaatcgaatggcttaaagagtgtttgaagccttgcatgtggtcagtgcttatgatgttgaatcgggtgttgccctcggccattgtgccgccgaaagcaaaggtaaggaaggctaggttgccaggcaattgattaaatgacttgctcttgatggtgcacttgtcaccatggatgccctacattgtcagaaagaaacccttgggttgattaaccaacgaggcggggattttattgttggcctcaaaggcaatcaaaaaaaattctatgagtttgttaaaccgcattttgctgcaccttatgaccacgatgaacgggctgaatttacagagaaaaatagcagtcatggacggaaagaattccgtcatgtcatgcaaatccgtgctgcattacctgagcaacttcagcaacagtggccttcaatacaaagtgtgattgaaatcgtcagtaaacgaagtgtgaaaggtcaaccttcctgccgtgattcacgctggtatgtcagctctctcccgttagatgcggaaattgccgccaaggcaataagaaggcactggtcggtggaaaacaagctgcattgggtattttcgggaagacgctctatcactcaaagaccctgatggcgcggcacaaatggcgctttttaacccaatggcgttaaatgtgattaaataaaataatatttagaaacagcatcaccctttaaataaaaaacaacatacctgtaatagcgggaatttctttaaataaaacaaaaaattcccgctctggctctcatcaggctattaaagatcttttaaaaattcagccagaatcgggttaaaaatatctggtgcttcccagaatggcgcatgatcaacgccggccaagttaaacacctggccttgccaaaggtttctataatttaatccattaatataatcgtgattaatgaaaggatcaccgacaccattgacgatagccaaaggaacttcactggtttcagccaataatttctgatctgtcgcctgaggggaaataaaagcttcaaacatatattgccgagctaacccgtctgttcttgccacggcttctatcataaacggttcatgaggtgcattgacgccgtttgtctcacaggcaaagtttctgacatcctcgtcagtaaattccgctttaccggtcagtctcatctgtttgctctgacaaaaaccacgggctatattctctttcccaacggccactggcggcgtgccacaaatcatcagcccgatcattttaggattcagtgccagcatttccaacccaatatgccccccgagtgaccagccaaagactacgactttatcaatgtccatcttatccagtacttccatgatggtgcgggcataaccgggcattgagtatgcttcacgcggatcgctggcgtcagaagatttaccgtggccgggtaaatccaatgccagaacccgatagtccccttttaaatattcaatttgatgacgaaaaatttctttacagcttgaattaccatgtatcaggagcactggcagcccacttccaccagtatcgagaactgaaatattggcataacgggtctgaatatcatcatgtgtagcaaccattattctatctcctcaaggatcaatcacagattaattgctaaattagaaaatatgttaccggagtaatgatttccatattaatctttacaagatattaccaatcgtctaggacaaattactggtcaaggaacagaggattcattaaaaaaacttgatctttatcatcaaatgaacttggatgaaactcatcacgctgcaactgataatgtagcagtttaaagcgggcatcaagaaggtattgctcgattcatcatttaacccgaacagatcactgttacagtcattaacattctagggtaattatatgaaaaaaactaaactttctagccccgtctataggggcaatgacccagttaaaatctgatatctctgtggtatctaacccttcaccttgaacacatctgctcactgttaatttcattctggagagctgctaagttagtttccaatttataaaccaccgcataagtctgtaaagcttccagtcacgaatgaagcttcgtcactaagtagccaaagaatcgcatttgcaacctcttcaggcgttccacctctttgcatcgggaaattcttggcaatacgatcaactctagaaggttcgcctccatcagcatggatatcggtgtaaatgcctcccggacgaacgcagttgactcgtatgccgtcagcggcgacttctttagataatcctgtagtaaaggtatcaactgcacctttcgacgcagcataatcaatgtattcgaaaggtgagccacttttcgatgcacctgatgaaacgttaacaattgaacctccagagcctcctctagaaatcgacatacgcttaatcgcctcagaagagcaataaaaatgactcattacattggtcaatagtacttgttgaaatcgttccccatccatatcaattaagggcattttttgttttaagatcccaacattattgacaaggtgagtaatacttcctaactgagtatcaatgtcgtcgaacattttttttacttgatgctcattggaaacgtcagcacgtacagtgatacatttggcacccagatttagaatctcatcacggactttaaacgcagacttttcatcgtttaaataatttaaacatatagaatatcctttatttgctgccagtatagcggtagccgctccaatacctcgactagaggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgacctaggataagacgaaaagtgatcgcccatgtttttgattacaggacaaaaaagacattaatgcgcctactggctttgctgactcctttcaatattattatttatatgacggatggttggcaaagttatgaaaaggcgttagcggggaaactgcatgtggccagcaagcgttatacccaacgcatagataaataaattggagtcatgacttttaatgagttatttattatcctgtcaatatttaataaaaaattaaacaaaaaaataatttaataatagtaatacttaatgccatctattttctttatctaaagcgtcgacattaaaacacaaatgattctcattaacaaaagctagtaataacaaagggaaatcatccttattcatttcagggatatatataccaaatgttggttattaatttttatgaggataaatccgatatgttagattttttattttgaatgataaaaatgtgtatcaatatatccgacagacccattaaaaaaatactaacagaaatattaatacttcaatttttctactcataatatttttcttatttgcgctatttcagactcaattttcccattaaaaatagaaaaaccgccgcaataaactgctaaaaacacacaaacagttcattccggcggcttttattccaccatttaataaatcacttaattaatatattaatgtggtaccgctatcagctactcattttctgtctctatatcttcctgaacgaggtttccgatggaagtaaactcatccagcaacgctaaaagctgagccaattttgctggagaaaaagcatcttcaatcgccttataaccatcattaacctgctctctggcctgttcgtaaagctcctgaccagccggtgtcagggaaacatacagcttacgctgatcattcattggtttcaggcggaagataagtccatcacgttccatacgtgtcagaatgcccgtcaagcttgggcgtaagatgcaggtgagacaagctaaatcatggaaatcaatcgaacggctactcgcaagtacacgaataatacgccattgttgctcagtcaagttatagcttttcaaaataggacggaaaaaacccattgcggtttcccgtgcctgaagcaatgcaattgtcagggattcatgcataagtaaaggtgactcttaagttaaccactagtcattctctataaactgaacgcgtacgctattcattatagacaacataaacgtcaaaaagactaacatggtcataattatctacaaagggaaaagaattcaacattaacaaataaataaaattattctgccaaacaaaagttaaaaataagttaaattcaatgccaaatgaccttatgaattaagataacaatttgatctttctgtgggaaaaacaatcaatactagaatgatgttacatggatcacaattaaaattaacaattacattaacatattgaacattgacggcagttgatttattaatatattaataaacaatcttgcgatacgtcgttcaggtttcaaggagttgttaatgaaaggcactgtttttgccgtcgccctcaaccatcgcagtcaactcgatttctggcatgaggcatttgatgagctaccttataaaacgccaccaaaaactccaatttggtttattaaaccccgcaatacggtgattgtctccggtgatattattcctcatcccatcggggaaacggtacaaagcggtgcaacgctggcactgctgattggcaaaaccgcccgtaaagtttctattcaggatgcagaacaatatatcgcgggttatgcattggccaatgaggtcagcctgccagaaacttcgttttatcgtcccgctatcaaagaaaaatgccgggatggattttgtccgataggccagataatcacaacaaaatcagtagattcactcgatatcatcactgaaatcaacggtcaggcagttgatcgctggtcaacccgcgatcttgtgcgttctgcttcggaactcctggcggcattaagtgatttttccacgttaaacgaaggcgatgtcatcctgctcggcaccccccatcagcgtgttactctccaccctaacgacatcgtcacggtcaaagctgaaggttttcctgcgttgaaaaacacagtcgttttggaagacatcacgttgaaaggtagcgatttggaaggaatggcgcaggcgggaggtcagtcatgagacaagccagagtacgttatcagaaccaagaaatgagtgttatcgtcgatgagcaggaaaatatcctgctgtctgatgggtgcgtcgtcagcggacgcgatgttttgtggctccctcctgccaatggcaccctgttcgcattgggactgaattatgccgaccacgccacggagctggaatttaagccaccggaagagccgctgatcttcatcaaagccgccaatagtctaaccggccatcgtcaggtttccgtccggccggacaatgtggaatacatgcattatgaagcggagttggttgttgtgattggcaaacccgcccgcaatgtttccagagaacaggctatgggttatgtcgcgggttataccgtctgtaatgactacgctatccgtgattatctggaaaattattatcgtcccaatctgcgcgtgaaaagccgcgatacgctcaccccgataggcccgtggatcgtggataaaaatgcaatagccgatccccataacctgatattgagcacccgggtcaacggggaattacgtcaacgcggcacaacggcagacctgatctttgatattcctttcctgattgcctacctgagcagttttatgacactacagccgggagacatgattgccacaggaacgccgaaagggctgtcagatgttgtgccgggtgatgaagtgattgtgtccgtcgaaggtgtcgggagcctggtgaatcacattgtcagccagcaagaatatgaggaaaacctgtcatgaccactattaatcattggatcaacggcaagaacgttgccagtaacacctattttgaaaccaccaatcccgccaccggcgaagtgctggcgcaagtggcatccggtgggcagacagagattgatcaggcggttgcagcggcaaaagacgcttttcccaaatgggcggatacgccaatgaaagaacgtgcccgcctgatgcgccgtttaggggagttgattgaccagaatgtacccgatattgccgcgatggaaaccaaggataccggcctgcccatccaccagacgcaaaatgtgctgatcccgcgcgcttcccataatttcgatttcttcgctgagatttgccagcagatgaacgggcggacttatccggttgatgacaagatgctcaactatacgctgatccagcctgtcggggtttgtgcgctgatttctccgtggaatgtgcctttcatgactgcaacgtggaaagtggcaccgtgtctggcgctgggcaataccgccgtgctgaagatgtctgaactttccccattgaccgccaaccgtctgggcgaactggcgctggaagcgggtattccggctggtgtgctgaatgtggtgcagggatatggcaataccgccggcgatgcgctggtaaaacatcatgatgtgcgggcgatctcgtttacgggaggaaccgcaactggccgccggattatgcaaagtgcgggcctgaaaaaatattcgatggagctgggtggcaaatcccctgttctgatctttgaagatgcggatattgaacgtgcgctggattcagcgctgttcacgattttctccctcaatggcgaacgctgtaccgccggttcccgtattttcattcaagaaagtatctaccccgaattcgttaaacgctttgctgaacgcgccaatcgcctgcgtgtaggcgatccacaagatccgaatactcaggtcggtagcttaatcagtcagtcgcactgggaaaaagtctccggctatattcgtctcggtattgaagaaggagcaacgctgctggccggcggctctgataagcccgccgatctgcctgatcatctgaaaaagggtcattttctgcggccaaccgtgctggcagatgtgaataaccggatgcgcgtggcacaggaagagatcttcggccccgttgcctgtctgctgccttttaaaagtgaagaggacggcctgcgcatggccaatgatgtggaatacggtctggcgtcttatatctggacgcaggatgtcagcaaagttctgcgtctggcacgtagcattgaggccggcatggtgttcgtcaattcccagaatgttcgcgatctacgccagccgttcggcggtgtgaaagcctccggtacaggacgcgaaggcggggaatacagtcttgaagtgtttgccgaagtgaaaaacgtctgtatctcaatgggagatcatcccattcctcgttggggagtgtaattgatcccagcgttaaccacggttcatcgtcctgatatcaagtgaggatttatgggaaagttagcgttagccgcgaaaattacacatgtaccctcgatgtatttatctgaaatgccgggtaaacatcatggctgccggcagggggcgattgatggtcacaaagagataagccgccgttgccatgaaatgggcgtcgatacgatcatcgtgttcgatacccactggctggtcaacagtgcctatcatatcaactgtgccggacacttttccggcatttataccagtaatgagttaccgcattttattcgcgatatgacttatgaatatgacggcaatcctgaactcggccggatgattgcggaagaagcccgccagatgggggttcgcgctcaatcacatgaaatctccagcctgaaattagaatacggcacactggttcccatgcgttatatgaacagtgaccatcatttcaaagtaatttcgatttcggccttttgtaccgttcatgcctttgaagacagccgcaagctgggtgaagccgtgttgcgggcgattgagaaatatgacggtacggtagcggtactggccagcggctcgatgtcgcacagtttcattgatgatcaacgcgccgaagaaggaatgaacagctacacccgcgagtttgatgagcagatggatcgccgagtggtgcaactttggaaggaaggtcagttcaaggagttctgcaaaatgctgccagagtatgcgcaatattgccgtggtgaaggcaatatgcacgacacagtgatgttgctcggcctgctcggttgggacaaatacgacggtaaggtggaatttctcaccgaattgttcgccagttcaggaacagggcaagtgaacgccgttttcccgctatctgatgatgcggttaatgaacaaaccaccgaaaaaatcagagcctgacaggagcagaccatgccacatttttacgctgaatgtaccgaaaatatccgtgaatccgccagattaccggcgctgtttgccaacgtgaatcaggcgctggccgagacggggattttcccgctgggcggcatccgcagccgcgcaatctggctggatacatggcaaatggcagatggcgaacaagattacgcctttgtccacatgacgctgaaaatcggcgcaggacgcagcctcgaggatcgtcaacaggtcggtgaaatgctgtttacgttaatcaaaacacactttgccgatttgatggcacagcgttatcttggactctctttcacaatggaagaacttgatccgatcctgaattataaatcgaataatgtacatcagctgtttaaatcaaaagattagacttaacgaatggcataattcagcacaataaagttcacctttttgcataatgaagagaaaatcatgaccaatcatctagagacattactgctgcgccaacaggcttatatcaatggtcaatgggttgatgcgcataataaaacgacgtttgccgttatcaatcccgccaatggcgaagttattgccaatgtcagtgatatgggttgtgcagagacgcaacaagccattgaagccgcccagactgcccttcccgcatggcgggcattgactgccaagcagcgcagccaaaagcttaagcaatggttccatctaatcatggataaccaaaaatcgttagcggaactgctgagtgccgaacagggaaaaccccatgcggaagcgatgggagaaattgcctatggtgccagttttatcgaatggtttgcggaagaaggtaaacgcatttatggcgaaactatcccatcaccgatgccgggtcgtcgtctcgcgaccatcaaacagccgataggcgttgtagccgcgattacgccgtggaatttccccaatgccatgatcacccgtaaagttggcccggcactggccgcaggttgtacggttgtactgaaacctgccgcagaaactccgctgtctgcgctggcattagcagtactggctgaacaggcgggcattccggcaggtgtcctgaatattgtcaccggtatagatgccaaagcaattggcgaaacactgacttcaagccctatcgtacgcaaactctcttttaccggttctacccgtgttggcaagttactgatggcgcaaagtgccgataccgtcaagaagctttctctcgaactgggcggcaatgcgccttttattgtctttgatgatgcggatcttgatgcagctgtggaaggcgcgatggcgacgaaattccgcaacagcggacagacttgtgtcagtgccaaccggatcctggtacaagaaggcgtttatgatgcgtttgctgaacgtctggttcatgctgtcaaacaacttcgcgtcgggccgactcatagcgattcatcacaacctgtgccacaacaagggccactgattaatcaggcggctgtggaaaaaatacaggcacatatcagcgatgcggtttcccacggcgcgcgtattctggccggcggcaagtcccacaccttgggtgggttattctttgaacccaccgtgctggccgatgtggatgattccatgcgggtcagccatgaagaaaccttcggcccactggcgccgctgatcaaattccgcgatgaagcagaagccattcgcctcgccaatgatacagaatttggcctcgcggcttatttctattcccgcgatattggccggatttaccgggtggcagaagcactggaaagcggcatggtcggcatcaatgaaggtttgatttccaacgaagttgttccattcggaggcataaaacagtctggtctggggcgtgaaggttcacgttacggtatcgaagattatctagaagtgaaatatctctgttttgggggtttgggcactaaaggagcttaacacgctatgcaacagcagctacagcaagaagtcatatcacaggttgcacgccgtttacatcaggcagaaaaaaaccggcagcagatccggcagatttcactggattacccagaaataacgattgaagacgcctacgccattcagcgtgagtgggttaacttgaaaatcgcggaaggccgggtgctcaaagggcataaaatcggcctgacatcccgagccatgcaagtcagttcacaaattgaggaaccggactatggcgcattactggatgatatgttttttcaggacggcagtgatattccctgcgagcgctttattgtgccgcgcattgaggtagagttggcctttgtgctggcaaaacccctgcgtggcccaaactgtacgctgtttgatgtctataacgccacagattacatcattccggcgctggagttgatcgatgcccgcagtcacaacatcgatcctgagacccagcgcccgcgtaaagtgttcgatacgatctctgataatgccgccaatggcggtgtcattatgggcgggcgccccatcaggccggatgagctggatctgcgctgggtcagcgccctgctctatcgtaatggggtgattgaagaatccggcgtagcggctgcggtgcttaaccatcctgccaatggtgtcgcatggttagccaataaactggctctgcacggtgtccagctcgaagctggtcagatcattcttggcggttcctttacccgcccggtgcctgcccgcaaaggcgatacttttcatgtggattacggcgcaatgggttcaattagctgccattttgtttaatggccggacgttacgtttgaaggtaagtttatggatctgttaaccaatagatttaagcaagccctgaaagcagggcatccacaaatcggtttatggcttggcctgtgcagtggatacagcgcggaaattctggcaggagccgggttcgactggctgctgattgatggcgaacacgcgcccaatcatattccctcaatcctgacccaattgcaggcaattgcaccctatccaagccagccggttgttcgctcaccatggaacgatcaggtgcttattaagcaacttctcgatatcggcgcacagacgttgctggtgccgatgattcagaacgcggagcaagcccgcgaagccgtgcgtgcgacccgctatcctcccgccggcattcggggcgtaggcagtgcactggcaagggcttcccgctggaatcgcattcccgattatctggctcgtgccaatgatgaaatctgtgttttggtacaagtggaaactcgcgaagccctgcgcaatctgccggatattctgaccgtcgaaggtgtcgatggcgtgtttatcggccctgccgatctcagtgcagatatgggctattccggtaaccctcagcaccctgaagtcaaagcagccattgagcaggccatccgtcagatagcggcatcagacaaagccgcagggattttaatgacccatgtcgaaacggcggaacattaccttaatctgggtgcactatttgttgccgtcggggtcgatacaacgttgctgacaacagctgctaactcgctggcagcgcgcttcggcaaaaaacaggagaagataaccccgtcttcattgagcacttattaaatcattctgattactgataacaccacaatcgattttcctacatggcagatgtcaatcgcagcatctgccaatacagtgacagttttcatgccagtttccataaaaacgcgacacgcatcgtataataaaaaaggtaacgacaatgagcagcccacctgaagccatacaagagccagaaaatccggcttacccacctcaaaaactcaccgatcggcagcaaaacgtcatcaacaaattgttccgccgcttgatcctgtttttatttgttctatttgtgttttcctttcttgatcgcatcaatatcggctttgccggtctgacgatgggaaaagatctcggcctgtcgtctacgatgtttgggctggctgctacgctgttttacgcgacttacgtgattttcggcattcccagtaatgtgatgctcagtgttgtcggcgcccgtcgctggattgccaccatcatggtgctgtgggggatcgcttctactgccacgatgtttgccaccggcccgacaagcctgtatatcctgcgtatgctggtcggcattgcggaagcgggtttcctgccggggattctggtctacctgacttattggtttcccgcctattatcgcgcccgcgccaatgccctgtttatgatcgcgatgccggtcacaatggcgtttggctcgctggcctccggttatattctggaaatggatggcatctgggatctgcgtggctggcaatggctgtttttgctggaaggcttcccttctgttctgctcggttttgtcgtctggttctatctggatgactcaccggaaaaagctaagtggctgacgcgtgaagataaacagtgtcttcaggagatgatggagcgcgataaactttcgcaagtgcaatccagtcgcccggccagctccaaaaccagcctgtggcgtgaagtttttaccccgattgtcctgatgtatactttcgcttatttttgcctgaccaatactctgagtgccattaatatctggacgccgcaaattatgcagagtttcaatcaggggagcagtcatgtgatgatcggtctgctgactgctattccccaattctgcactatcttaggaatgatttactggagtcgccgctcagaccgtctgcaagaacggaaaatgcacactgccctgccctatctgttcgcggcagcaggctgggttttgacctcactgactgaccacagcatggtgcaactgctggggattatcatggcttccacggggtcatttacggccatggcggtattttggactacgccggatcaatccatcagcctgcgcgcccgtgccattgggatcgccgtcatcaatgccacaggtaatgtgggttctgctgtcagcccgctgttgattggctggctaaaagatcaaacgggcagtttcaactcaggtctctatttcgtcgccggactgctgattatcggggctttgatggtttcatttatcccgatgaagcaaacgcagcgttcaggggataactattgatgccagcctccaacacacgcaaagtcattattaccaatattgatatcagtaaagactatgatgaaacgcagggatctgacgatgtgcactatcagacttttggtcgcatggccgcgttctttggccgtgatatgcaggcgcatcgtcatgatggtttttttcaacttcactatctggtgaccggacggattgagctgcaactggatgaactacgctattcagtacaggcaccgctgtttatcctgacgcctccttcggttcctcacgctttctttacgcaggaagataccgatggttatgtcctgacggtgcgtcaagcattgattacgccgctgctcaattcgctctaccccacccatcgggaactggttgatattccggccatctgcctttctgtggcagataagcccgatgaattggcgacattcaatcactattgggcgctgatcgggcgtgaatctgccaatcaattcgcaggacgtgaacaatcactggcatttctggcgcaatcactgtttacctttctgctgcgcagcattccccttgatgatcaccgctctggcggggtaagaggagaactaaaactgtttcagcgttttaaccagttgattgaacagcattatcatcagcatcttgctgtaccggaatatgcggaaaaactgggaattaccgaatctcgcctcaaagatatgtgccgaaggtttgccaatcggccacccaaaaaattgatttttgaccgattattacgggaagcaaaacggctgctgctgtttagtgacagcccggtgtttgaaattgcgtatcagctgggatttaaagatccggcttattttacgcgtttttttaatcggttaatgggatgtgcaccaagtgtttggcgggagaggagtgtgtaaaatgcaggggattttaaacggttctgttgcattaacggagaaagtctaagtcaatgtggagttcgttactctttattcagccaatcgataaaacatctctgtcggtgacaatatcttatcttcaggttgtgagtattcagcaaggcgatggcggcggtgttgtccccactcttatcaagggtgatgatgtcaggctccccgtagtggcgtagggctttacggaaaaaacgcaaagcggcagcggtatctcggttggcggtcaataaaaaaatcaataggttgaccggaggtatcaccgcccgatacaggtatttccactgacctttgattttgatataggtttcacccatacaccagccacgagccacgggacgtttatgtcgacgaaaggccttacccagtaatggtgtgagcctgataacccaacggtataagggagaatggtcaacacgtatccctcgctcggtcatcatctcttcgagattgcgtagacttagaatgatatcaacggggtaatgcaaccgtttgaaggcttttcgtatcaacgacattgacgatacttttatcaacaaataagtgagatattaccaaggctttgcttattgcaacagaacctaaaaattcgccagtcgttttatattttcgttaatttcagttgggatatgggcggcatagccaaaaagaatagcgttatcagaaaaagaatgaatacagtagcgtgataatggttgtgcccctaaatttaattgcctgcaatgtgtaataatatcttcttcattaaaaccgtcttttaaccgacacaccatatgtatgcctgagtcagttatattcatatcgaaaacatgagaaaggtatctgtttatagcataaaatagtgcggtttatttgtttaaaagcggtgccactgacaccgctacaatctgtacagaacttattatttcttatctgctgtgatacgatcacgaatatgttgagcacgctcctgtgaaggcggatgtgaatcaaacatgctggatttaccactgcccagtttagccagtttctcgaagccggatgctaaacctccagtgttgatattgcgttttttcagcagatcataagagaagtcatcagcctgactttcctgatgttgtgagaactgcgagttgatcagtttttcacccagtgctgcaaactgagaatcgcttagttgtgcagctacaccaccggctgatgtagctgcggtacgtgcagcaactgtagcataagcaatctgcattgctttacgggagtgacccagtgcaacgtgacccatttcatggcctagaacgccttcgacttcattgtcgttcatcattttcatcaggccgctgtatacacgtacacaaccgttagccattgcccatgcgttcacatcatcagtcagataaactttatagttaaccggtgtgccgttaacttcgctacctaatgctttggcgattttgttcagacgtttagtgtattggctggatgccggtgcagttttattccgtgcatccatatccttacatgcttggtcagaaaactgtttgacatcagagtcacttagcgtcgccgcctgaaataattgcattccagagctagccagcattccatgatcaatattcttacaacctgtcagaattacagcagaaactgctactgcaacaagagttttaattttcataatgtttccctttgccatacaagcaacttttttattttaaaagcattaaaagaccgtggattctgctaaaaataataatagaaataaacctaatatttatgattatgtgaatttgataacattttaaacaaaataataaaatcataagaaaaataatttagtttaagcttacttaactaaatcgcttttcgtcggtcatgataccaatttattgatagtgatgaatgtttaaacaataccctatgaccctgtcatgtattgctatggattttgaaaaagacaacgtttgcgagtcagtctgacgaagaattatgtctctctatacgttgtgcataacgcttactgaccacatgcagcttctccagacattggttatatagatcacaatgttgaagggagccagtagcgctatcagacgcatcaaggttttctttgttcttgagccaaaaacgggggcgattaccttccgtctgatccggtcatcagcataaaagagctaacggggctgatgctttgactccacatacggctactgctcacaattgatgttatgaccaacccggcggcaatttatgttgtcacagaaccagagtttatgcggcttgcagctacataaactccgattcaaatcaccaccagattaataatttaatatcccaacatttaactcaatcaaataagtccgtggatcaaaatcactccgatacataaaggcccgacatatctccatataaacagtaaacactgacggttccacgatgacatattatccggtattagtgcattgaccttacgtgaccagccaaatacgaggcaaatgataatcccgaataatggcatgagaacattggaagtaataaaatccagtatatcgaagatggattttccacctaatgtgacgtgacttagaggaccaaaagataaggaaacagggatccccattagcataatcgatgccgtgactattaagcttgctttacgacgcgaccactgaaaacgcgtttgaacataagcaacaatatgctcaagtaatgaaattgatgaggttagtgcagccattaataataataaaaagaaagtaactgctaagattgagccacctggaagattggcgaaataaattggcatcgtcataaatgttaatccgggtcccgcattgggttttaaaccagcagcggacaaagcaggaaaaatcatcaggccagccaatatacagaccaaacaggagaggattacaacccagatactcgatttaccaatgcctttgttattaggcaaataggagctgtacgtaatgtggatccccaaaccgatagacagtgaaaaaaatgctaaccctaatgcatctaaaacaccttttccggtcaaactactgaagtctgggtataagaataattttagcccttctgatgaaccaggtaaacggatgccgacaataattaacactatcatgatcaagaataacagtggcatcatgactttaactgacttttccaaacctttttgcacaccagataatactacgaaacaggttagccctgaaaatgtcagatgtgtgattatcggccaccatggattgctgatgaaaccggtgaaaatagatgtcagttgagaaatgtcggtaatattcaactttcctgtactcgccatcaccgtgtaacctatggtccaaccaccgacaacactgtagaagctatagatacaccatgaactgaatatacctataaagccaacccacccccagtgtttaccaagtaattttttaaacgcatcaatggccacttcacccgtactgcttcccagtatgttttcagctaacagaatcgctaatccaatcacaaagctaaacaataaaaatacaaccagaaatgcaccgccaccatttgttgctgaaacatacgagaatttccagatggcaccaatgccaacggcagatccggttgctgctaatacatgccccagacgggatgtccattgttgactcatgctaacccccgaatagatacagtatcagcacgtgtacttaggcccaccgccgtaagcaaaaaaccggcagcagcgttcgaaacatgcttacccgcttgcaggccagtcataggcagggaaatgatatttcctgccccgttgaatcgtgcaaaggtcataaagtccaatgcccaaatatttttagatgataaacggtatgtcataataattgttaacttattgttataaacataattgaacatgtaatagtaactattacaactatttaaatttccacgggagaaactggattctgatttaacagtcagtgataagtaccatattcactgatacgcataatatacagaatgatagtggtaataacagctagaatcgccaacaactgccccccagtcaaacttttaagttctaaaaggcatgtactaacgccttgtgaggagtccaagatgattactctattacagctgatcatgttgctcacagtgtagtcgtgaacataaattccaataatcctgatcagtatatatagttattgtgttattctttatttaactatgttattaaatgtttctttagataattttcctgtaaaattagaatttaattctaatatatgaacatttacaaacaacaaatattttacattttagcggataatttttatccgttttaattatttttccatatttatgcacttggcttcactttaaatataatagtttatataaccattttataataatatagatattaaaatatctatgattcttggattactgagttaacatatttaataatttattgttaatttctcatgatttcaggaggtattcttgtatatatttttatagtcatattacttatttaatgagggtaacgtacagtgatttgtcagacaatccggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccgacaatcctgtatgagcgtttaaaaattatatataaagaaaagggaaaatgtatgagcgattgggaggctgtccctgtattggctgcattggatctagatgaattggtttaattttacacaagtaaacttgggttccattgcgacaattttgttcctaatgaatatgcgataattagcagaggggaagctgaaatccatttttgggcatgtaacgataagtacattgcagagaacacttcttgctatattttcgtgaaagatatccagagtgtgtttcaagaactacaagcgcagactgaagtctctccgcttacggaaactccatggggcatgttggagttccacctaattgatccaaatggaaatttacttaagtttgggcagccagtttagctgtttaacgttctccccaactcctgtttatttatccaaatggagcctgtaaattaaattgtgtatttgccttagcttgatatggttaattttctatcaaaataaagttattttatgaactagaaacaattgcaggctcttgcccatgaactagataacctgagatttgcttaagaagggaactaaagtgcctgaggcacgatcaaagtttttgctaaagaaaacaaaattgtggagatcctcattttatttcatatgagccattatcgtgattttaaaacgttttatattaaataacctgagttccgcagtagattggagttcacgagaaaattcagacataaaaaaccggcctcagatgattatctgaagccgattatgacttatctcagttggcttaagcgaacggtattaccgtgttgggcgctttttttattatttagaataatggataactaaccaataaactccagccctttcatataaggacgcaatacttctggaatttcgatacggccatctgcctgctgatagttttccatcactgcaaccagagtacggcccacagccagaccagaaccattcagtgtatgcaccaactgggttttcttgtcatctttgctgcggaaacgtgcttgcatacgacgagcctgaaaatcccacatattagagcatgatgagatttcacggtaagtattctgcgctggcagccaaacttccagatcgtaagtttttcttgcgcttgcgcccatatcacccgtacatagcaacatcttgcggtaaggcaattttaataactgcaatactttttctgcatgtccagtcagttcttccaaagcatccattgatttttcaggatgggcaatctgaaccaattcaattttatcaaactggtgcatacggatcaggccacgagtatcacggccataagaacccgcttcagagcggaaacaaggtgtatgcgccgtcattttcagtggcaatgcactttcatccagaatatcaccacggacaaggttggtaaccggcacttccgcagttggaatcaaggcatagttactgccagtttcttcttccaatgggttggtgtggaacagatcttcaccaaatttaggcagctgaccagtgccatacagcgtttcatgattaaccagataaggtacataagtttccagataaccatgctgttcggtatgcagatccagcataaactgtgccagtgcacggtgcagacgagcaatctgacctttcattaccacgaaacgcgaacccgtcaattttactgcagcggcaaaatcaagaccgttggttaattcacccagtgctacatgatctttaacttcaaaaccatattggcgtggctcaccccagcggctaatttcctgattatcactgtcatcttttccataaggagaagaatcatcgggaatattaggcattcttaatgcgagctcacggatctctgcctgcaatgtttccaattcagctttcgctaaatcaagtttttctcccaactgattcacttcctgacgcagtggttcaatatcttcaccacgggctttcgctgcaccaatagccttcgatcgggaattacgttctgcttgcagggtttcagtttcaacttgtaaaactttacgacgctcttcttgtttacacagcgtctccacatcaagagtataacccctgcgagccagtttttcggcgactgcgtctagctcattacgcagcatatttggatcgagcatgctattcctgtgcttgttattgaaaaaattgttattgagaaaaaagtggtgaaatcagctcggactgaccaagccgacacatatacccttaccgcataaaccttaccgtatcaatggcattagcggtagcgttttatctggctattttgatcctgttcagttagccagtttaatttatcaccgatcttaccttccagccctctggctgtcggatgataatagcgggtctctcgcatttctggtgggaaataaacttcaccagcagcataagcattcggttcatcatgggcatagcggtatgcctcaccaaaccccatttccttcatgagtttggtaggcgcattgcgcaaatgttcaggaacgtcataatccggcttatcttgcgcatccaccatcgcggccttgaatgccatataaaccgcgttgcttttcggagcgcatgcgagataaacaatggcctgtgcaatcgcccgttccccttctgccgcgcctactcgtgtaaaacaatcccacgcggcaatagctacctgcatgcctcgcgggtcagcattacccacatcttcagatgcaatagccaataaacgacgggcaacataaagcggatcaccgcctgctgtaatgattctggcgtaccaataaagcgcagcatccggcgctgaaccacgtattgatttatgcagcgctgagattaaatcgtaataccgatcacctttattatcaaaccgcgcactccgttccccgctgacctctttcagtaactctggtgtcagaactcgttgtccctgtgcattggcttccgccatatctgacatcatttcgagcaagtttaatgaacgacgagcatcacccgcaaccaattctgcggccatctgacgggtgtcgtcctgcaacacaatattttgcccaccgaaaccacgttctttatcattcatagcctgaaaaagcacttgctcaatttcggctgccgacagtgatttcaataaatagacacgggctcgtgacaacaaagctgaatttaattcaaaggaaggattttcggttgtcgcaccaataaacgtgatcgtgccatcctcaatatgcggtaaaaaggcatcttgctggcttttattaaatcgatggacttcatcaacaaataagatagtcctgcgacctgcattacgattttgactcgctttttctatggattctcgaatttctttgataccagaagtgaccgcagaaatacgctcgatatcagcttgcgcgtaatggccaataatctcagccagcgttgttttccccgttcccggtggtccccacaaaatcatggagtgaagatgacccgcgcggattgctcgtggcaaaggtttgccttccgctagcaaatgttgctgaccgatataatgatctaatgtgactggccgcattctcgcggccagtggctgaaattcattttgtgaaaaatcgagtgaaagattgttcacttaaacctcactaacgctgatcatccaacgtgacgccctctggcatggtgaatttgaattttgattcatcaacgcgggtattttgctgcccttttaattgataagcacttttttgcccatcttgctcaaccgctgtaaatttctggatagtcccctccggcgttacagtgattgaaaaatgtttcaaatttccattggcgttactgggcgtcaactcgaagttattgccattttgtacaacgttatattgcttccagtcagcagaatcattacgggcaatcaacataaatggtgtattgcctgcagcatcttttaaccaattagcagtcacttgttcaacaaaggggttatagaaccacaatgttttgccatcagaaaccaagacactctcatcaggcgctgtcatgtgccagttgaacaaattaggacgtttgacccaaagttgcccttcaccgttttggatcgctgaaccatcactactagtgacggtttggataaaactagcgtgaaagctattcaccttacccaagcgaccttgtagatcctgcgaggcatcagcccatgcagtacccacactcacacccatcatcagacaaccaatcaacatcagttttttcatgtgcgagataccttcaattcatatttattatcagcgttaatagccgataccacatttaaaaatgacttatcaatgttcatgcggcggaggcgccaagacttcacgattgccattgtgaccaggagtactgacaatctgctgtgcttccatctgttcgacaattctggctgctcggttatacccgatgcggaactgtcgttgtacaccggaaatagaaacccgacgtttttcggtcacaaattgaaccgcctgatcaaacaggggatccaattcttcatcgctatctaatcccagaccaccttcaccgtcttctccacccttgataatattatcaatatattgaggacgaccacgggctttccagtcgttgacaacttcatgaacttcctgatcgcgaacaaatgcgccatgaacacgtacaggaatggaagagtttggtgccagataaagcatatcccccatgccaagtaatgattctgcaccaccttggtcaagaatggtacgagaatcaattttactggaaacggtaaatgcgatgcgcgtcgggatattggctttaatcagccctgtaatgatatcaactgagggacgctgtgttgccagcaccaagtgaatacctgctgcgcgtgctttctgagccagacgcgcaatcaattcttccacttttttccctaccgtcattatcaagtcagcaaattcatcaaccatgacaacgatataaggctcttttttcagcataggatgagttacatccatactgtcacccggtttccagaaaggatcggggatcgggcgtcccatattttccgcttgtttgatcttatcgttatagccggcgagattacgcacgcccaaagctgacatcaacttataacgacgctccatttcgttcacacaccagcgcagtgcattcgccgcatctttcatatcagtgacgacttccgtcaataagtgcggaataccttcataaatcgacaattcgagcattttcggatcgatcatgataaagcggacatcttccggtttcgctttatatagaatgctgaggatcattgcgttgacccccactgatttccccgatcccgtcgtccctgcaaccagcaagtgaggcattttacccaaatcagcaactactggctgacctgcgatatctttccccaaaacgatagttaatggcgatgggttatcgcggaatttttcacagtccaaaacctcacgcagataaactgtatgacgttttttattcggtaattccaaacctacgtaaggttttcccggaatcacttccacgatacgaaccgccaccgcagagagtgagcgggcaaggtcacgcgacaagttggaaatacgggaagctttaacccctggagccaaatccaactcaaatcgtgtaataaccggacctggtgagaacccaacaacatccgctttgacacgataatcattcaggcgcgcttcaatcagacgtgaaatctgttcaagggcaaacatatcgacgggctcctcttctgcgggtggtttcgtcagaagatctaaagaaggcatcggtgttgttggctttggcaatggttgatcattacgcatcaaaaatggatggaacaggctcgattgctgcggttgctgcggttgctgcgcaacagtatgctgaattttcgattcatgggaaggccctgaaacagaaactgttcttttttcctgttctgaatgaatcgatgactctgattgcaggggtaatggctcaacaggttcagatttttcaaaaccatcagccagtgaagaataatcaaacgcaggcttttcggcctgacttggaattacaggctggatcttttgataacgttcacgctgctgctgttcaaacgccactcgcaatgcctcttcctgttccgacggttcatcaacactatgctctacaaattcggctgtcgctgattgcttatgtatctgagcgatttcttcacgaggcccttttgtttcttcttcaaaattagaaccatagcgttcacgctgctgttcaaggaattgctgccgcaacgtgtcttgctgctgttcatccatttgctgttcatcagtttccgcaataagatcgctttgtctctctttttcttcccgttgcagatgttcagacaaacgctgagacggtactttgacaccatataattcacggcgggtaggtattctaacgggattcggccgcggcatttcagggccaataccctgtttcatctgaggagttttcatcacaacagcagcactagaaacaccagcagccacatttttcagattatcattcggagaaaaagtaaacgactctatcggctgtatgtttgttgccacagtgctatctatagataactctgattgtgcagttttactgaattctgattctgtatctaattgataatcagctggtagttcaaatgtataaggaacaggttcttgatcttcttcagcatgatccgattcagtttgtactgattccggtaaggcaatggctttctgagcaatagattgcggcctgttttcgttttgctgcacagactgaaccttttcaggtgaaccgacctcctgcgctatatccatagctggaggcactgaatcagttttaaccagttccaccatcgttggcgcactcaacagcacgtcatcctcgtcaacttctacagctttagcggcagatgctgtcgtgcctatatcacctgtgttgacattatcagcacgattttgcccgctggccagatgttcaggagtaacctcgttttccagttctccatactcaggctcattgcgactgcgatttaccataaaactgagtgagtcaagaataactgcaccaattttttccgcaatcgtgagccatgaccagcctgtaaataatgtgaacccaatagcccagacaccgagcagcgctaatgtcgccccaagaatattaaaccacggcagaattgctttactgaataagttgccgatgacaccaccagcagcaaaatcgtttaaatcatcaatattgagagcaaccagaccacatgaggttaataccagtgccaaagcgccaatgatgcgtaatgcgagcgtaaagaaatcaacatactcttgcctatctttctgacggaaagcattccaacaacctaagaacataaatagcgggactgcataggcaagaataccaaatgccgaaaatagtatatctgacaaccaggctccaacactgccaccgaaattatggacgggcccattccatgacgtttgtgaccaactgggatcggagggattgaaactgacaagcgccaccataaagtacacggcacaaatagcaataaccaacagaatggcttccagaagccgacggctactgcttattttctttaatttaacacgtttatcttctgtatattcctggttcaagaaaggctctccaggttttcctattgattaaatggaacaacgctgaggattgctcagcgttggaactgtatgcataaacaggagtgtacctaagtttttcctattttgcacctgtacattttagacaaaagtttagcgagttttaatgactaaacggttactctgcttcacttcttccatgacaacataagtgcgggtgtcattgacgcccggaagtcgcagcagggtttcgcccagtaatttacgatatgcagacatatctggcactcgtgttttcagtaaatagtcaaaatcaccagaaactaagtgacattcttggatttcttcaagtttctgtacagcagtattaaactgctcaaagacatctgctgcaccacggttcagagtaatctccacaaataccagcagcgatgcatccagataatgaggattcaacaaggcggtgtaaccagaaataaagccctgacgttccaatcggcgtacacgctccagacaaggagtaggtgataaaccaacccgtttggataattccacattagaaatacggccgtctttctgcaattcgttaaggatattacggtctatgcgatcaagatcttttcctggacgcttcttattatctatcatcttattgctctctctttatattcctacacccataacattttccctatctctctcaagcagttgagctggaaaagatgtctttcaaaggctaaagctcaatctgtaaccaaggtttgggatctatacgccattttctgaaatacagtttcccagaactcgattaaccaaaacacgacttactagaacaccgtcctccagaatattatttcccaaaacactacgtctcccagaaagcagcttatcggcaatttttttgttctataagaaaactacccactccgatttgtctattctatagaaacaattgattagcgaggtagataattatctcttccacagatgttttcgcaaatgcacagccgattgtcaaagtaaatgaacaaaaatcagaacaacctaccaaacaaattttgagtaaatcctttcaatagcttgtcttataccttatacggataaatgatgttcaattcagaaagttaagtaacctctccttacattcccattacatcatagttactatctatcggtaaaatcgttaataacataaatattttatctgataatcgctttttttaacttattatttctcctacaatccccaaatccgcaatatgcgataatggaaatgaggtattcatgagcacagccaaacacagtaaacttatcattcttggctcaggtcctgctggttataccgccgctgtttatgcagcccgcgctaatttaaaccccgtccttattacaggggttgaaaaaggcggccaattgaccaccacgactgaagttgaaaactggcccggtgatcctgaagggctgacaggtccagatttaatggaacgtatgttccagcacgctgaaaaatttcaaacagaaattatttctgaccatattcagaaagtcgatttcgaaaaaaaaccattccgtctttatggagatgatcaggaatatacctgcgatgctttgatcatcgcgacaggtgcttctgcccgttatctgggtctcccttccgaagacgctttcaaaggtcgtggcgtatctgcctgtgcaacatgtgatggtttcttctatcgtaagcaaaaagttgctgtagttggtggtggcaataccgccgttgaagaagcactatatcttgcgaacattgcagccgaagtccatctcattcaccgccgtgatactttccgttcagaaaagatcctcattgaccgcctgatggagaaagtcaagaatggtaatatcattctgcacaccgatagaactttagatgaggtgctgggcgatgatatgggtgtgactggcattcgtattcacgatacgaaaagtgataatgcagaagagctggatgttactggtgtcttcattgctatcggacacagtccaaacacaggtatctttgaaggacagcttgatctgcaaaacggatatattaaagtccagtccggcctgcatggaaatgccacccagacttctattccgggagtatttgccgccggggatgtcatggatcatgtttatcgccaagccatcacctcagcaggtacaggctgtatggctgcactggatgctgaacgttttcttgatggattggcaactaaataaaccctctttccttaaggcgctatttcggtagcgctttttaacagggaacataaggtttggccgctggcaaacagtatcaccagcctttttgatacattgtatcatcacctgctaatcagaaatttttcttatggacaaaacaagacaatctgaacttgttcgatggctaagacagcaaagtgcgcctgcccgtcggtggcttcggctatccatgctacttggcctcattagcggattactaatcatctctcaagcttggcttctggcgtcaatccttcaagcactaatcatggataatatcccccgcgaaaatctcatcgttcagtttctgatgctgatcgccgcctttacattgcgggcaattgtcagtgctattcgagagcgtatcggttttatctgtggcaaggttgtacgccaacaaatccgcagtatggttttggataaactggcacaattggggccggtttgggtcaaaggaaaacccgccggaagctgggctacgattatcttggaacaaattgaagatatgcaggatttttattcccgctatctgccccaaatggcgcttgcaacgattatccctctcttaatcctgatgactgtctttcctgtcaactgggctgcagggttaattttactcgtcacagccccattaattcccctttttatgacattggttggattaggggccgctgacgccaatcgacgcaattttgtcgcgctcagtcgtttaagcggcaatttccttgatcgtttacggggtctggaaactctacgcgtgttccatcgcggggaagccgaagttaagcaacttaccgaatcgacagacaatttccgtcacagaacgatggaagtactgcgcatggcatttttatcgtctgctgtgctggagttttttgctgcggtttccattgcggttgttgccgtttattttggtttttcttatttgggagaattacattttggtagttatggtctgggtgtcacgttgtttgcaggcttcctcgctctgatcctcgctcctgaattctttcagccactgcgcgatttgggtacgttttatcatgcaaaagcccaggctgtcggtgccgcagagtcactttttaccctgctcagcagtgagggagaacactctgtattcaacggcgaaagaatgctgccagatacaaaatcagtgactattgaagcaaacgaactggaaatccggtcacacgatggtcatcgtcttgcgggtcccttgagcttcacgattgaccaacatcagcggattgcattggttgggaaaagtggtgcagggaaaagctcactgatcaatctattactcggattcctaccctatcgcggctctttgaaaatcaatggaatcgagctacgtgagctgaatctaaccaaatggcgtgagcaattaagctgggttggacaaaatccacacctgccagaacagacgctgctcgataatatccgtcttggtcaatttgacgcaacacaagaccagattaatgatgttatggaacaggcttatgtcagcgagtttatttatgctcttcctgacggcgtgaatacagtcattggtgacaatgctgcccgtttatctgttggacaagctcaacgcatcgccgtagcacgggcattattgaatccctgtcagttattgttgttggatgagccagcagccagtcttgacgcccatagcgaacaacgtgtgatgatggcattaaatcaggcatctagtcagcaaaccacactgctggtcactcacctgttagaagaaacactggaatatgaccagatttgggtaatggaaaacgggttaatcattgagaaaggccattatcagagtttaagccaatctcaaggggcattttcccgtctgttgtctcatcgcagcgtggagctttaatcatgcgtatattactcccatttctcgcactctatcgccgccactggtttctcatcagcttaggcatggtattagcgattgtaaccctgttagccagtattggcttgctgacgctttccggctggtttcttgccggtacagccttggcaggattcgcggggttatatacgttcaattatatgctgccagccgctggcgtccgtggtgcagctattttccgtactgctggccgttatggtgaacgactggtcagtcatgatgctacttttcgcgtattagcccatctacgcgtttttgcctttcagaaaattttaccgctttctccgggaggcatcgcccgttttcgtcaaggcgagctgctgaatagaatcgttgcggatgtcgaaacgcttgatcacctctatctgcgagttatctcccctgtcctttcagcgttggttgtgattgttgttctgacttttggcttgagttttcttgatgtcaccctcgcatataccctaggcgggattatgctggggctactgataatattgccttttgggttttatcatgcaggaaagccttatggcagagacatcaccctactacgcggtcaatatcgtacattactcactagcgcgttgcagggacaggcggagttaacagtgtttggcgcactcgggcgttttcgacaatcaatgacagacgttgaatccgattggctgaaatgccaacaacagcaagccaacctgacggggctttctcaagccgttatgattttcgctacaggcataacagtgactctgctactttggctggcagcagcaggtgtaggggaacatagccaacccggagcactgatagctctatttgcgttctgtgctctcgctgctttcgaagctcttggacccgtcacagtagcatttcagcatatgggacaggttatctcatctgcaacccgtgtttctcagttaatgcatcaggagccagaagtcactttccctgctcatgggccacaaacgactgatagcctcaatcttgagataaaaaatattgatttcacctatcctgaacaacctctgccagtattgaagaatatttcactgtccctggcatctggcgagcatatcgcactattggggaaaacagggtgcggtaaatcgacacttttacagttactgagccgtgcatggaatgttgatcacggcgaaattcagctcaatcaacaacctatttcccagtatgatgaaaccacgctgcgatcaatgatgtctatcgttcctcagcggatacatgtcttcagccataccctgcgtgaaaacctcttgctagccaaaccggatgccagcgatgatgagttagtaatcgtactcaaacaagtgggtttagggaacttgctagacaataatgaaaagctaaactgttggatgggtgaaggtgggcgccagctttccggtggggaacaacgccgtttggggattgccagagcgttgttacacaatgcaccattaatgctgctggatgagccgacagaggggctggatgccgatactgaacaacagattctgtctctgttacgccacagttgccagcacaagacactgattgtggttacccatcgattaacaggtttacagcatttggatcgtatctgtgttatggatgagggacgcatcattgagcaaggcaaacatgatgtgttgctggctcagcaggggcgttactatcaattctatcagcgacagagctatcctgagcaggagtaatcatttttatgacgatagctcaactgggtaactcatatgcatttcctcatccaacccatgcgctggctgaaccaaatggtttactagcatttggcggtgatctatgcgcagagcgtttaagggtagcttatcacgaaggtattttcccttggttttcccctgatgagcttcccctatggtggtcacccgacccccgagcggttctaattccgggtgaattacatactggacgtacgctacgtcgttttattcgcaaacttccttaccaaattacggtaaactatgctttcgatcaggtgatatatggttgtgcccaacggcaagaaggcacttggatcgggtctgatgttcagaaaggttatcaggctctacatcaagaaggtctggctcattcaattgaagtctggcatgactgccaacttgtaggtggtttatatgggattaatgtaggtacgctattttgcggagaatcgatgtttagcaaaatggagaatgcatctaagtgtgcttttgtggcattctaccaccactttttacatcatggtggccaattattggattgtcaggtactaaatcaccatacgaaatcattaggcgcaaaaaatattccaaggaaagaatttctccagcatctttacttatgcagagagcaatcattgcaggcaggatgctgggctgctcaaatgctggatttatagtcaaaatctagtgatttatgctgttcacggcgggaatgtcgatatccattatgaggaaaatgatggtttaaaatacgacattcctttacataatgagggtttttcggcattatcttgccgtttaaaaactatggttgttacatttagaggattagatggccaaagaagacaatattgaaatgcaaggtactgtgttagacacactgccaaacaccatgttccgtgtcgaattggaaaatggacacgtcgttactgctcacatttcaggcaaaatgcgtaaaaactatattcgcatcctgactggagacaaggttacagttgagctaaccccatatgacctgagcaaaggccgtatcgtcttccgtagccgctgatttagatactgttttaaacaccacaggtgataattttttcgacattcacctgtggtgtcacccgactatttttatcaacttccagtacaactctttaaaatgtggtctgttttatagcaccgcatcttccgatttctttttactcgacttttgtgcacttttgaaatcgtatatcagtgcccgtttgtctttatcaagattaatcctaaccgaacctccatgtatcaacgaaccaaacaacagttcattcgccaatggtttcttgagattgtcctgaatcacccgagtcattggacgtgcgcccatcgctctgtcatagcctttatcacataaccactgacgggcatctgcacttacttccagagaaacacctttttcatccagttgtgcttgcagttcaacgatgaatttatcaacaaccagttgaatgacttcagcggaaagtgcatcaaaccagatgataccatcgagacggttacggaattcaggtgtgaagatccgtttgatctcttccattccatctatgctgttatcctgctcagtaaaaccaatggacttacgctgtatctcacgtacccctgcgttggttgtcatcaccagaatcacattgcggaaatcagccttgcggccattgttatctgtcaatgtgccattatccatgacctgtagcagcaagttgaacacgtcaggatgagccttctcaatctcatccagcaacaacactgaatgtggatgtttgataatagcatctgtcaataaaccgccctgatcgtatcccacataacctggtggtgcaccaatcaaacgactgacggtatggcgttccatatattcagacatatcaaaccgcagtaattttatattaagcattttagcgagctggagagtaacttccgtcttaccgacccccgtgggtcctgcaaacaggaaagaccccactggtttatgttcctgccccaatccggcacggctcatcttaatggcttccgtcagtaccccgattgctttatcctgaccgaaaaccagcatcttcaaacgatcatccagtgttctcaatacatctttgtcactggctgaaaccgttttttctggaatacgggcaatacgagccactacagattcaatgtcggcaacgttaatcgtttttttgcgacgactagccggcaccaatcttgttctcgctcccgcttcatcaataacatcaatggctttatccggcaggtggcgatctgtaatatatttcacagacagctcaaccgcagcacgaatggcttttgcagtataacgaacatcatggtgcgcctcatatttagtacgcaatccattgataatctgcaccgtttcctcagaagaaggttcaagaatgtctatcttctggaatcggcgagccagcgctcgatctttctcaaaaatattactgaattcgtgataagtcgttgagccaatcacccgaatgcgaccactggacaacagcggcttaatcaggttagccgcatccacctgcccccccgaagcagcacctgcaccaataatggtatggatttcgtcgataaagagaatacttttgctgtcttgctctaacgtttttaacaaagatttgaagcgcttctcaaaatcacctcgatacttagtacccgccagcaatgaaccaatatccaacgaatagattgtgcaatccttaataacctcaggaacatctttttgcacaatacgccatgcaagcccctcagcaatggcggtcttgccaacacctgactcccccacaaataaagggttgtttttacggcggcggcataatacctgaaccgttctttccaattcatgctgacgtccgacaagcggatcaatctgccctttttgtgccaattgattcaggttggtagtgaaattttccagtcgatcttcatttatcacctgttcctcctgaatcggattgacactgtgatgagactcattatcagactcatctttgcgcgttccatgtgaaatgaaattcacgatatccagacggctcacatcatgctttcgcagtaaataagcagcctgggactcctgttcactgaaaatagcaaccaagacattcgacccagaaacttctgaacgccccgaagactgaacatgaaacactgcacgctgtaatacacgttggaaactcaacgtaggttgtgtatctctgtcatcattctctgataacaaaggggttgtttgtgcgataaaattttccaattcctggcgtaacatcaccagatcgactttacaagcctccagtgctcctcgcgctgatgtattgcttaacaacgccagcaataggtgctctacagtcataaattcatgtctgttatcccttgctttggcaaaagcaatgttgagactaagctccagttcttgattgagcataagcacctcctcctaaaatcagtaagccagatcagaccttctccagcgagcaaagtaacggatgctcgtgctctttagcatacatattcacttgcgcagctttagtttctgccacctctgccgtataaatcccgcaaattgccttaccttggtaatggatatccagcatgagttgcgttgctcgttcaacatcataagaaaagaactttcgcaatacgtcaaccacaaactccataggggtatagtcgtcattgttaagaatcaccttatacattgatggtggctgtaacgtttgctctgttttatcttcaattaattcttcaattttcaaactgttataaaactcactcattgttcttccgctgggtattaactttctgctaaattttagtatgaactaattcattctactgctatatattttatcacttcatgaagcactctgcttatcccctctttgatctctggataaagaatccgcctaaaaatcggatatcgttatctatatcaaactttcgctatttgagacagcttgaggttatttctgtgcttgacggcgtaatgaatttcactacagtatattttatgagcaccgccctggctgggcatctgctcatatcctgaaatttttagtgactcctaaacccgaaatcgtgatatgagggataaagaagtatggaaacaggtactgtgaaatggttcaataatgcaaagggctttggatttatttgtccggccagcggaggcgatgacatattcgctcactattcaaccattcagatggatggttataggacgctgaaagctgggcaaaaagtgaacttcagtattcatcaaggccccaaaggcaaccatgccagccttattgttcctctggaagatgactcgaaatcaaaaaaagagtgaccagataaattcgtaattcccacgccacaaacgaataatggcttatttgtggcgtgctattaatacaagttcatttagtacccatctttctactgcaataccgtagcgtagctgttactctctgaccagcacctctataggatcaaactgaatatgggtttacggcggttttgctaagttcaattggctttttcctgccattctcaactgacacgtaaataaatacgtttaagggcttactccgacccacccataattggacgtaaatgacgaaaacgtgtcatacggtggcggccaatccgtgataatcaattaacaccgttaaaaccggaaatttctacacgtttcaggaacatatactcccctttttcgtatcagatttaattaatttctttatgatacctaatgccttagataataaaaaacaccttgaatttcagtatgtttccctttattctgtttgttattttagtgtaaaaatattgttgtcatgattttattggtctttatgactgattcaagttatagagccagataaaagacatttattcttgaataaggatatgggttatgtattcagggttgctaattgttctcataccattaattctaggctaccttattcgtctgaataataaaacggcgctggccacagttcattacctacttaatatcataatttatgtcattctcttcctgatgggcgtcagactcgccatgctggaaaatctgggcaataatctactctctatcctgctgtatgcgatgacatttttcttatgcatatttgcgactaacttgctggcacttatcctattggataaacgggatccgtggattattcaagtcaataagcaggaaaaatcgccttctcaattacatatggtttttgattccatcaagttatgtggtgcattaatatcaggatttttactcgggctgacaaactggtcattgttgaattttgccgatcatgccagtgaaattgccttgattcttttactgcttctggttggtattcaactgcgcaataacggaatgagtttaaaacaaacgctgttgaatcgccgtggcaccattatcgctctggtcgtcgctataagctccctgttgggtggcattatcgccgcatttttactgggattaccgaccaaaaccggtcttgccatcgcatctgggtatggctggtactctctttctggtattttactctctaacgcttatggctcggtgattggcagtactgcattcttcaatgatctagcccgtgagttggcatcaattctgctcattccgatgctcatcaatcgttatcgctcaacagcgttggggttaaccggagctgcatcaatagactttacattaccaatattacaacgctgtggtggcataagtatcgtaccagcagccattgttcacggttttatattgagcttgatgacgcccgtatttattgcattttttactcaacaggcttaggcgttacctgatgcatgaaaaggttaaaaagaaaacttatttggcatcaaaatcaatctatttagccaaaaatagaacataaaataatctaaaaaaagctgatagcctgattagttaagtcactaatttgatgataataacaattttatgcagatattattgcatagttattcttatgagattaatatccctccaacctattaactattcatatttatcgcatgagcattcaattaaaaaacataaattgtttctatggaacgcatcaggccctgttcgatatcaattttgaatgtacatcaggagaaactgtggttctgttgggcccgagtggtgctggcaaaagctctttactgcgagtgcttaatctattggagatgcctcgttctgggcaactaagcgtggcaacacatcagtttgatttcaaacagcagccaggcgccaaggaaatacgaacactgcggcaaaaagttggcatggtttttcaacaatacaacctatggccacacctaactgtgatggataacttgattgaagccccctgccgcgtattaggtctacccagacagcaggctcgggaaaaagcagcaaaactgctggctcgtcttcgtttggatgaattttccaaccgttttccacaacacctgtctggcggacagcaacagcgtgtcgctattgcacgggcattaatgatggaaccccagattctgctgtttgatgaaccaaccgctgcacttgatcctgaaattacatctcaagtcatcaatatcatcaaagaactggcaggaactggtattacccaaattatcgtgacacacgaagtggaacttgcacgtaaggcagcaacacatattgtgtatatggagaaaggccacatcattgaaaaaggtgacgcaagtcattttttaaaacccaaaacagaagcctttgctcattatttgtcacactagctctgtcattacaaatagtcagttagaacataaaacaagcatcagtaacatttatcaaccataatgctcatgaactacaggatatgactatgaaaaaattattgtttgctgccttattaaccgcaatgactttgtctacatctgcaaccgcagcagaaaaagaaacgctgcgctttgctacagaagcaacctatcctccgtttgaatttattgatgcaaacaataaaattcaagggttcgatgtagatttagcgaatgctatttgcgcgaaaatcaacacagagtgcacattcaccaatcaagctttcgatagcctcattcccagcctgaaattccgccgttttgatgcattgatggcaggcattgatattacgcccgaccgccgtaaacaagttgatttcactcatacctattatgataactctgccgtttttattgccatcaaaggaaaatttactcattctgccgatctgaaaagcaagcaagtgggaatacagaatggtacgacacatcagaaatatttgatggaacagcataaagagatcaaaaccgtaccttatgacagttatcagaatgcgatccttgatctgaaaaatggccgtattgatgctgtattcggtgatactgccgttgccaatgaatggctgaagaagaataaagaattaggctctgtcggcgacaaagttactgacaaagattactttggcattggtttaggaattgcagttcgtaaaggtaatacagctttgctggataagctgaacaaagcactggctgaagtcaaacaagatggtacttataactccatctataaaaaatggtttgaacaataacagaatcctaatgagtgaacttcaatctttaattaacgccgctggtattaccatcggccttgctgtttcttctcttgtcattggcttaattctggcaatgctttttgccgcttgggaatcagccggctggaaaccctttgctttcttaggctcttgttgggtcacattgatcagaggattgcctgaaattctggttgtcctctttatctatttcggaagttcacagcttctcataacgctgtcagaaggctttgatgtcaatctcattgtttggcaattcagaatccagatggaaattgacaactttgatgtcagccctttcctttgtggtgttatcgccctttctctactttactccgcatacgcatcacaaacactgcgaggcgcattgaaagcagtcccaatggggcaacgggaagccggacaagcactcgggttaagtcaaagccgtatattttttcgtctgactatgccgcagatgtggcgccatgcattgccagggcttggcaatcagtggttggttctactgaaagatactgctttagtttcactgatcagtgttaatgatctgatgttgcaaacgaaaagtatcgcgactcgcacacaggagccatttacatggtatgtgattgccgccatgatctatctggtgattactctggtgagccaatttattctcaaacggcttgaaatgcgcgccattcattttgaacggagtgcttccgatgtttgagtatataaaggatatcttacctggcctgcaaactagcctaagcttgactgtcaccgcattactggctgcatttatactgtctgtggttctgaccttcattttaacaatgaggttgccgatactatcccaattggtaaaaggctatatcacgttatttaccggaacgccgttactggttcagttcttcttgatttactacggacccggacaatttccctcaataaaagagtacccttggttatggcaactcatgtcagagccgtggctatgtgccatggtgacactggccttgaacagtgcagcctattcaacccaacttttttatggcgccgttagggcaatccctactgggcaatggcaatcctgtcaggctcttggtatgtcaaaaacccattccatgcgcattctgctgccttatgccttcaaacgagcgctttcttcctattccaatgaagttgtcttgattttcaagagtacttctctagccagtacgatcacactgctggatatcatgggatatagccaacttcaattcgggcgtagttatgatgtgactgtatttgttgctgctggggtcatttatctttgcgtaaatgctcttctgacactgctgatgcgcataattgagcgtcgagccttatcatttgagcaacgccattaaatactcaacagcacacgatttatctgctttttgcttttgtcagcgataactattagttatcgctgacaaatacagctaaatcccctgttactttccatcaaagatcagtaacgccagcgtttcataatgttctgtatgggggaacatatcgaataattgcactttttctattcgatattgctcaagcgcagcaatatcttttgccattgtttcagcattacaacttgaatagagaataaatttaggtgccatccgactgaggtattcgcataacgccttaccaattcccctgcgaggaggattcaccagcaccagttcagggagttgcgctttatcaagggcaaaatgtgtagaatccaatgcctgaaattcaacctgctcaagaccaagacttttggccgagtttttggcacaggcaatggcctctgcactaatctcaatccctgtcagtctggtttctttgtctgcacagtgcagcccaaaacctcctgctccacaaaagagatcccacatgctgctgatattcagctctctgacccaacgaccagccgtcgcataaagcgccgaagcaatttctggatttgtctggaaaaaactacggggacgaatatacagcggaattccgttgaagatttccttcagcatcttatgctcagtaaaaatgacttctttttccccttccaaaatcgccatatgagtcggttgaatattggcagaaataaccgtcaattgtggtagttgttcctgtaaccacggcaaagcatgttccaactgagccagttttgtttctgagcgcaggacaaaacgcagcatcatttcaccgctggcacggctttctgtcagcagaatatatttcaattccccttttttacgtgcaacgttatacggaaccaacccagctttagcgataaatatttttatcgattcaaataccagctgaaaatattgtggatacaaaggacaatcacaaagatccaccgttctgccatcacggtgaagcatgccaagctgtgggcgttcaacactgccacttaccaccatcttggccttattacgaaatccactgatcaggctgctgactggaggcagccagtacgttgctgacgtctcccgtaaaagctgctgtaaatgttgttgtttatcagataattgttgtgaataggacttattgagccactggcaggagtgacaatgccccgcggtatactgcgcacattgcattgtaaaaaaccatatcaaagaatattagtgcaaggtaaatgtcgatgtttccgtcgaagccaatgattcctcatcttccacttctacttccatctcgctttccatatcattattaatataaaggaaattattgctgtgaatttcaaaaatcacattggcaatctgctcctcactttgctgcaagaaatgggaaaactgcgggaaagtcataccagcggcaataggaaatgcctgacaaactatcaacttcggtaagttttcgtcctgaatatcaaggaacactttggcagtgagggaactcgcattaatctggctcaagtttgcagccaatggaattatcgccgttggcctgacttctgccagagcagaaaacagcactacgtcacccaacagatcaatcttggcatcaaacaggccatcaatgttctgcatatgaggcaaatgcaagaccgaatttgaatcactctcaaaataagaaattttgaggcgttcaagccagttacgcaatgttaccaaatttggaacaaccatagaatccatcgaatcaacctcatatgaccaaaaagttgtacatgctatctgaaggaaacaccttgccaatagcaacaagatcaataattaacctattttgttttttcatcatcagaaccagtcagatgatttttatctactttcttatgatcaattcctaaaaaagaaagattatagactgcacgccagataatatggatagctgcaggtatcaagcaacctatacccaataagatcatagcaatgtgcgcttctgtcgtcattaataaaggtgatagaattatgctatcagttatcgacaaatacgccaaaaccaacaagccgattcccaatacttctaataaaataaccagctttggcatatctgacaacgagctcatctcttttgttgagattttcttcatgactttctaccttctgagcctgataaaatagactctccgcctcttatagaagggctatcatacctgaatcccttctatcggcaggacaaattagaacaaaaggcaattcctgcttttttttgccgacgcttacaggcatagtaaccccagatgacaatctatgaagttcacgattattaccactaaggagtttgtatgtatactgtcatttttggtcgcccaagttgcccatattgcgttcgcgccaaagaattggctgaaaaattaaaagcagagcgcgacgactttgattaccgctatattgatatctgggctgaaggcatcaccaaagacgacttgtcaaaaactgtggggaaacccgttgaaaccgttcctcagattttccttgatgagaaacatatcggcggctttactgattttgaagcttacgctaaagaacatctgaacttgtacaaataaccataaaattcactatccagccagaaatatcgatgctttcttctggatagtggcaggctcataatattgactaagatccacatatccactgaattgaaaaaaatctgtaattttttcctcaacaatgagaactttcatcacattacgcagtctgaattaatgccactgcttttctttgatgtccccatattgaggagcccgatagtcacccattttggttaaagactatcgggtttttttatttgtcactgtgttatctacagtacagagggcatctaaatcacctttttttgctatcatcggcatattatttactcacttagcatcaacaatcgttaaatatcatggtgaattaaagcaaaaatcctttactgaatcgcattataaaattactatttttaacaatgacttgataacgctcgtttatcatatttgcgtcaatatcacgcttgtgaggcttactttgctagaacaacttaatcacaatgtgtttacttttatcaatgcaacaccggattcatcacctgcaatgattttactggcgatctttgtagcaaaatatcttgtgtttattttccccataacattagctgtttgctggctttggggagaagaaaaagccatctcacatcaacgtattgttgtcagtaaatcctgtattgcttttgcctttgcaatagcctgttcggatatcatcggaacatttgttccacacgcccggccgtttgtagaaggttttggttataattttctctatcatgcccctacagcctcttttcccagtaatcacggtacagcagtctttaccttcgcgttagcatttaccttctggcatcgtatccggtcaggtttatgcctgatgatcatcgcctgcgtgattgtatgggccagagtctacgtaggggttcattggccaatagatatgatcggcgcatttctagtcagcttgatgggttgtgctttttcgcaaatattctggcgcttatatggtgagtattggcacagtaaactcattcgcctttaccaattctgctgtgcatttttcatccggaaaggatggataaaaaattaacccaacggcaatatgccactggatatttatgctacaaataaactgctgttgaatatttgaactttatttttgaagccttaaattcaggtaaatctaccttaagcctcattatcgcggctagtttaaggctttattttacccaaattatttattaacatttcatttacaaggtgcaagcaaattaatcgacagaataaaatgcttcattatatttaacaatatatagcgataatatgattactgtttctttataaatcaaaatttgactgacaaattttttgcactacgattgtttaaatcaaaaaaatcattaatacataatcaataaaagcaaagatgtaaacacagagagcaaatattcatcacaaactgaattattaaatattttctttttatttcaacaagataatattaatctcgattggatttttatatttaaaaatatcaaagattatatttacgatactattttagactaaaaaatattttcacatttaatatcgttaatatgtgaattacagtatggttattgtgagtagaatataaaaatttaaaattaaaataatcaagttcatttccttaacttttctttttcattttatgtaatatttaattaacactttcgtaaaaccttataacatattaatttttagatataaatcttgcaattgcgagagtgatcacggtacatttcactgaaaataactatattttccctaccaaaagactagggtttatttttttgatttcaacatcaaaaataaagtacagcaggatttcaactcttctgctttagctgactatattttggtcagtttattaatgtagtaacaaacgtttagatagacgtcagaacaatatctaacaacttattattcatataaatagaatccaactcgtgcattttattaatgtgcgggtttagcaatttttaaattttactttactgcgttatttcggagatatttatggacacgtctcaatcaggttctatcgcagcctctgctgcttccggcaaaagcgattatactacctggcgtaaatcagacactgtatggatgttggggttatatggcactgccattggtgctggagttctgtttcttcccataaacgccggtattggtggtttaattccactcatcatcatgacactacttgcacttccgatgacattttttgctcaccgtggaatgtgtcgttttgtcttgtccggcaaaaagaatggcgaagatatcaccggcgtggtagaagagcatttcggtaaagtcgcaggtttcctgatcactatcctctacttctttgcaatttatcctatcttactagtttatagtgttgcactgaccaacaccgtaaacagctttattactcaccagttacatatgaacgcaccaccgcgcgcattgctggcactggtactgatccttggtgtgatgagcattattcgcttcggtgagcaatttatcgtcaaagcaatgagcgtactggtcttcccatttgtcgcagttctgatgctgctagcgctgtatttaatcccacactggaataccacaatcttcgataccctgtcactggagaatgcgctgtcttccacaagcggtcatggtttgctgtttactctgtggctggctattcctgtcatggtgttctctttcaatcattctccaatcatctctgcatttgccgtagcaaaacgcgaagagtacggtgaagatgcggagaaaaaatgttcgcgcattctgggttatgctcacatcatgatggtgattaccgtcatgttctttgttttcagttgcgtactgagtctgtcaccggaaaatctggcagaagcaaaagcacagaatattactatcctgtcctatctggccaaccattttagtgcaccaacgattgaatacattgctccgctcattgccttcattgcaattaccaaatcgttcctcggtcactatctgggtgctcgcgaaggtttcaacggtatcgtgaacaaggctcttagcacacaaggcaaaactattcagcataattcactgaatcgtatcactagcctctttatgttagtcagcgcctggatcgtggctactcttaacccgagtatcctagacatcatccaatccctgggtgggccaataattgccatgattttgttcatcatgccaatgtacgctattcacaaagtgccagccatgcgcaaatatgctggtaaaccaagcaatgtctttgtggttgtgacaggattaattgccatttctgcggctgtttactcagtcatgtaatcaaggctcaggagcagttttctataacaacagccccataaaaaatgccagccaacctcacaattgactggcattttcctatttatccgaagactatacatcttcaatatttccggctatttcgtttatttccctatccgaaaattgagttaaaccagccgctgacagtcttcacaattaaatcccaaatacgcccaaaaaatccactctcttctacggcttctttaacaaccaaaggacgttgatcaataaccttatcattcaacgaaaaattcacagtgcccacaacttgattcttcgccaatggcgcttcaagtgaagtttgggtcagcgtaaaactggctttcaggttattcgcttgacctcgcggcaccgtcacggccgtatctttttctacacctaaagccacctctgaacgcgtaccgaaccatactctttctgtcaccagtgtgtcactggctttaagcggagtactggcttcataaaaacggaatccccatgacaggatcttttcactgtcagagaaacgcattcgatcactaggcgctcccagtacaactgaaatcaaacgcattgacccttccgctgcagaagcaacaaggttatatcctgccccgctggtatgtccggtttttacaccatccacattcatattctgattccacaacaggcgattgcggttaggttgacggatattattgaaagtgaattctttctctttatttagagcatattcttctggcacatcacggatcatagcctgacttaagagcgccatatcacgagcagtgctgtattgtcccgcagcatccagaccgtgaacagtcttgaaatgggtattttccagccccagagttttagagtatttattcatcaaatcaacgaaagcatcctgactgcccgctacataatccgcaagggcaatactggcatcgttgccagattggatcacaatgccacggttcaaatcaatgactttgacccgatcacccggtttcaaaaacatcagggatgaccctttaagcgccggattgccggttgcccaagcatctttacctacggttacctgatcttctgtagaaatctttcccgacttaatcgactgaccaacaacatagctggtcatcacctttgtcagactcgctggatctagccgttcatcgggattatgggatgccagaatttttccactggcgtaatccatcaatatataggatttcgcatcaatttcaggtgctgcgggttcatccattgcgtatgtgttgacacccatcaaccaaaaaatacccaagccaacagtaaaagatttgattatctgtacttgccgtctttttttcatcatagcccgccctttttgtctacaaccagaatataaaagctctattaatataggatgttatgagataagactccaacccaataagcgtaaagattttcttgttacccgaatgaatttattatcatattatcgatgactcaaaataacctgatattaaggaaagaatgatgctgacaatctggggccgtaaaagctcatcaaacgtaaaaaaagtcacttggtgtctggaagagttaaacgtgccatatcagcaaattgatgttggtggtaagtttggcaaacttaatactccagaatacctgctcatgaatcccaatgccgtcattccctgtttgcaggaagacgattttatcttatgggaatcaaacacgattgtgcgctatatttcggcaaaattcggcgaaaatagtctttatcctgccaatcttcaagaaagagccaaaattgatcaatggatggattgggtcggctgcaatttcttcccgccaatcaaacaacttatgattaacattgtcagaacaccagaagatcagcgtgacccgaaagtgattgcccagatattaaaagagatagaaaaactgctgaaaattgtcgatgacatgctgggtaagcaaaaatacctttccggtgataaatttggcatggcggatatcgccctcgcgccactggtctatccgtggctaaacatcgagatagagcgtccatctctgccaaatttggaacgctggtatcaattactaaccgaaagaccagcgtttcaaaaaatcgttatgattgaaataagctgatcatcagctcattggcattctgccgggatctgggaattgatactcaaaacctagttcccgacaaatacggctaccgtcaacaactttacccgctgttccctgaacctctgactgtagaaactctggcggagtcaaatcgagctgacggctggcctgcaaataaaatttctctcttttcggatgttctggcgcacacagattataaatatgccctcctttctgctgctcaataaggcgtttaatagcagaaataacatcatcctgatggactagattgaccaccttttctccaccctcaatcgctttccgccccgcaaggaaacgccctgcatggcgaccactgccgaccaaacctgccaaacgcacgatatcaacagaagtatttggcagtcgatgcagccagttttccaattcaaccagcgccttggcagatcgcgtctcaggaaataacggagcatcttcattcagatggccgacagacgagccataaactgaagttgagctggtgaaaataatatgaggaaccgaatgcgaaagcgcagtatcgacaattaactgcaccgctttgacatatccttctccaccccccgcaataccgctaacaggtagtgttagcaccagtacatccactgacatcagctgctcaagatcatccgcttcacagattatctgaggggtcagattcaataaatggcaacctataccacacatacgtgccgcttcgacaccatccgctgttgttttactaccgaccacttgcataccatagccttgcaaaatttgcgctaacggcattcccagccaacccaatccgatgatggaaacttttttcaccataactctccccaggaccgatatgattcttcaggctatctgcatattgccttaacgacaacacccgttttatttataaaacaaacaattagaaaaacacaaacagcttctttgaaaaaaaagttgcttttcatacacaaaatcatataggttaaacggtaagcaaccaatcctcgttcgcaaacatatattaaaaaacagatagagaactcacatattatgaaccgtattcaatttaaccaccatcatcaccatcatcctgactagtctttcaggctgttgtgtgctggaagacatttagcaagtcttccggtggcatgagtacgataaaaaaaccctcggaagattttccgagggttttttttattgccaatttatacgatttatatattgaatattgagatagggtaaaacataacatgctagataaaacacgcttacggatagccatgcagaaatccggccgcctcagtgatgattctcgtgcactactggctcgctgtggcatcaaaatcaacttgcagcaacagcgcctgattgcattcgcagaaaatatgcccatcgacattctgcgtgtccgcgatgatgatattccgggtcttgttatggatggtgttgtcgatttaggcattatcggtgaaaacgtacttgaagaagaacaattaaaccgtcgggcgcaaggggaggatccccgttataacacattgcgccgtcttgattttggtgattgccgtctttcccttgccgctcctttcgactatgactataccggcgtggaatgcctgcaaaactcccgtatcgccacgtcttacccacacttactgaaacgttatttagataaaaaaggcgttcccttcaaatcctgccttctcaacggttcagttgaagtcgctccccgagcaggattggctgatgctatctgtgatttggtctcaacgggcgccacactggaagccaacggtctgcgggaagttgaagtcatctatcgctcaaaagcctgcttgatccaacgcgatggtgagatgccggaagccaaacaacaactcatcgacaagctgatgatccgcatccaaggcgttattcaggcgcgtgaatccaaatatatcatgctacatgctccaagcgacaaactggaagaaattatcgcgttacttccgggtgctgaacgtcccaccattttaccactggcgggggcacagaaccgtctagccatgcatatggtcagcagtgaaaccctattctgggaaacgatggaaaaacttaagtctctgggcgcaagttccattttggttttaccgattgaaaaaatgatggagtaatcttaatgagtatcaattttaagaccgttatccgctggcaggaatgcccaccagaacagcaaaaagcgttgctgacacgccctgctgtcgtcgcttcagaaaatatttcccgcacggtaaaacagattctggaaacggtcaaagccaacggcgatgaagcattgcaggaattcagccaacgcttcgacaaaacaacaatcgatactatcccgctttctacaagtgaagttaacgcagccgccagccgcctgacaccagaaatcaaacaggctatgcagcaggccatgaataacattcgcctgttccatgaagcccaaaaacccgctgtgattgaggttgaaaccctgccgggtgttcgctgccagcaagtcacacgcccaatcgattctgtggggttatatattcccggaggttctgcgcctctgccttccactgtattaatgctgggaatacccgctggcatcgcagagtgccgtaacgttattctgtgctccccacccccgattgccgatgaaattctctatgccgcacagctctgcgggattaacgaaatatttcaggttggcggcgcacaagccatcgcagcaatggcttttggcacagaatccgttcctaaagtggacaagatttttggcccgggtaatgcatgggtaacagaggctaaacggcaagtgagtcagcgcttcgacggtgcagccatagatatgccagcaggtccatcagaagtactggtaatagcggacagtggagccaatcccgcatttacggcagcagatctgctttcacaagcagagcatggccctgattctcaagtcgtgctggtcacacctgacgaaatttttgccgagcaggtgatccgtgaaatcgaaacccaacttacggccctgccacgccagcaaatcgcgattcaggctctgcaatccagccggattatcgtcactgacaatctgacccaatgtgtagcgatcagcaatcaatacggccctgaacacttaattatccaaacccgtcagcctgagcagcttgtggaaaaaatcaccagcgcaggttcggttttcctcggagactggtcgccagaatccgcaggagactatgcttcaggcaccaatcacgtcttgccgacctatggttatacttcaacctattccagcctcggtctggcagatttcctgaaacgaatgacggttcagcaaattacaccgcaaggattaagaagcctcgctccaatcatcgaaacactggcgcaggcagaacaactcaccgcgcacaaaaatgccgtcacattacgcatagctgccctgaataactcagatgttgaataactaagataaggagcaatgatgagtactgtttttaatgtcaattcactggcaagagaaaatgtccgcaaattagtcccttatatgtctgcccgccgtttaggtggcaaaggtgacatctggttaaatgctaatgaatatcccatcgcacctgattttcagttcagcgaaaaaacgctcaaccgctaccccgaatgccagcctgcctccgtaatccagcgctatgcagattatgctggtctgcaaccgaatcaagtccttgtcagccgtggcgccgacgaatccattgaactattgatccgcgttttctgtgagccgggaaaagacgccgtactgttctgccctcccacttatggcatgtacagtgtcagtgcagaaacctttggtgtagagcagaaaaagatccccacccgtgctgactggcagccggacattaccgccatcgaaaataatctggatcgcgtcaaactgatttatatctgtagccccaacaatcccacgggtaatctgattgctcctgcggcgctgcgccagatccttgaactagctcgtaaccgtgccattgttgccattgacgaagcctatatcgaattctgtccgcaacatactaccacccgctggctgcgagactatccgcacttggtgattttgcgaaccctctcgaaagctttcgcactggcaggactacgctgtggatttacgctggcttctcccgatattatcgcgctaatgttgaaagtgattgctccttatccacttgctatacctgtggcagacatcgctgcgcaggcactgacaggagcaggcattcatataatgaaagatcgtgtagaggaagtggtcaagaaccggacttatctccagcagacattgaatgaactggcaatggtcgaaaaagtgtttccgagcgaagccaactatcttttagtgaaatttaccgatgcggaaatcgtattcagggcattgtgggaacaagggatcattttgcgtgatcagcgaaaacaagcgggactaaataattgcctgcgtatcaccattggtagccgaaatgagtgtaaacagttggtcaatgccatcgctgctcttggtagccaaactcaaccactaaaggaagctgaaaatccatgagccagaaactgctttttattgaccgtgatggaacgttaatcacagaacctccgaccgattaccaagtcgatcgccttgataaattggcctttgaagctggtgtgatccctgccctgttatccctgcaaaaagcgggttacaaactggtcatgatcaccaatcaggatggattggggactgatagcttcccccagaccgattttgagccaccacacgcactgatgatgcaaattttcacttcgcaaggcattcagtttgaagaagttatgatctgtcctcacaaacccgaagacaattgcaactgccgcaaacccaagctcgggttggtggaaaaatatctaacagaaggcatggtagatatgaaaaacagttacgttatcggggatcgggaaaccgacttacaattggctgaaaacatgggaattaaaggaattctctatcaagcccaatcacttggttggtcaacgatttgtgagcaactgacccacaaagatcgtcatgccagcgttgaacgtaaaaccagagaaactggtatcaatatcgatatctggctggatcgcgaaggtagaagcgaaatcaatactggcgtgggtttctttgatcacatgctggatcagattgccacccacggcggtttccgcatgaatatacaggttaagggcgatctctgtattgatgatcaccacaccgttgaagatactggattggccttaggtgaagctctgaagcaagcattgggcgataaacgcggcattgcccgttttggcttcacattaccgatggatgaatgcctcgcccgctgtgctctggatatttccggtcggccccatctcgaatacaaagcagagtttaaacatcagcgtgttggagatttaagtactgagatgatcgaacactttttccgttcactttcttatacgatgggatgcaccttacacctgaaaaccaaaggtaagaatgatcatcatcgggcagaaagcctgttcaaagtctttggtcggacattgcggcaggccattcgcatagaaggtgatgttctgcccagttctaagggcgtactataagggaatattatgatggaagttgttattttggatacaggctgtgccaatcttgcctctgttacttatgccatccgccggttgggttatgatcccatcgtcagtctggatgcggatattgtgcgatcagccgataaactgtttctgccgggagtagggacagcaatggccgcaatggatcaactccagcaacggcaactgatcccactgattatttcactcactcaacccgtactgggtatttgcctcggcatgcagcttctggcggcaatcagtgaagaaagcaatagtgaaacaaacgataatgtctccttgctggcattaattgatgcccccgtcaaaaaaatggcgaccgccggcctgccattaccccacatgggttggaatcaagtaaaagcgcaggccggacatcccctgttttgccatattgaagacaatgcccatttttattttgttcatagttacgctctgcctgtcggtgaatacaccattgcccaaacggaatatggcaattccttcagcagtgccattgcaaaagacaatttttttggtgtgcagtttcaccctgaacgctctggcacagcaggttcacaactactgaaaaactttttggagatgtaattgtatgattatcgccgcattagatttaattgatggcaatgtggtgcgtttgcatcaaggggattacaaccagcaacggacttatggcaattcacctttgtcctacctgcaacaatatgaaaaagaaggcgctaagttgctgcacctcgtagatctcaccggcgcgaaagatcccaccaagcgccagatgatcttgctgcgtgaattgctggctggcgtttctgttccagtgcaagtgggcggtggaatccgttcggaaaacgatatcaaatcactccttgaggccggagctagtcgggttgtgattggttcaaccgcgatcacacagccggaattagtcaagcaatggtttcagcgttatggtgcagaatcaattgtactggcactcgatatccgcatcagtacagatggcgctaaacaaatcgccatcagtggctggcaggaaaacagtaataccactcttgagcagattgttgagcaatatctccccgttgggctgaaacatgttttatgtaccgatatttcccgtgacggcacactaaacggctctaatatcgcactctatcaggagatcagtcagcactatccacagattcaatttcaggcatcgggcgggatcggcaacctcgctgatatttctctcttaccgacgactggcgttgcgggcgttatcgtcggacgggcattacttgaaggaaaattcacactgacggaggctatccaatgttggcaaaacgcataattccttgccttgatgttcgtgatgggcaagtggtcaagggagtacaattccgtaaccacgaaatcatcggtgatatcgttccacttgcacagcgctatgcccaagagggagctgatgaactcgttttttacgacatcaccgcttcttcagatggtcgtgtggtagataaaagctgggtggcgaaagtcgccgaagtgatcgatattccattctgcgtcgcaggaggtatcaaaactaccgaagaagctggccagattttatcatttggtgccgataaaatttcgattaactcccctgctctggctgatccttcattaatcagtcggttggccgatcgttatggcgttcaatgtgtagtaatcggcattgatacgtggtttgatgaaaatagcaacagctatcgggtctatcaatttactggtgatgaaaaacgcacaactgcaacacaatggcaaacacgggattgggtcagggaagtacagcaacgtggcgcgggtgaaatcgtcctgaacatgatgaatcaggatggtgtccgcaatggctatgatcttacccaactgaaattggttcgggatatctgctccgtccctttggtcgcttccggcggtgcgggtacgccagaacattttttggatgcatttaaactggctaatgttgacggtgccttggctgcctccgtatttcacaaacagatcatcaatatcggtgagctcaagcaatatcttgctacacagggtgtcgaggttagaacatgttaacagcacagcaaatcgaaaaactggattggaaaaaagtggataatctcatgcccgttatcgtccagcacgctgtatccggtgtggtgctaatgatgggttacatgaataaagaggcacttaatgccacactggattccggtaaagtcacctttttttcccgcaccaaacagcggttatggacaaagggcgaaagttccggccacttcctgaatctggttgatatctatcccgattgtgacaacgataccctgctcgccctcgtcaatccgattggctcaacctgccatacaggaaccgagagctgttttgcaccagcgcaaactgaatggggcttcctctaccaactcgaacaactactggcaagccggaaaaatgccccaccggctagctcttatactgcccgtctgtatgccagcggcacaaagcggattgcccaaaaggtcggtgaggaaggcatagaaaccgcactggcagctacagttaatgatcgggaagaactgaccagcgaagctgctgatttgatttaccatctgctggttttattacaagatcaagatttggatctcagttgtatcatccgccaattgcagaaaaggcatacagccaaagaataaggtaaagcaccctgaattgctcgattaacgagaactgttcagggagtccaacatcaagagtgctgaggctttttttaatgcttcattctccatttcaacccgttgcaacttctttttcaattcacgtcgttcaatttactccggcgtgatgggcagggcttgaggggataaatcacgtagacaggcacttcgccaccgtgttcctgccagctatgttcagcgaccgcacacagccgggctgattgacttgattcgatgtggcttcaatcaatacggtggttcctgtctctttggcaaaccagatggcattttccaatactcagaggtgtgccgaacagacagagtaaacgccacctgcctcgccggatttatggcgatggataagttgtaatagcgattgcgttgtatctccaagctatttaatacaccttaaaaaaactgagcgtcttcaagtagcgggtctagctctgtgtttgagaaagtgatttctttcttgaatattgccatataaatggcaatattcatcgagttacattgccgctttaaaaatagccacaatctcttcgtgtgatgcctgaatcgggttggtaaaaccacaagcatcttttaacgcattgcttgccaacattggcaagtcttcaattttgacacttaattcggacaaccccgccggaatattgacatcttttgctaatttgctgatttcttggatacaggcttctgcaccctgccgatcgttcaagttggcaatatcagctcccattacagcagcaatctctttcaggcgagatgcagatacttttgcattgaatttttgtacgtgtggcagcaatactgcattgcaaacaccatgcggcaaatcataaaaaccacctaactgatgtgccatggcatgaacgtaacccaaagaggcattattgaatgccatacctgccaaaaactgtgcataagccatattctcacgcgcttccatatcattgccatttgcaacggcacggcgcaaatagtcgctaatcatcgtcactgctttcaacgcacaggcatcagtgataggattggctgccgtagaaacgtaggcttcaatggcatgagtcagcgcatccatgccggttgcagcagtgagtccttccggcataccggccatcaatgccgaatcattgactgacaaaataggcgtcacatttttatccacaatagccattttgatatgacgatcaacatctgtaatgatacagaaacgcgtcatttcagaggcggtacccgctgtggtgttaatggcaatcaatggcaattgaggtttaacagaacgatcaacgccttcgtagtcacggatatccccaccgttagccgccaccagcgcgatcccttttgcacagtcatgcggtgaaccgcctcccaaagaaataatgcaatcacaatcatgctggcgcaggatggttagcccttcttcaacattaatagtggtcggatttggattcgtcccatcataaatcgcactctttatccctgcttcagccagtaaattctgaacctctccaacaacaccaatctcgtttaacactcggtcagtgacaatcaaagcctgtctgtagccataatttttcattaattcaatggcttcagtcatgcatcccataccgattttattcactggcgggataaagaaagttgatactgccattcggaactccttaggtttcactgaagtatttcaaatcttgatgcaaaaaaggtgggttacaatgtgacacttatctacctcagcaattttgatcgatatcaataatcgcctttgtaaaattttaaaataggtatagcgatgcctgaactagcaacattcatcaaaatttaacagcaaataatatcgcaattaatgaaattaatagtgtgctataatgttaattagatcatatggcgattattatatgaataatatttctacattgataatagttgtatttttgattatcagctttgtgctaattgttagcctcgatccagaggtagcacacttcattgaaaaatttgctgaaaggctgatacaaaaaagttgatatggtgcaggaagaaagtttaggggttttgtcaaaaacacgttttggataatcgaataatttatcgcatattttattaagggtgctgaacttccagcaccctatttactaacagccgatttttaatctaaccattcagtgtggaacacgccttctttatcagtccgcttataggtatgcgcaccgaaataatcgcgctgagcctgaatcaggtttgcaggcaaaaccgctgaacgatagctgtcgtaatatgaaatagccgcagagaatgttggcgttggaataccattctggacaccataagaaaccacatcgcgcagggcttgctgatactcatccgcaacttgcttgaagtaaggtgctaacagcaggttggcgatagccgcgttctcattgtatgcatttgtgattttttgcaggaactgcgcacgaatgatacaacctgcacggaagatcttagcaatttcgccataattcagatcccagttgtaatcatccgaagacgctttcaactgctggaagccttgagcgtaagaaacgattttacccaaatacaaggcacggcgaactttctcaataaattctgccttgtcaccattgaatggctgggcttctggccctgacagaactttagaggcagcaacacgctgatctttcagagaggaaatgtaacgagcaaatacggattcggtaattagtgttactggaacacccagatccagagaactttggctagtccatttacccgtacctttattggcagcttcatccagaatgacatcaaccagatattgaccttcttcatctttcttacggaagatatcagcggtaatttcgatcaaatagctgctcagttcaccttggttccagtcactgaacacatccgccagttcctggttactcagattcaaggagtgtttcagcagagaatacgcttctgcaatcagttgcatatcgccatattcaataccattgtgaaccatcttcacataatggcctgctccgtctgcaccgatataagtaacacaaggctcaccatcaactttggcagcaatctctttcagaataggcgcaaccagctcataagcctctttctgaccgcccggcatgattgacgggcctttcaatgcaccttcttccccaccggaaacacctgtaccgataaagttaaaaccctgagcagacaactcacggttgcggcgaatagtatcctgaaaataggtattgccaccatcgatcagaatgtcacccttatccaaatgtggcgtcagcgatgcaatggttttatccgtagcttcacctgccttgaccatcaacagaatacgacgtggcttttccagtgaaccgacaaactcttcaatggaataacttggaactaattttttccctggattttcagcaataacttcatcagttttatcgctggagcggttgaaaatggatacagagtaaccacggctttctatattcaacgccagattacgccccataaccgccataccgacaacaccgatctgttgtttggacatgaataactcccgtctgatcatgactgctgcccaccaagatgcctaactcaacactatgtcaatcaaataatgtcatatacaacaaaattacagtgggcaatttgttaatgagatcacatgttaactcaggaataggcttcaggggtagttattgatgcaaccgatatcgtcatactgtttttttgctgaaaaaatttccaactggaataaatcacctattgatatttctgataccaatccgcattattcaagtaatcggcacaagccgtcacattaaaaggtaaaataaactgtatggaatggatcgctgatcctacgatatgggccggtttggccacacttatcgttttagaaattgttctcggaattgacaacttaatatttattgccattctggcagacaaacttcctgaaaaacagagagacaaagctcgcctgacaggtctgacctgtgctctggtcatgagattgctcctgttattcagcctttcttggcttatttcactgacaactccattactaactttatggaatcatcctttcagcgcccgcgatttaattatgctgatagggggaatattcttgctgttcaaggctacaatggagttaaatgagcggttggaaggtaaaatgctacataacaaccaacagcgcaaaggtgcaaatttttgggctgttgttgtgcagattatcgttttggatgccgtcttctcgctggattctgtcattactgctgtgggtatggtcaatcacattggcaccatgatggctgctgtcatcattgccatgattctgatgatatgggccagcaagccgctgacgaaatttgttaatgctcatccgaccattgttatcctgtgtctcagcttcctgctgatgatcggtttcagtctggtggctgaaggctttggctatgttattccgaaaggctatctctatgccgccatcggcttctcgatcatgatcgaagcactgaaccagttttcccaattcaatcgccgtcggttcctgagtgcttcccgctccttgcgcgaaagaaccgcagaggctgtacttcacattttaaatggcaaacgtgaaaacgccgatctggacaatcatgcttccaatctgatcgcggatcatgaagatcataaagccgtctttgaaccgcaggaacgccatatgatcgcccgtgttctcagcatggcgcaacgtacagtcagcagtatcatgacctcccgccacgatgtggtttacctcgatatccatgcaccaactggaaaattgacaacgttactggaaaagcaaccgcatacacgaattgtagtaacggatgagcaagccagtgacgaaccactcggcgtagtgcatgttattgatatcctcaatcaacaactgactcataagtcatttgatttacggaaactggtgcaacagcctctgatcttccctgaatcactctccctgcttcaggcgctggagcagttccgtcaggcacagacgcacttcgcctttgttgttgatgaattcggttccgttgaaggtgtggtcacagtgactgacgtgatggaaaccattacaggcaatctgccggcaggcggtggagagatcgacgcccgccatgatattcaggtaacggaagagggatactggatcgccaatggatttatgccactggatgacctggtgctctatgttccattgctattggatggaaagcgcgagtaccagacactggctggcttgttgatggaagacctacagcgtgttccacaacaaggtgagcagttacagatcggcgaatatctgtttgaaccgctcgaagtaatcagccaccgcatcaataaagtgaaaatcacatccctgaaaacggaagaaaaaatagaagcataattcactgcattaaacccatcactaactgacaaaaaccgacataatgtcggttttttcagctctgataaattttattgtatcgttttaacctttatttttagataatttatctggacagcttcgcaggtacaattgaatgtctcatttgacattgcctgcaagatgtctctacgaacacacattcacccagttaatgcgtttatgacgcaggctgattataaaccagcgccataactcaaacagatatcacggggggatgtgtgtcgtggtaggtagttttgacactgaccacactccacgacaggaaattcacgcacaagatgtgctctccagtgttaatgagcaggtttgatgatttactcatgggcggagaagtcaccaccgccttcatattgcccgggaactttttaacaaaatttcctgtggctgggttagcaatacgtctatttattgttgataaaatgagggttttatatgagtacaaaatattttgcattactgacacatgcaggcactagtaaactggaaaatgctgcgacatcgggtacaaaacttgagattacccatatggccgttggtgatggcggtggcagcttacccatcccaaacgtcacccaatccaaactgattaatgaaaagcatcgcgctgaaattgatgtactgaccattgaccccaaaaaacccaacctgattatcgccgaacaggtgcttcctgagggtcaaggtgactggtggatccgcgaaatcggtctgtttgacaaggatggaacgctggttgccgtcggaaactgtgcagatctctacaaacctcaattgcaggaacagaccgttagcatggcgctacccgtcagcaactcagattggactggctgggtaaacgagctattttctggtctggcaacacgcaattacgtgagagaaaaaattaaagatcatgccgaaagccgcaatcacccagatgcaacattgaaagaaaagggtcttgtcactttgagtaacgcggtagatagtgacaatgaaactcatgctgcaacatcaaaagcggtaagaacaacccatgctctggctgaaactgccaataagaatgcaacctccgcaattcaaagcgctgacagtaaagtgcccttgacccgcaaggtaaatggcaaagaactgttaacagacattgaactgaccgcacttgatgtaaatgcctacaacagagcggaaaccgacgagcttatcggcatagttaaaaaacagactgataccgctaaccaaaatgcgactgctgccctccaaagtgctgacagcaaagtccccttaacccgcaaagtaaataacaaagagctgctaactgacattgatctgaacgcggcggatgtcggtacttataataagtcggaaattgatgctcatatcaataaagttgagcaattggctgataccgccaataaaaatgcgacttccgctattcaaaacgctgacaacaaagtgccattaacccgcaaggtaaatggcaaagaactattaacagatattgaactaaacgcgactgatatcggtacctataacaaggtggaaatcaatgagcatatcagcaaagttgagaagctagctgaaaccgccaaccagaatgccacgaccgcgattcagaatgccgacagcaaagtgccattaacccgtaaagtcaatggcaaagagctgtcagccgatattcaactgaatgcggcggatatcggtgcctataccaaagtagaaactgacgatcatatcaataacgttaaaactcaggtcggtaatgtcaataagctggctgaaaccgccaaccataacgccaccaccgcgatccaaagtgccgacaacaaagtgccgttaacccgtaaagttaatgacaaagagctgtcagccgatattaaactgagcgcggctgatgtcaatgcctatagtcaaaaagaaactgacgaccgtatcagtgacgtcaagactcaggttggtaatgtcaataagctggctgaaaccgccaaccataacgccaccaccgcgatccaaagtgctgacaacaaagtgccgttaacccgtaaagttaatgacaaagagctgtcagccgatattaaactgagcgcggctgatgtcaatgcctatagtcaaaaagaaactgacgaccgtatcagtgacgtcaagactcaggttggtaatgtcaataagctggctgaaaccgccaaccataacgccaccaccgcgatccaaagtgctgacaacaaagtgccgttaacccgtaaagttaatgacaaagagctgtcagccgatattaaactggacgcggcagatgttggtgcctacaacaaagtagaaactgacacacatattaataacgtcaaagttctggctgaaaccgccaaccagaatgccacgaccgcgactcagaatgccgacagcaaagtgccgttaatccgtaaagtcaatggcaaagagctgttaactgacattgagctgagtgcggctgatatcggtacctataacagaactgaaatcgatgatcgtatcaacaaagttgacaaactggctgaaaccgccaatcaaaatgccacttctgccattcaaagtgccggcagcaaagtgccactcattcgcaaagttaatggcaaggaactgtcaaccgatattcaactgattgcggatgatgttggtgcctataacaagaaggaaaccgatgatcgtatcaacatagttgataaactcgctgatactgccaataagaatgctatttctgccattcaaaatgttgacagcaaagtgccattaaatcgcaaagtaaacggcagagaactgtcaacagatattgaactgaccgcgactgatatcgatgtctataacaaagcagatgtcaacattcttttcgaggatgctaaagaactggcaaataatgcaaataacaacgcggataacaaagtaccattaactcgcacagtaaatggtaaatccttgttaacagacattaaactgcaagcatctgacctcaatgtctatagcaaaggagaggttgatagtcgcatcgacgatgttaaggaactggcaaatagcgcaaataataatgcggatagccgagtgccgttaactcgtacagtgaatggcaaggcgctgttatcggacattaaacttatagcatctgatgtaagcgcttatactaaagcggaaactgatctccgtatcagtaaagttgaagacttggctaagagcgccaataataacgccagcggccgactggagaaaggccaaaacggggcggatatcccagacaagaaagcgtttgtaaaaaatcttggcctgtccgatctcattgggttaggtatagaatcccgtcgagtcggaacagatgtcaccataatcaagcttggtgatatcatcaagatcaacggactcgcagtagctagtgaaccgattggtgaagttaattcattcgttatcggtggggttacatactatacccactactacaaaatacagctaccaatcagcttgccaaacggcataatttcatgccatgcaagtattgtcgggagtaattttgataatcaacaaccgggttaccttgctgatgtaaaaacacagcggaataatccaaatggagtaggagtgtcgaaagatacattgacaatatctgtcacaacgccgcaggttggctgggttcctcacttcgattatcaggttatagggtattaatatacactggaagtttaattcctaacccgttattttatagtgaagtcgtgccactatagaattggcataaatcaggtgatcgccgaggcgatcacctttaatattcagtaatttagatccaatctgccagccaagcacatttccctttgcatctccctacaaataaaccagcaccataatctcattaggtatgttgaaaactcatttattcaataaattctcaaattccttacgatcttcagcacgactattctgttcaatccaatttctgatggattgtttggcttttttctgtaattcatcactcagcaatgcttcaacatcgagcttatattgcaggttatcccaattaccataaacccgcaggggcacttttaatttctgtagattacgcacaaattcgttttgttttccccagccgcctgtcaattgcacccacaacgacatatctgtgttttgtttcagcaaattcgccttgccctgccctgtgatatttaacattcccgatatcgcagaaaggttatcaaccttgagctcaccttgattcaattgcgctctgacagacatattttttgcttctgtaaaatcatcagtactctctggctgattaacttggtcagtcgccctcgaaaaagactgctgaataagctgaggaatgttcaatccctccaaacgcgcattttccaagccaatattcagatcaccctgccagtaatgggtgatagcatattcatcatagccttcccccagaagatcaccatccagttcaagttgcccactgaatacgggtggcagagccagagccgtcaacagtggtttcagctctatattttgtaagagcggtttagtatgtaatttagctgggttaaccgtggcatcaatcgtcgtggggagcgcaaaatgcccaccaaatacatcgccgctcaatttcaagatttctgccattccatcatcattgacagctttcaagacaaaattatcaatatccatgccctgataaataaccttatccgccacaaacgaaagattggcctcaaacgctttcagtaaactcagatcataatttgataatggtgaaacagacgtcgcaatcaccggtttcaataaactgttttcaattcgataatcatgccttgcctgcaaatcattttgcggtaatgcatcccatcccagaagattatctaaattcagttttggcgaactcaggttgatggtgtattgcggcttattttgcaatttaacagcaatattgccgttaagttcgctttcatttaccgttaatgccagtttttgtagcgaaatggatgaaggagatgattggtacgctaagctaacactgcctgtccctttgatgccctcagacggtactccgactcccttcagttgatatttgagcgaactgacatcagccgccaagcgctgcggataatcagaaatatcaacggaagtattgaattcgaatgccagttcctgctggtttttattgatcttgctgctgaattcaagattcacgtgatcctgatccttccgctccatcagaaaattgatatcacggatatttaattgggaatcagtatcagtttgccagaccagtaagctatccgctaccttgattctggcaatatccagtttccaaccttgaccccctgccaccggatattggatatcacttttcggcgcaatcggggcttcagcctgtttctgcggctggctgtccggcataaatcgcaaaactgcacctttcagcatcacttctttgactacaaactggtgggataacagcggcagtaattcgacatccaaacgcatgttctctgccaccaccgcaggtatttcagcatcagatgccgttagtgatatctgcccagtcagaatgctcagttttggccagatatgccagcgcaaatcatcctgtaacacgagatgataaccactcttcttttgtacctgttcgactatgtagctacgaaaatcattcggattaatcagcacaactaacgcagctaaaccagcaacaatgactactaacaaaataacgagtgtcgtcaacaatcttttcatgacttcctcagtctcatgtctacaagatgaataccttcaccagaaaaaattagtcctcactaattcggctgcctacagcgccctgctgatttttatacttggcatcctgacgtcggttgtaaggacggtcagctgaacccgaaaggggttcaaagctcagcgccccaatcaccatgcctgggcgcaacgccaaaggtaatttgcctgagttataaaattccaaaacaatttgaccatgccagcctggatcaatccgatgggcagtgacatgtaccatcaggccgagacgcgctagagatgaacgcccatccagccagccaaccagattatcgggtagtgtgaccgattccagcgttaccgccaatgcaagttcgccgggatggaggaagaaaacttctccctccggcaaaacgatttcatcgctcatgacacgatcaagtgctgcattgacctccgctttggggccactcaaatcaatgtaggcagcagtatgaccacgaaaaacgcgaaactgattcccaaggcacacatcagcagttgccccatttatacgttcaacagggggacgcggggtaattaccaatttaccttcatcaatccatttaataatgtcacggtcacagagtcgcattaattcctctcaaaatacgatgatgcttatgaatgcctgaacggcaaattattcgtaaaattggccaatcttggctttcaatatgtcgatagccacgcggttcttcccaccacggggaacaataatatcggcatattgttttgatggctcaataaattgcagaaacattggacgaacggtttttttatactgttcgatgacagaatccaatgtacgtccacgctcattcacatcacgtttaatgcggcgcatcaggcagatatccaatggtgtatctacaaaaatagagaaatccatctcctgacgcaaacgcttatccgttaatagtaggataccttcaaggatgatgacgcgtttcggttcaaaatggatggattcggttttgcgggtatgagcaacatagtcatattgaggcaattcaatggattttccggctttcaatgcttggatatgttcgaacagtaaactgtgatccattgaacttggatgatcgtaattaactttataacgttcttccagaggagtgtttgtttggtctttataatagcaatcttctggaataacaccgatattgtgatcaccaacctgagcccgtaattctctataaagtgtactggcaataagacttttgcctgaggcagaggcacctgcaatacctacgattgtacacttatgtgcttcatcagccataatagaagtaacctggttaaaaaagaaaaaataaagtggggacgtagcattcagtaatgctatgtttggcggattatagggagttaatgacttctattccagagtaaacaagataagtctcgtttttttctatacgcctcgcataaaaatcccgcgatttcaccttgaaaaatgaaaaaatggctctgtataaacagagccattgatcggcgatgctgatataggattcatgaaccgatcacagaccagatagcgacaataccaacaaagtcacagtgactgttgctaatcaacaacgttccgtcgcgtatcgacacgaaattgcttaactcaaactgcgcggaaagaaatttccgtaggaattttctctccctgccagtacatctgagcagagatattggcggcaatgtcacggtaaatatctgccaattcactgtcaggctggctaatgaccgttggttcgccgcgatcaagatcttcacgcagtgagatatgcaacggaatctgccccaacaattgacaatggtatttttccgccagtttctctgcaccacccgtaccaaaaatcggctcctgatggccacagttgctgcatatgtggatgctcatgttttcaataatacccaatactggcacattaactttttggaacatcgcgatgccttttatcgcatcgatcagagcaatatcctgcggcgttgtaataaccagcgcgccagtcaccggaatattctgggacagcgttaactgaatatcccctgttcccggcggcatatcgatgaccaggtaatccagatccggccacagtgtatcctgtaacatctgcatcagagccttgctcgccattggcccgcgccaaaccatcgcgttgtcatctgtgacaagatagccgatggaattcgtcgccatgccgtgcaccataatcggcgccatgtgctggccgtcaggtgaagttgggcgctcttgagctgtgccaagcatattgggcacggacggaccataaatatccgcatccagaatacccacctttgccccttcctgcgccagcgccagtgccagattcaccgccgtgctggatttccccactccacctttccctgagctgaccgccagaatattgcggacaccgttgacacccggcagattattagcgcggcgcaaggtacagatatcataggtaagccgccagtcaacagattttgctccagtagccgtttgcaaagattgagtcgtttcttccttcagttttgcaaaagcccgcttccagacgaacggcatcattaattcaatatgcagtaccccatcaagcatggcgcaatgatgcaatgctttcagggctatcaagtctcgctctaaagtcggatgcttgaacgttgccagtattttcacaacgtgttctttcagcaggtcaggactggtctgctcgggggattgtgagttcatcccggctccttttgatttgtcttcttttaacctaaaaccgttcgtccatcatagcagaagccggcggcttgggataagaccaaaattgaaatcgacgccgaatagcgccttaaataaaagtaacgaagatcttgcgttaccctagcgacaatgcccttgatcaggtaacatcaaaaacccttttcaatatatggaagtcagatcctaaccatgtctcaagtcgcgaacaaattattggtgacctgtgcgttaccttatgctaacggtccaattcatctcggtcatatcctagaacacattcaggctgatatttgggttcgttatcatcgaatgcgcggcaaagaggttcactttatctgcgctgatgatgcccacggcacaccaattatgctgaaagcccagcagagtgggatctcgccagaagaaatgattgccaaagtgagcctagagcatcagcaggattttgccggctttgccatcagctacgataactaccactctacacacagcgaagaaaataaagaacttgcgtcccaaatttatctgaaactgaaaaagaacggttacatcaagagccggaagatttctcaactgtacgatccagaaaaaggcatgttcctgccagaccgtttcgtcaaaggtgcctgcccgaaatgtaaggccgaagatcagtatggcgataactgcgaagtctgcggaaccacttacagcccaacggaattgattaatccccgctcggcagtatccggcgcgacgccagaaatgcgcgatacagagcacttcttctttgatctgcctgttttcagcgacatgctgcaaaaatggacgcgttccggctccttgcaagaacaagtcgcaaacaaaatgcaggaatggttcgacgcgggtctgcaacaatgggatatcactcgtgatgcaccttatttcggtttcgaaattcctgatgaaccgggcaaatttttctacgtctggctggatgcgccaattggctacatgggctcgttccaaaacctgtgcagcaaacgtgatgacctgaatttcgacgaattctggtcgaaagattccgaagcagatctctaccacttcatcggtaaagatatcgtttatttccatagcctgttctggccagccatgttggaaggcagcaactatcgcaagccgaccaatctgttcgtccacggctatatcacggttaacggcacgaagatgtccaagtcgcgcgggacgtttatcaaagctgaaacgtacctgaagcaccttgatgcagattgcctgcgttattactatgctgcgaagctctcctcccgtattgatgacatcgatctcaatctggaagatttcgttcagcgcgttaacagcgatatcgtgaacaaagtggttaaccttgcttcacgtaacgcaggtttcatcaataaacgttttgcgggcaaactggctgatcaacttgctgatcctgcgctgtaccagcaatttgttgatgcggctgaaggcattgcggaagacttcacccaccgtgaattcagtaaggccatccgtgaaatcatggcattagccgatttggcaaaccgctacgttgacgaacaggcaccgtgggttgttgccaagcaagaaggtcgggatgccgatctgcaagccatctgctcaatgggtatcaacctgttccgcgttcttatgacttacctgaagccggttcttccgagcctgactgaccgtacagaagcattcttaaataccgaactaacttgggatggcatccggcaaccattgcttaaccatgaagtttcaccatttaaggcactgtttaaccgtatcgagatggcaaaagttgacgcgatggtggctgactccaaagaaagcatcgagccacaaaaaaccctgacaggcccactggccgatgatcccattcaggacaccatcgcatttgatgattttgccaaggttgacctgcgtatcgcactgatcaagcaagctgattttgtcgaaggttcagataagctgctgaaactgacccttgatcttggtagtgaaacgcgtcaggtcttctccggtatccgttcagcctatccagatcccaaagcgctggagaaccgtctgacagtgatggtcgccaacctcgcaccacgtaaaatgcgtttcggcatttctgaaggcatggtaatggctgctggccctggtggaaaagagattttcctgttaagcccggacagcggcgcacaaccaggaatgcaggttaaataaccatcatatgccttgtgaaattaaggtataataataaacaacaaagcggactcaaaaaaagtccgctttttaatgtgatgtatggcacatttacagagttagtcgtatgataaaaccctcgttatattgaggaattatgtttatgtctttccgaaacatgctggtgataggctggcaatacctgcgtgcattcgtgctgctctatttgtgcctcatcgccgggaatatcacttcagcactacttcccttctctctccccggcagcattattggcttacttcttttgttttgtttacttgcattccagcttattcctgcatattgggtgaaaccgggctgtagcctgttgatgaaaaacatgacattactgtttttacctatcggggtgggtgttatggattattacccgcaacttagccagcaaatgttcccgattgttctctcctgtatcgtcagtacagtaattgtcatgattgtcgttgcttacagttcccattatgtccattgcaaacgcattattaccggcgctcaacgaaaagaacccgatctcacttccccgccatcacaacaatcggataaaagataaaaatgttaagccatatctggtggtcactgccattaacactgctcgtattttattgcgccaaaaaattatcacggcagctcaagctgcccatctttaatccattgttgctatcaatggccgttatcattcctttgctactgatgactcacaccccctatgagcactattttatcggtagcaggatcttaaacgacttactgcaacccgccgttgtcgcattggccttccctctttatgagcagctccatcaaatccgcgctcaatggaaatccattattagcatctgttttatcggtagtattgtcgcgatggtgacaggtacagctatcgcgttatgggcgggagccagccctgaaatcgctgcctctgtgctgcccaaatccgtcacaacaccaattgccatggccgttgctgactccgttggcggaattcctgctatcagtgcagcttgcgtaattactgtcggtattttgggcgcgatctttggtcataacctgttcaatattctaggaataaaaacgtcggcttcaagaggattggccatgggaacagcatcccacgccgtgggtactgcacgctgtgccgaactcgatcatattgaaggtgcatacagttctttggcactgatgacctgcggcattatcacctcattgatagcaccttttttatttcctgtactgcttcatctatttggctaatattttgctcgttagcaactcgtgatcaaacggtgaaaaaattcataaaaatagtaaaaatttgatataagtcactaaaataacgtatctattacactcatttcactgattatatggcgtttatcacattacaaacctgagtagacatcctagaatgaccttcaattaatttggagatcattctatgcaagctcgttttcacgctatttggtcagaaattacccctaaactgcaagaagccctgttaccctatatcggtaatgacgattttccagcaatgctgaccgcggagcaggttgagtcaatcaggcaaatctgcggttttgatgatcatgcgctggcacttgctctattaccacttgcagcggcctgtgccattacacctatctcgcatttttacgtcggggcaatcgcacggggagaaagtggcaacctctattttggtgccaacatggaatttgctggagttcccttgcagcaaaccgttcatgccgagcaatcagccatcacccatgcttggctgcgcggtgaaaaaaagctggtttccatcaccgtcaattattcgccttgtgggcactgccgccagttcatgaatgaattgaacagtggaacacaattggaagtctgtttacccaaccgcccacgtttgacgctggctgactacctgcccgaagccttcggcccacacgatttactggacgcaccattactgctggataccgtcaatcatggctaccaattggatacctgtgacgaattagtgctggcagcactggatgcggcgaaccaaagccatgctccttacagccagtcccatgccggtatcgcactgctggatgaacaagatcaggtttacaccggccgctatgcggaaaatgccgcatttaacccaagtttaccgcctttacaggcagctctgatcttaatgaatatgtctggtggcaattgtcagtccatcaaacgggcaatattagtggaaggaaaaaatagccatctatcccaatcaagcgcaaccgaatccacattaactgccctcggttgcaccaaaatagaatgccatagattttgactgcccatctttaaaaacaacaattcagtaaaaaattcgggcaaacatgaaattaagataacttaacaaaatggcaaaattcccctctgaatcgctcagagggggtataatcgaaaaaattcataacatttaattagctaattctgtaagttatctctcatttctgctcatgataaacataattaaataatatttactgtacttattttttttatcttcttaggatctataattttgttattgattagtccaaagagtaagtatcatggaactggaacacgaaagtaaacgtcctctctatattccctacgctggccctatcttgttggaatttcctcttctgaataaaggcagtgcctttactgaagaagaacgcagcaatttcaacttacatggtttattacctcagatagttgaaacgatagaagaacaagccgagcgtgcctaccgccaattttgcgattttaaaagtgacggtgacaaacacatttatttaagaaatattcaggacaccaacgaaaccctgttctatcggcttcttgatgcccatctcagcgaaataatgcctatcatctacacccctacggtgggtgaagcatgtgaacacttctctgatatttatcgccgtgcccgtgggttgtttatttcctatccaaataaagcgtctatcgatgacatgctgcaaaatgccaccaagcagaatgttaaagtcatcgttgttaccgatggtgaacgtatccttggtctgggagatcagggcattggcggcatgggtattcctatcggtaaactctcgctgtatacctcttgtggtgggatcagcccagcttacactctgccagttgtattggatgttggtacaaacaacccgcagcgtctgaatgacccactgtatatgggctggcgtcacccacgcattaccggcaaagaatatgatgaatttgtcgatgaatttattcaggctgtgaaacgccgctggccaaacgtgctgctgcaatttgaagattttgcccaaaccaatgctatgccgctgttgacacgctatcgtcatgatctttgctgtttcaacgatgatattcagggcacagcagccgttgccctcggcagcctgattgccgccagccgcgccgcaggacgccagttgagagatcaaaccgtgaccttcctcggagcaggttctgccggttgtggtattgccgaacagatcgtcgctcagatgaaatctgaaggattgagcgatgaacaggcccgcgcccgcgtgttcatggttgatcgctttgggctgctgactgataaacagccaaacctactggacttccagagtgtactggtacagaaaaacagcgtcctgcaatcatgggatgtcagcaatgacagcatttcactgatggatgtggttcgcaatgccaaacctaccgttttgattggtgtttccggccaatcgggtctgttcacggaagagattatccgtgaaatgcacaaacattgtgagcgtccaatcgtcatgccactgtccaacccgacatcacgtgtggaagcgcgccctgaagacatcattaactggacggatggcaaagcgctggtcgcgactggcagcccatttgcccctgtgaaatatgatggtcaggaataccctatcgcacagtgcaacaactcctatatcttcccaggcatcggcttgggcgtcattgcttccggtgccagacgtgttacggatgatatgttgatggtagccagccgcgcattggcggattgttcaccgttggcacaaacgggttcaggcccattactgccaccgattgatgatattcaaaacgtttcccgcaaaatagctaaagaagtggcgaaaaaagcccagattcaaggcatggctaccgtcacgtcagaagatgcgctggagcaagccattgagcgcaatttctggaaaccagaatatcgcgtctataaacgcacttcattctgatctaagacctgttaagatcagctaaaagcctgccaacggagttggcaggcttttattaccgcacgaaagcttgcttcaatatttcaagtaaagtagcctttaagacattgaatcatgagtacgcacaaggcaaagaaaaacaatgtggaagcgcctgattaccgggctggttttcatcatggctgttttaatactaacagtcattatgcttgaccgctggattagctggaaaaccgccccctatatttatgatgacctcaaccagcttcctgaacgagaagtcggtatggtactcggcacgtccaaatattacacatccggcgcctataaccagtattatttctaccgtattcaaggggctgctaacgcctacaacagcgggaaggtgaattacctgttactgagcggagataacgcccaactcagttataacgaacccattacaatgcagaaagattttatcaaggcgggaattccggcttccaaagtaataatggatttcgctggcttcaggacgttggattccattgtccggactcgtaaggtctttaatgccaacaactttactatcattactcagcgtttccactgtgaacgcgccctgtttattgccatgcatatgggcatagacgcacaatgttatgccgtatcttctcccaagaatatgatgatcatacgtttcagggaagtatttgcacgcctcggagccttggctgacctttatattttgaaacgggaacctcgctttttaggcccgttaacaccgattcccagcgaaactctcatcccgacaggtattgaaggctatcctgccgtatcgccagaagagttacaggaattgaggaaaaagccccgcagttaataaacgtagaaatagcataagagcctattggataggctcttaccttttcatttaaaccctgccagccagttttctggttaaaccacgccagagcttttcaatcggcccttgctgataacgttttaaccaccagcaggcaaaccagatattgaaagcccagaccaacgggataaacaccagcaattccaaacgggtaaactgatcaaaaaattcccaacgataaaaaatcgtggtgcaaatcaaagtttgcagcaagtaactggtcagcgccattctaccaacttgtcgtaaccagaagttcactcgccaatgggaaatgattggccaaaaaccataaatcaacgcgatataagccaatgccagcaagggcgtcgccagttcggagatagtatgacgaatagtccatgaggcaaaatagctgaagggatataaacactgtatggacagagcaataacctgaatgaccatacctgacggaagtagccataatgctaccctgcggtaatggctgagactaaactcccctttcagccagccattgcgtagcagcatcgccccacagagcatcaccccaaccatttgccaaccatattgcacgataaccactatcatcatgccacttacctgacgaaaacgatactcgatagccaataacccaccctgggttttccaatgactttcatgaaaaatatcctgcggtgttggctgccagaaggcactattttctcccactggaaacaaccccagaagataaaacatcatcaaaccaaacagataaaaagtaattcctttaccaaacaatctatgacgagtatggataaagtgccatgccaaaagaccgacaataccatataacagtaaaatatcaccatcccacagcaagataccgtgcaacaagccaataacagccagtataatcagtctgggaatattccattcacgccctcgctgccatagtaattcaagtgaagcaccaaataacaaagtcaaaatgaataaaaattttccctgagtaagaagactcaggacagaccatgtcatcacatcagaaaatgagatcggatctgtataaaaaagattcatagaagcggcatatggcaaggcaaaactgaaaatattcaaaattaatattcccagaatagcgaaaccacgcacactatcaagtgcctcaatccgctgacccattacctcactcttttccatgataataagagttcatcatgataagtgcaggtgacgcacggcacgcaaaaattcctgtcgtgtattctgactagatttaaacaaaccgccgagagaagttgtcgtcgtcgtgctggtcgcatcgcggatgccacgggctttcacgcagtaatgaacagcatcaatggaaatggcaacgttatttgtaccgagcagcgtttgcagtgcaatcaggatctgctgtgtcagccgctcttgcacctgtgggcgctgcgcaaaaaactgcacgatccgattaattttcgacaggccaatcaccttatccttagggatataagcaaccgtggctttgccatcgatagtgacaaaatggtgttcacaggtactggtcagcgtgatatccctcaccgttaccatctcatccactttcattttattttctatcaaggtgattttcggaaagttgttgtaatccaatcctgaaaatatttcatctacatacatttttgcaatacgactcggcgtatccgccagactgtcatcactcaggtcgagatttaacagtttcataatttctgtcatgtgttcctgaatcagtaccttacgcacttctggtttcagagtttgttcacgcaatggggtttcaaggccacgggagaccagtgctgagtgcaccagagcggcttctgtacttagggatgacatcagtttctccaagaataatactttccgttacttgacgggaaatcgagacgcatattttacgcagatatctgtgaatctaacaccttacatacaatacggattcacaagacacctgctgacatggtatccactcgcgtggtatgtgtttacattgtatctgtgtacaactctatctgcacgttatcaatatcaatgcgccaaatttggattactcactgtggatctgattgcgcctgaagaccagtaaccccgcaacgaccagaccaataaatgcgatatacaaagcaggctccagtttgcccgttagccacgtcgaagtagctgaaaacattggcccgactaattgccccagcgcataacccgtggtcagcagccccgccatataacgagcatgattcggcgctaattcacgtccatacaacaaggccagttgcacgacacacataaatccccctcccaccaacaatgccccgatcacaaggcctccaatacccggcagcacttcagcaatcaatattccaatcgcctgaagccacaaggtgatcgccaagcggatttgagtagtcgatacatggctcagcaaaattcccagtacaatgccgagtacagaagcgccaccaaatatcggccagacaaattgtgcaaacaggctgtcaggaaaacgctctgtcgccatttgagaaaggaatgtggcgggtaggatataaccaaatccagccagactgtaactccatatcaaccgtttgatttccggtgtcagaataagtttttggacgttagtctgtgggcggtgcagttcaccacgacgcggcagataacgactgacatagatactgcatagcaacgccaacatgccataaatcacccaagccttggccgcgcccatcgcccaagattggataccaacagccagcacaccactaatcaaaattcccattcctgttccggcaaagacagcggcactcaatctcggacgattcagttttgccagttcatcatttacccatgcagcgaccaataccaacgtccaaccactcgcccagccaataaagaagcgagcaatactatgcaatattggcccatccagcagtgccgaaagcaacgtgataatcaccgccccccacagcccactccacaggcggtattccacgaatcgctgtgctcgcatcgcatcataagagccagccagataaccaaggtaattaaatgcagcaacaattcccgctcccgtcagtgtgaattgggattcagcgatcatcagcggaacttgtggagtaaaagtgaagcgtcctattcccattgcaacaactaaagcgagaaaaccgctcaatgcaatctggaaagcttgataatgacgacggccagaagtgataatttgatttctcatagtgattaaaaataatgggattaattgttttaattgacattattcagttataacaaatcataaatataatacaccttttttcgtaacatttcgttctttctctgatgtggcaacaattccccatcaaagcgatctttgccataatgcggccagcacaggaataaacgtttatccgctattggcggcatattgggagttctttatggatcattgtcatacctcaggcttaatctcgctcgaacaagcgctggaaaaactattggcacaagccgttgccctgactcaaacagagactatcagcctgacgcagtccgctggccggatcaccgctacagatattatttcgccaatcaacgttccccctttcgataactcagcaatggatggttatgctgttcgtcttgccgatctaaacggaaatcaggctttgccagtagcaggcaaggcattcgccggtgcaccatttcaaggagaatggcctgccggcagttgcattcgtatcatgactggcgctcctattcccgctggtgccgatgcggtgataatgcaggaacaggctgaagttacggaaacagatattcgattctcctatcccattcaacaagggcagaatatccgtaccattggagaagatatcactcagaatgcggtcgtattgccaaaaggaaccaaactatccacagcacagttgccggtgatcgcctctctgggcattgcaaaggttgaggttattcgcagattgaaggttgccattttttctacaggtgacgaattacaggcgattggtgaaccattacaggcaggtcaaatttacgacactaaccgttttgctgtgcgcctgatgctggaaaaactagattgtgaggtaatcgatctcggtgtgatccccgataaccctgacgcattgcgcaatgcctttgccgaagctgataaacaagcagatttagtgattagcagtggcggggtctctgtcggtgaagcggattacaccaaaccggttctggaagaagtcggcaaaatcaatttctggaaactggctattaagcccggcaaaccttttgcgtttggcaaattggaaaacgcgtggttctgtggtttaccgggaaatcctgtctcagccgtgctgactttttatcaactggtacaaccgctgattgtccgtctgtcaggttttacagcatggcaaccgccaatgcgcctcaatgctaaagccatcacaccactgaaaaagtccccaggcaggctggatttccaacgcggcaccgcttccattaatgaacatggcgaattagaagtacaaaccaccggacatcagggttcccatattttcagctcatatagcctcggtaattgctttattgtgctggaacgagagcgcgggcatattacgaccggcgaaacagtgcaaatcgaatttttcaaccacttactgaaaaaccaataggtaacgggaaaataatggttatcgagctcaccgatgaagaaatcctgcgctacaatcggcagattgtcctgcgtgatttcgattttgacggacaggaaaagttaaaatcatccaatgtgttgattgtcggtataggcggtctcggctgtgccgcctcccagtatcttacttcggctggcgttgggacaatcactctgctggactttgatgctgtttccctttccaacctgcaacgacaaatccttcatcgcgatgagcgcatcggtatacccaaagtgcattcggccgcccagacactacgggaaataaacccgcacgtcaccttacatcccattgagggattattggatgatccatcactgaatgaattgattggccgacatgatcttattctggattgtacggataacgttgccattcgcgaacagctcaaccgcctgtgttacgagcgaaaagtccctttggtttccggtgctgctattcgcatggaagggcaactggccgtgtttacttatcaaccggatgaaccctgttatcgttgcctgagccggttatttggtgaaaacagcctgacctgtgttgaagcgggcgtgatggcgccactggtgggaattatcggctccctgcaagcgatggaagcgattaagttactgactcaatacgggaaagtcagccgtggcaaagtgttattgttcgatgccatgaccctgcaatttcgtgagatcaggctgcctaaagatcctcagtgtgaggtttgctaaagctaattttaacaacaaaccctattctatactcactgcctttcctacctgaaaaaacgtgggttaaggggaataaaaatattgatgatgatttgataacgttgtctgatgaaaatcaaattttcttacccgtctactcatgttataatcacataaagacattactcctttcttttatatttcttccttagagtcgtattcgggctatggtgagatttccctgatgttgaattcttgtattataaaatcttaatagataacatagtattataaatcaccatcaatgataatataatatcaatgagattatataatgcaagaactgaatgataaaaaatcaacggaagctgatgccttgttatccaacatcgctaaaaacattgattttttgattaaaaagaacaacatagactcacaaactctgagcagattaactggtctcggaattgcgactatcaacagcctcagacgtggagttggaaaccccactattgctactgtttcatcaattgcagatgtatttggtgtgaatgtgggtgaaattaccgatggaaaattatctgaatcaaataaaaatgaagaaattatctcatcaatacctctggttaggtatgatgaattggatggttacgtatctggcaaaataatcactaaaaatttatataagctcagtattcaggataatcatgaagactctctttttgccgtagaatttggaaataaccttttatttccctattttgacagtaacaccatcgcaatagtttctaaaaccgaggcagtttgtgacagtgatgtcgttctcgtaaaaattaaagatgctcccatttgttttagacaagtttttgtcggcgaaagtggaatttacttttcaatattaggcattgagaacgaacggaaaacagttttaacgcagaattacacaataattggagttgtgattagatcaattagaaacttaaaataggatttaattgtggttaagataataagttttctcaaaaaaatattcgaaactcgttatatatacagtttgcaaaaattcgagcctataaaggaaaacggattttatatcttgaaagaactaggcacccatacatgcataaaagcaaaagcagaagcagaagatatttttgaaagcgatttgttatacaatatcaatcctcaagatatcatatttatagcaaggtttgaagaatatgatatgagagaaaaacaaaaattcaaaataatagaggagagaagagatctttcattcatcatacagaatgcatattctcgcagagaaattaatgaaaaagaactgcttatagaacagaatatagtagaaaaaatagatccaacgagtcttgtgagaatagcctatatgtcaggattaaaagatggaaggaaaatatctgacgagatctcaaaagctgaaaaaataaaaccctctaaatccccaaatttaaaggtaatcaaatgactcagaattaccccactcattcaaagtttaagtatgattctttgtttatttctctatctgtaacaataatgataacttgtgatgttcttgtatataaaacactagacttttatgattttaaaattacatttagtggaattttgttttcgttttactttcttatatccacgattcagacagaggtttatggataccggcaaggtgtaaaaacggtctggatcatggtgttatgccaatcaatctttgtcatggttatctttgtagcatcgcatatgcaacccgaaaacaatcagatatcaatgaattttaagtcattattcggagaattttggcgtgttatggtaggaacatggacttctgtacccatttcttactttattaacggatttgttatatccagcctgaaaaaagtctttcttggcaggttctttttcatcaggtatctcattgcctcgatgaccactcaggcagctcttctgttatcggcttatcctataagcctctcttcaaaatataatttcaatgaattaataacaataatcacaacaacatggtcttacaaagtcgtaatgtccattattcttctgcctatagggatcatcttagcggataaagtcaaaaaactagagtcggctgatgtatatgattggggcatatcatataatccatttttcttcagaggtaataaaaaatgaaagtcgttaatttgacagacatacacctgaccagaaacagagataaaaaactatttgatgtaaatacgtatgataactttgattttgtttgtgaggaaatacatagaatacagaaccttactgaaatagagttaattatcgtgtccggtgatattgcaaatgatggtgatgttgaggcctacagatattttttgaataaaatggagtcactaaaaacaccttatatttccatactcggcaatcatgatctcaataaaaactttgaaataacactggcggaagaaaaaccaaaatacattatttcctcccgtgaatataacaatgataattggtatataactgccgtcgatactgtcgttgaaggagaagattatggttttataactcaagataaccttgctgaattagaaagaaaaattatcacaaacagcaattttaatatcgctatatttatgcatcatcatgccatgccggttggtacgccaattgtagatagctgcatgctgaacaatgccaaagcaatactggaactttgtgagaaacatagggttaaatttattggtagcggtcatgcacacacaccccgcgtttggcatcataataatatgacagcatgtgtttctcctgctgtttcatttcaatggttatcaggcaccaatacagtgaaaatttcaaaaggctttggctttaatgttatagatttttcaccagatttatctatcacttcatgtatttattaatcgtcaataacgacaagtaaaaaagcgcttcatatgaggcgcttacttattggttgatacctgatagggtactttatcggggaattacatccttgtattcacttcagccattccgccctcaatacgcaaactgaaaaataatattcacttttaagatcatgcgggcagaaaaaagactttactcagcaattccctgacttctcagatactcatcataagtccctctgaaatcaatcacttcgtcggatttcatttctaaaacacggcttgccaatgagctaacaaatgcacggtcatgggaaacgaaaatcaacgtaccttgataaagttccagcgcaaggttaagggattcgatggattccatatccagatggttggttggctcatccataatcagaatattcggtttgtgcatcatcagtttaccgaacagcatccgtccttgttcaccaccggacagtaccttgaccttcttcttgatatcatcctgaccaaacaacaaacgtcccagcgcactgcgcacggactgctcatcgtctccttcgcgcttccactgactcatccattcaaataccgtcagatcgcagtcaaaatcgctggcgtgatcctgcgcataatagccaatcgtattattttcagaccatttgatcgtaccactgttcggctctgcttcacctaccagcgttttcagcagcgtagttttaccgataccgttttcaccaataaccgccattttttcgccaacttccatcagcaggttcaggttcttaaacagtggttcgttaccatagctcttggtgacaccttccaactctagcgcattacggaacagttttttctcctgttcaaagcggatatacgggttttggcggctggaagctttcacttcttctaactggattttgtcaatctggcgagcacgggacgttgcctgcttagacttagacgcattggcactgaaacgactaacaaatgactgtaaatcggcaatctgtgcctttttcttggcgttgtctgccaattgacgttcacgagcctgcgtcgccgcagtcatgtattcatcatagttccccgggaacagacgcaatgcgccataatccagatctgccatgtgagtacagaccatattcaggaaatggcggtcatgggaaataataatcatggtactgttacgttcgttgagcacttgttccagccagcggatagtatcgatatccaagttgttggttggctcatcgagcagcagaacatcaggattagaaaacagtgcctgtgccagcaagacacgcagtttccaacccggtgccaccgcgttcatcaaaccataatgctgatccacagggataccgacaccgagcagcaattctcccgcacgtgcctctgcactatagccatccatttcaccgtaggcgacctccagatcagccacacgatagccgtcttcttcgctcatttctgccaaggcataaatgcggtcacgttcctgcttaacttcccacagttccgagtgccccatgatgacagtatccagcaccgtgtaggtttcgaaagcaaactgatcctgacgtagcttacccaatcgctcattgggatcaagactgacattaccggcggttggcgttaaatctccacccaggattttcataaaagtagacttacccgccccattcgcgccaatcagaccataacgattgccgttgccgaatttggcagaaatattttcaaatagtggcttactgccaaactgcatggtgatgttgtttgtacttaacacaacttttgctcttaaagtggataaaagggaatttggaaaaaatcgatagtcgcgcattatgacacaacaagaaaaaagtatcgccagaatacctcgacctctatctcaaaaaccaaaacacagaccccgttcacataaaaaaataaataaaattttcttatgaaacaacctgaattgcccgctaagaaaacatagaataaggccaataattattatagactttcgatgaattttgcggctcaacaatttgatataccggaaaaagaaaatgcaaaaaatcagatggggtattattggttgtggtgatgtaacagaagtaaaaagtggccctgctttttataaactggaaggttcagaattaattgcagttatgcggcgcaacgccaatttagcaaaagaatttgccaaacggcataatgtcccaaagtggtattctgatgccgaatcgctggttaatgatcctgaaattgatgcgatatacattgcgacaccccctcgacacacaaagaatatactatcctggctgcacaagccggaaaaatagtatacgttgaaaaacccatggcgctgacctttgaagaatgcaatgaaatgatcgctgcctgtcgttctcagaatgtgccgctatttgtcgcgtattatcgaagagcactaccaagattcctaaagataaaagaattaattgattcaggtgccattggtactccgcgcattgtaaattgccaactcttcagagaaatggaatcccgctaccaagatcctgataatttaccctggttcgtaaaaccagaaatatccggtggtgggttatttgtcgatttagcctgccatacacttgatatattggattttctgttgggtaaaatcgtttcggtcaaagggcatgccaattcacaggcaaaagcctatccggcggaagattgtgtctcaatgtcatttatgtttgaaaaccatatccaaggcgttggtatatggaattttgtcgctggcgaccgtgaagataaagtagaaattatcggcacaaaaggcaaaatcacgtttgcgacattcggtgatgcagctatttcatattatgacgaaaataatcagctgcaccaattccattttaaaaaccccaaacatattcagatgccatttattcaaacggttattcatcaattgcagcgcaatgatatcagttcatccaatggagaagccgccgcaagaaccagttgggttattgatgaagttctaaaagagtatcgaactgccctatacataaaaaacaaagaaccataacccgtcaggccagcatcggctggccaaagtatttagcaagtgtttgaaaaacattaatgttaaagatgacaacaggagaaataaaaatatatcaactatcagaatattgttctgatagtgaaataaattattaatttattacggagtaattgacatcagtttattaacttcgttatatccttctttttcataaaaacgaatagcttcaaaattttgcgacaatactgtcaattccaaatgcgaataattgttttcttgtgtccattttttcattccagctaacagtcgctgaccaattccttgacttctggcatcctgactgacgatcaaatcaaaaacataaccataagttcgtggtatcaaacaattaaacggtggcgtattttgctcttgcgcaatggaaaatcctttaatatcaccattatcatcttccgcaaccaataaatgaaatttattattatctttctaagaaataattaaatttctatcctgctccgagccttttagcctatctggctgcaattcagccatttcactaaataaaacgttatagagtgacaaaatagcgtcaatatcccgtatgaaagccgatcttattatcataattagtccttaatgctgaaattattgaaagtgccacacggtttattattccagccaatcatgctccaagtaaagacctcactgaactcttccagcgcgccaaagccgccgggtagtgccacaaaatcctctgccagttcaatcattactttttaattataagttacacaactgataatacagttgagttgcgcctgtttcgctgcgaagatggcagccctagataacatgttgtaaccgaggttttctgtaaatgtctttttccaaacaccgggcggcttcttttccactgcttcctatcgttttattattactttcaatgacatcaattcaagcgggtgcttcactggccaaaacagtatttcatgtcattggcgcacctggtgtcaccgccctgaggctggcgttggggacgattattttatttctgatttttaaaccttggcgtctgaaattccagcgagagtctcttattcctctttttgcctatggcatttcattgggcgcaatgaattacttgttttacatggcattgtcccgtattcctcttggtattgctgttgcgcttgaatttacggggcctttagctgttgccatgttctcttcccgacgcccgctggatttcctttggatcgccttggtcattgcaggattaggttttctgttaccggtcggagatggcgtcagcacacttgatcctatcggagtcttatatgcactgggagccggtgttttctgggcactctacattattttcgggcaacgtgctggtgccggctacggggctgcaacagtttccattggatcattgattgccgctatgattttcttccctgtgggattgatacaaactggccctgagttactgtttgatccctcgttgctgcctattgcactagggatcgccattttatctaccgcatttccctatacactggaaatgattgccctcacccgattacctgccaaaacgtttgggacattaatgagccttgaacctgccttgggagcattatcagggattatcttcttgaatgagcatttgacgatgactcagtggatcgccctgttctgtattattttcgcttcaataggctctacctcaaccattaagcggaaaactaaaatagaaaaattagaataatcaatatgaagggtatatcaactatcaatgtaatagagacaagcaatatgactcccggagagttatcaactaatcttatttcatccgatgagataactcattatacggcattaagggaacatcattatgagtacagcaaaattaatcaaccccaacacttcccacctgatttatacccgcaacaacgttaataaagatgtaaagcagagatcgattactgccctgaatcatatggtgatccactttatcgacctctccatgatgactaaacaagcccattggaacatgcgtggcagaaactttattgccatccatgagatgcttgatggtttccgcactgctctcactgatcaccttgatacattcgcagaacgtgcagttcaattgggcggcaccgcgtcaggaaccgttcaggaggttcacagccgaaccctgctggaaaattacccaacgggcatccatgatgtgcaggatcacttaaaagcattggcagaccgctacgccgttgttgcaaatgatatccgtcggcgattgttaatgcagaagatgaagatacggcggatatgtttaccgcagcttcccgtgatctcgacaaatttttatggtttatcgaagcaaatattgagcaataaataaaaatattatttttcattatcttatggccgcatctgcggcctttctgcatcacggataatctccaataagaaaaaacatcgaaaaatagccgctacaatgtcaaagattagactaacctttaaaaaaatcatttttctctctataatctctttttgatttaaaaatcaacatgaggacgctatacgatggataccgaagtcaaagattctaacggcgcattattaaatgatggtgacactgttcaggttatcaaagatctgaaagtcaaaggtacttctaagacgctgaaacgcggcacattgatcaaaaacattcgtctgactcaccgtgaagatgaagttgaatgtaactcagataaaatcaaaggattagtgcttaaaacctgcttcttaaagaaaattggataaatagcagttacaaaccgatttttgcttaaaggataaataatattaattattatattatttatcctttttcatgaagaaacataataatattcaaacaataacattagaaaatttataattaagactaacttcggcaaatgttaatcccttcctcatagctatccaataactttcaagttgcagcacaatggaaaataaacgaattctcaaaaacataagtaattatttggattgtaattgacagaataaatttaattatctcagtgatactttcctatctggtttgctatattacttatcagcaaacaccaaatagaaaaatctatataacaataatacatctcagttttacactctatatattcactctgtttttctacaatatcattcacatagaaaataaacacctatcttatcttgttaatttctcatcaaaaagaaaatttatttttattaattacagcctgtgtcttttattatttacaatatgcggcctgtattatattataataacccaatcaaatacgatattacttttttattattcaggcatttactctttaatatcattaataaatttatcaaggtcgcaatatacaaaattgatcaccttgtgcgttattgttttattttcttgtttaggaggatatatttatgcttaattccaaaacgggaagttagcataacttatcgtggtcaataacgcttcctcgcgttattgaccttttttcatttgcagtaattcatcttctgacggcacatccggttgctcaataggaaataccggtaaagcattcaacaaacgggaaccataacttttgttcagtaggcgccgatcataaatcaccacctcaccataacattcatgactgcggatcaatcttcccacttgctgaataaggttgaaagacgcactcggcaaactttgtacttcaaaaggatatcgcttcagggatttcagccattcactttccgtaatgatgaccggattggtcacaggaggaaaagctattttatggatatgtacttgtgaaagataatcaccttttaagtccagcccttccgcgaatgattgtaatccaatcagcacgctgggctgcccttcatcaatacgtctgcaatgagtttccaccaatcgataacgcggctgatcaccttgtaccaataacataagccgcaattcttttacgaaagtaagaaaaccttccattgcacgctggctgctaaatagcaccagcattccccgataggctcccatcagtatctgcgaacgaaaataacgcgccatttcttcaagatgctgcatttcattttgaatagtgggttcctgcgtcatcaggggaataataatacgtccctgacgtacgtgttcgaaaggagatgacaaggtgataaagcgatcatcataattttcatgcagccctgtcagctcctgaatacgagagaagctatttagagagcgtaatgtcgctgatgtcactacaatatggggaatcttacgccataacaactgggttaattgctcactgactcgaatgcctgcacagtgaaaataaagatgcgattggtttttctcataacggcgagtgagccatttcgatattggtgcatgggaagattcttcctgtgatgctaaacgccacagtttcaccatattctcaaagtaacccaatgttcggctggtttgcagaatagcatggtgcaacctgacaatatcctgtttggctgtttgatcggtaagatcatttacaatcgcttcagacaggccacgcaccccatcagtaagtttgaataattgctggcagcataacagcaaattttcaggtaattttcccagttcaaataaatattctgctgcttcacggcgttccggcaataatacctgtgtgatatccgccagctctttaaaacattcacgaattttttcacaatgcgcctgcaaacgggtgatatttgccaaagctggcggttttgtcgggcgaaattgaagcaagtattgttctacattacgaacaaaggtatccaactgcccattaagttgaaataacgtgatttcgccttcaacttccagtgaatcccttgcaacatcgggaatatgatgcccttcatccaaaatcagcagcaggtttttcgcgtccggcaaaacggattcattttccagtgcagcgatgaccagagaatggttggcaacaacaacatccgcactttcaatttcccgacgggcaaggaaaaatgggcagcgatggtaaaactggcaatttctcgccaaacaattcattttatcggtgctgacctttgcccacagagaatccgatagcgccagttgatgatggtcacgcaggccatcccagataaaagtgctgtaatcactgcgcagcctacgacacagatcccgttcttcactattggcgatttcagttttgtcttcgaccaaaagcatcagatcaatctgctccccctccgcagcacagatagcttccagattgcgtgggcaaacataccgcgcacggccaaaagccccggtgaatttcaggtcagggatgagcttgcgtaacaacggcaaatctttgctgtaaatctgatcttgcaaagcaacattggctgtactgaccacgagcggctttttttccgcccgactgacggcaatacccgggatcaggtaagacagcgttttaccaaccccggtcggggcttctatcaccaaatgccgtccttcttcatctgccagtgtctttgcaacctctgcaatcatctgacgttgaggctcgcgtggaatgaagccatcaatatggatggataacgccttataccattggctgatctgattttttattgcgctggaaagtgccatgagttttgctacataaaaattggagggctattctcccataggatgactatcagatcagctttatatcactattattgggaacacgtttccagctttttcattgaagaagcaagaaaatcggttattacttgtttggaatacagaagccgatatacttttggctttccgtgtcggctataaatcatgactagaagctatcactgagaaccacgacttaaaaatatagcttttaaaaatatagcggctaaaaattctgattaaaaatcttattgagaactaaagatgaaaaaaatcctgcttattatcatcgtgttattttccctcggctctattggcggtgtctttttggcagggctgaatatgtacactcgctcaacaactccggtagaagagccacagcagtcacagcaggaaaacgccccgatagggcaacaataaccgtcaatacatccgcttttattgcaatatccggcattgcaacatcatgtgagaacgctcatgaaaaatgaatattttgttagtccgcaatggctaaacgaccatctccatgatgagaatgtcgtcattgttgacgccagcgcccccatgcctacccaaactatcgattatcaccagttatggctggataaccatattccgggtgcccagttttttaacctggataaaatcgccaatctccagactaacctgccacatatgctgccagaaccggaggttttccgtcaggccgttagcgcgatggggatcagtgaaaaccatctggtaataatttacgatcagggaaatatgttctctgccccacgagcatggtggactttcaagatctttggcactcgcaatatccgtattcttgaaggggggttacagggttggcagcaaatgggttatccaacggaatcaggtgaagttacccgtcagccccaaattttcaatagccaattcacccctgaaaaagtctgttctcaggaacagatccttgatgctctccatcataaagcaccaatacagtttattgatgccagagccgaagaccgttttcaggccaaagtaccagaacctcgccccggtttgagaatggggcatatccccggctcaaaaaatgtcccgtggacaacattgattgataatggaagttataagtcaccagacgaaattgcagctatattcaaaaagcaaggcgttgatttaaaacagccaataatgactagctgtggttctggaatgaccgccgcagttttagtattagggctggatatgattggtcacaaagaagtgggattatacgatggctcttgggctgaatggggtgccgatgattctcttccgttagaaaaatagataaaacggcaaagggcattaaaatatcatgccctttttcctatcaagcatatgaatcctactgcttttataagacgattaattagaaattttatggtatacaaataggacaactatcgcaccaacgactgcaatggcaaaacttcccagattaaatccatcaacttttcccatgccgaagaatgtactgatatatccaccaacaactgcaccaataattcctaaaatcaccgtcatgatgataccgctactgttatcccccggcataacccacttcgcaataattccagcaattaagccaaagataacccatgacaggatacccatatacaacctccagaattgattagatgacttgtttaagaaccttagtataggctctaatatggttttactgtatatttctcttctatgccctaatttaagacactaaataaaagaattgcaaatagtaaaagaaaagatatttataagtcattagccatatttatataaaaattaacattaaaaaatcagaatccattaatgaaatttaaaagttaattttttcaaatgaataattatcacaggtcagttagcaaaatatttttcagtataatgggaaatattcggtcaatataataaagatgaaagggatatagcagataatttaatagcggctgggttggtcccagccgctacgttttttcaattgatagcaataatcatgcttctgcggctgaaaagataatatttgagatagcagcagacgttttcaatgctctgatctgcataaataactcatcggcttcatcatattctttacgtagataaccaagccactgcttgatgcgggcaacgtgatacatgcctgtatcaccccgcttttccagataagtatatttttgcaataactgaagcacaccattccacggcatttttggttcgttatatttaataatacgactcaaatttggcacattcagggcgccacggcctatcattaccgcatcacatcccgtcaccttcatgcactcctgagcactgtgccaatcccagatttcaccgttggcaatcacaggaatggcaagacgacgccggatttcgccaatcgcctgccagtctatgcgttctgctttatagccatcttctttagtacgcccatgcaccaccagttcggtcgcacccgcctgctgaacggcatccgcaatttcaaactgatgatcaccggaatcccatcccagacgcacttttaccgtaaccggtaattcttcaggtacagcgtcccgcatcgctttggcaccacggtagatgagttcaggatctttcaacaacgtagctcccccaccgctgccattcacagttttggaaggacagccgcagtttaaatcaacgccccatgaccccaattcaactgccctgacagcattttcggccagccattctgggtattgccccagaagctgtaccctgacgggtgttcctgatggtgtccggctctggtgctccagttcaggacacaaccggtaaaaagatttcaccggcagcagactgtccactacacgcaggaattccgtgatacagaggtcataatcgttgacctcactcagcagttccctgaccagagaatccagaacaccttccatcggggccagcaaaacgcgcatggattattttcctgatgcggctacatttgatgttttggatgaagtacgttgccgacgctgacccgatggggttcctttgctgcgcggacgatcactgtgttgtttggtactgccttggttagaacgactctggttggagcggttcggtttgctgctgccttggttagaagggctttgcctaccgttaccacgctgactgccacgggaattacttccattcagaattggctcagctttaatggaaggatcagggtcataacccgaaatcgcaatacgtggaatttcacgcttcagcagtcgttcaatatcgtgcaggagtttgtgctcatcgacacaaaccagagatattgcctgtcctgtcgcttccgcacggcctgtacgaccaatacgatgcacgtaatcttccgcaacattaggcaattcaaagttaacgacgtggggcagctgatcgatatccaatccacgggcagcaatatctgtcgccaccagcgcacgtatccggcctgacttgaaatcggccagcgcacgggttctggctccctggcttttattaccatgaatcgcggcagcagtgacaccatcttgactgagctgttccgccagacggtttgcgccatgtttggtacgggtaaagaccaatacctgctgccagttctggttgcctatcatataagagagcaattctcccttacgttttttatccacaaaatgaacagcttgatcaatttgttcagaagccgagttacgacgggcaacttctatgctcaccggatcacgcagcagtttattggcaaggctcttgatatcatcggaaaaagtcgccgaaaacagtaaattctggcgttttgcaggcaatttgctcaatacccgacgaatgtcatgaataaagcccatatccaacatgcggtcggcttcatccaaaataaggatttcaacatgggataagtccaccgcattctggtgttctaaatccaacagacgccccggagttgccacgagaatatcgacaccaccacgtaatttcatcatttgtggattaatgctgacaccaccaaatacaaccaatgaacgcaatctgagatatttactgtaattgcatacattttcacccacttgagccgccagctcacgggttggtgtcaaaatcagcgccctgaccggacgacgaccttttgcctgagccggagattcactcagtaattgcaaaattggcaaagtaaaccctgccgttttccccgttcccgtctgggcactagccaaaagatctttaccggacaacacaacaggtatggcttgctgctgaataggggtgggttccacgtaaccttgttcttcaacggcacgtaaaatatcagccttcaagccgagtgactcaaaattcataaataagaaatgctccagacttcaccattcctgaaacccgttcaggagcagttttatgggaagaaaacagacgcgataaatcgcaaagaaattacacaaactgcaatgcatcataaggcggcattataacagatatgtttttctaagcagcatagaagaaaagaataattgacttttatatgctaataaacgtgtctattggcagaaaaggtttgcaggaaatgacaaaaaataggcatattatttttttttggtagcgatttaacgtaaatttatgccagctttacatcaggttactttagttttaaagttaatcatatgattgatatattgatggcattttcgaaaattctttgtaacaggatacacataacatggcagctaaaacgactcaaacattgcgaggcgaacaggccaaacagcaacttattgaatcagcgatagaaattttcgggaagtccggtctggaaggtgcgaccacccgtaatattgcccagcacgcaaaacagaatatcgccgctatttcttattattttggctctaaagaagggctataccttgctgtcgcacaatttattgccgataagttaaaatcggaattttccccactcgttgaagcgattgaccgtttttttgtcgaaacttctcagccttatccacaagcgccgatactggcatttatccatgaaggaatgacgaggtataactgtctgattttcgaaacaagcagcatcaatctcagccgaatcatgtcacatgagcagttgacgcccacagcggcttacagcgttatccatgaacaagggcttgccccggtttattcccgtctgaataaactcattgccaattatatcggcgcggatgaacaccagatttcaacacagatccacacacatgccctgttgggggaaattctttctttccgtctggctcgagaagcgttactacgccaaacgggttgggacaatcttggcaccaaagaatacgaattaatcaatcaagtgttatctcaacacatcactttattgcttaacgggttacggcagaagtaacacactcaatgccatacaggctgaacattaaaaattgaataacgcataagggatggtatgaacagtaaaaagtttgctcttttcctattagcgatcatcattgttatcggagctattgtcggcattgattattatcaggaacaaaatgacaaggaattaatgctgtatggcaatgttgatgtcagaaccgtcaatcttggctttcgagttgcaggtaagctggcagccctacaagtagatgaaggcgatacaatcactgcgggtcaggcactcggccagctcgacaatacccccttcatcaatgccctgaatcaggcaaaagcaacccgtgacgccgccaaagcaaatcttgccaaaaccgaagccggttatcgtactgaagaaattgctcaagtacgtgccgagaccacgcaaaaagaatccgcattccgcttcgctgatagcttcctgaaacgtcaacaggggttatggcagcgtaaaatgatttccgacaacgatttggacaatgccaaaaccggccaacatcaggcgctggcggcctatcaagcggcaaaagataagttacgtcagtttgaggctggttatcgcaaagaagaaattgccgccgccaaagcgcaactggcgcaagcacaagctgccgtggcacaggcagagcttaattcacaagatacgcaactgacttcaccgtcagcgggtgtcattcttacccgagccatcgaacccggcacgatgctggcagccggaaacaccgtctttacactctcgctgaccaaacctgtctggatcagagcatatattgatgaacccaatctgaatcaagcgatagcagggcgtgaaatccaaatttataccgatgggcggaaaaatcagccctatcacggcaaaatcggctttgtttctccaacggctgaattcacgcccaaaaatgtcgaaacacccgacctaagaaccgatttggtctatcggctgcgcattattgtcaacgatcccgatgaagggctgaaacagggtatgcctgtcactctgcgttttactgattctaataagtaaggcgcgaatatgaccagttcggcttacacgatagtactgaacggcgtagagaaaacgtttccggggttggaagttcctgccgtatcgcacttgaatgcagaaattcaagggggatcggtcaccggtcttgtcgggccggacggtgccggaaaaaccacgctgattcggatgctggcagggctattgaagcccgataacggcaatattaaaattatggggcttgatcccatcaaagacagcgttaaagtacgttctgaactgggctatatgccgcagaagttcggtctgtatgaagatttaaccgtgctggaaaatctcaatttatacgcagagctgcggggtgtgcttcgcgaagagcgcaaggccacttttcaaaaactactgactttcacagagttaacccatttcacggggcggctggcgggaaaattgtccggcggtatgaaacagaaactggggcttgcctgtacgctattaggaagcccgaaagttttgctgcttgatgagccgggagtaggtgttgatcccattgcccgtcaggaattatggcagatggtgcacgaactcgcttccgacggaatgttgattctgtggagcacgtcttatttagatgaagcagagctgtgccgtgatgttttgctgctgaaccgtggtaaattgctctatcgcggccagccgcagaaattgacccagaatattgtcggacgatcttttctacttgatgtcaaacaaggttcccgccgtaaaatcctgcaacatgcgcttacgctgccacaagtgactgatggggtgattcagggaagatctgtgcgtctgatcttaaaagctggtgtagaccaaagcaatctactccagcaaatagggctgcctgatgccaagctatttgacgctgaacctcgcttcgaagatgcctttatcgatctactgggtggcggtccctcccatcgctctgcactggcagaaatcatgccgcagataccgcccaatccgacggaaaccgttatagaagcccgtagtctgaccaaaaaatttggtgattttgcagcaactgatcatgtggattttcaggtgaagcgcggagaaatttttggcttgctcgggcctaatggtgctggaaaatcgacgaccttcaagatgatgtgcgggctgatcatccccacttcgggcaatgcgctggttctggatatggatttaaaaaccagttcaggcaaagcgcgccagcgtctcggttatatggcacagaaattttccctctatggcaatctgaccgttgcacagaatcttaagttcttctccggtgtttacgggctgaaaggccgccatcagcgggagaaaatggctgatatggtcaatgcctttaatctcgaaccgatcttacatcaaaccaccgatagccttccgctcggctttaaacagcgccttgccctcgcctgcgctttgatgcacgaacccgatattctgtttttggatgagccaacatcgggcgtcgatccactgactcgccgcgagttttggctgcatatcaacggaatggtagataaaggtgttaccgtgatggtgactacccactttatggatgaagcagagtattgtgatcgtatcgggctggtatttcggggaaaattgatcgccgccgggacacctgatgagttgaaactgttggtcaccactcctgaacgccccaatccttcaatggaagaaacctttatcgatcttgtggtgaattatgataaggagcagcaatgagccatcctgaacgcattcgccctgaatatcagggagcacataaagctgtcagtttttcatggcgtcggttaaaagcattgtgcattaaggagagcaaacaaattatccgcgatcccagcagtgctttgattgcggtagttatcccgttgatgctgctgtttatctttggttatggtattaaccttgattccggcaaactgcgcctcggcattctgatggaacagcaaagtgaagatgcccgtgaactcgttcatgcatttacaggctcgccctatatcgatgctactgtcagcgacaatcgccaactcttgatcaataaaatgcagatgggtgggattcgcggcatcatcgtgataccggtaaattttgatgtccagctcgcccgcgttggtggtcatgcccccattcaagtaatcactgatggcagtgaacccaatactgcgaattttgttcaaggctatgcgaaaggtgtctggcaaatctggctacagcaacgcggacaaaatcgcgcggtttcaacgactccactcattgacatgcaaatccgttactggtttaaccctgcggccatcagccagcattttctcatccccggcgctatttcaattattatgacggtggtaggagcgatcctcacttctcttgtggtcgcccgcgaatgggaacggggaacaatggaagcactgttgtcaacccaagtcacccgaactgaattactgctcgccaaactattaccctatcaagtgctgggttctttcgtcatggtgctttgcatggtattcactgtgtttgtactgggcattccctatcgcggctcactctggctattggcactgatttccagcctctatctcgctaccgccttaggtatgggcttgctgatttctactgtgacacgcaatcaattcaatgcagcaatgattgccctgaatgccgcttttttgcctgccattatgttatccggctttgtttttgaaatagacagtatgcccgcgtttattcaggcaaccacttatgtcatccctgcccgctatttcgtcagcagcttacaaacgctatttctggcgggtaacatcggcactgtgctgatcacgaatttgcttctgctgattgccagcgccatcgtttttattggcctgaccgcatggaaaacccgtcggcatctggattaagaaggaaagagcatgttttacagcctgtatacgctagtcatgaaagagttacagtctctcctgaggaatccccaaacacgggccactctgattgtgccggttctctttcaaatgaccctgtttccctgggcggccacactggaggtcaagaatgccaccattgctatttataatgaggacaaggggcaggcttccattgaattaacccagcgtctggcaaaatcgaaagcatttcctgacattattttgttaaccagttcgcaggaaatccgcccgacgttagataaccgtaaggcactgctattggtgcgctttcctcaaaatttcagtgccaatattgccagccagacaccgacatcaattcaggtcttactggatggacgcaactcaaacagcgcacaaatttccgctaattatatccagcagattgtgatgaattatcagaaggaattattaggcaattcggccagtctcaacaatagcgatttaatcattcgtaattggtataacgccaatctggattataaatggtttgtggtgccatcactggttgccatgattacgacaattggcgttttgatcgtgaccgcactttccgttgcccgtgaaagggagcaaggaacactggatcaattgctggttgctccgttggcgacatggcagattttcctcggtaaagcgatccccgcattggttgttgcaaccactcaggcaagtattgttttacttattgggacactgttttaccaaatcccttttgccggctccctgctgctattttatggctgcactctggtttatgggctatcgcttgttggttttggcttacttatctccgctgtctgttcaacgcagcagcaggctttcatcggcgtgtttgtgtttatgatgccagctattctgctgtctgggtatatttcccccgtcgaaaatatgcccgtttggttacaggatattacgtgggttaatcctattcggcattttactgatatcactaagcaaatttatttgaaaggcgcggatttttcagtgatttggcacagcttatggccgttattagtcattaccgtgacaactggcgggatcgcctatcggttattccgtagtaaaattgcttgatgaattatgagaaattatgttctcccgaacttttggctgatttttcagtgaggtattccacaggagcagctcttgaccggaggtggaaaaagagggaaacataaccgatcatcattctgtttttacattctctttaaaaaataattaacagaaagataatgggaaataatatatcaacaattaatcagaaaaagatcttcttactttctttttaatataaaaaaacctgctaatgcaggtttttctcaaaatattcaatggtaattaacgacggtcaccgagaatacgtaacagcatcaggaacaggttgatgaagtccagatacagagtcaatgcgccagtaatagaatatctgcgcaggttctctttatcgttaacatccagctccgcacccatttctttcagtttctgagtgtcataagcagtcagacccgcgaagaccagaacaccaatataggtgattgcccacatcagtgccggacttttcagccagatgtttatcagagaagccagaacgataccaatcaaccccataaacaggaagctacctaagccactcagactgcgcttagtggtataaccatagacactcagtgcaccaaacatcgccgctgaaatgacaaaagtgctggcaattgaaccactcgtgtaaaccacaaaaatactggaaagcgtcagccctgtcagcatggaatacagcataaacaaccctgttgccagcgcaccgctcattttatgaaccaagccagacagcacaaataccagtgcaagctgggcgatgatcaggccataaaatacaatggagctgctaaaaattgcgtttaagatttcagggctatttgctacatatcctgcaacaaatgcagttaacagcagaccacaagtcatccagccgtagacttgtgccatataagtttgtacaccagagccagctttctggacaatcgaaccactagaacgttgatatcggtccatgacgattacctttttataccnaagttaaggggaaatggatttgctttaanaataaacaatctattcaaatgttatacattagcatagaacattaacanaaccaccccgccgattaatggcaatttcagtgacatattatttaactatccagttttagaggtaggccgcaaaattatcagccaaaagattttaccgttatttaccagcgcccagccgcttcctgatcactctctcgcgttgctacccagcgctctccttccaccagagactcttttttccagaatggtgctctggttttcagataatccataatgaattcagccgcagtaaaagccatgctacggtgagcgctggtgacaccaacgaacacaatttcctcacccggatacaattcaccgatgcgatgaatgacactgatccgttgcagcggccagcgctgacgggcttcgtcaatgataacctgcaacattttttccgtcatacccggataatgctccagtgtcagtgctttgacgctatctccaagattatagttgcgcactttgcccgtaaaggtaacaaccgcaccatcgtcatcgcactgcgagagccattggtattcgtcaccaacgttgaatctctccctttggacacacattcgtgtgttttccatgatcatccccccgtaactggcgggaaaaaagccacttcatcaccatcgtgcaaagggtgttcagcatgtacaaaggattggttcactgcggcaagcaatttaccctcttccaatgccagcgcccatcgttctcctttttcaatcaggaaatgacggagatccgcaaccgttagatattcatgaggcagttcgagtgaatcagcccctaccagttcacggacctgtgcaaaaaataggactttgatcatgatcccaccttaaagtttcctgatttgccgccgcttttttccagcagacgtaccggcccaatcaccatatctttttgcactgccttgcacatatcgtaaatcgtcaaagccgccacggacgcagcagtcaaggcttccatttccacgccggttttccccgtcaggcggcagcaggattcaattctgacacgattatgttcggcttgtgcttctagttgtacttcaactttactcagcagcagcggatggcacagtgggatcaattcccaagttctcttcgctgcctgaatccccgcaatacgggcagtcgcaaaaacatcgcctttatggtgatcaccagcaacaatcatggccagcgtttcagcctgcatttcaacaaaggcttccgcccgtgcttctcgcacggtttccgttttggcagaaatatccaccatatgggcttcacccgcagtattaatatgggtcagttgggacactctccgctcctgaaaaatgaattgagccgttaaattaaccgccaatgaaagaaagattaggggtaatgccactatccccctgatgtaaaaagtgagtctcacgcttatggcgcaagccaccctgaatgcgcaatttcagatcattaagtaacgtgtcatcggacaataaatcacgtaatggaatgccctgttcaccaaacaggcacaggtgaagattgccaatcgcagaaacccgcaggcggttgcagctttggcagaaatttttttcatacggcatgataaggccaatttcgccctgataatcaggatgactaaaaacctgcgccggcccgtcactacgggcgcgttgctgttgctgccagccctgttgcaacaaatggcaacggatcacttcaccggaaagatggcggcgacgaaacaattcactaccttcccccgtctccatcaattcaataaaacgcaattggatcggacgatgtttaatccacgcaaggaaagcgggcaggctagtatcattgacgtttttcatcaatacggcattgactttcactgcactgaaccctgcgtcaaaagccgcatcaatgccacgcataatctggaaaaatttatcctgtccggtaatggcgtgaaactggcggggatcaaggctatccacactgacgttgatcgccgtcagtcccgcctctttccagcgggcaacatcacgctccatccggtagccattggtcgtaatggcgatttttttgatctgtgggttttcatgcactgtcgcgatgatatcgcaaaaatcacgacgcatagtgggttctccgcctgtcaggcgaattttttccgtcccaagttcagcaaatgcacggctgacgcggcgaatttctggcagggacagaaacgattggtgtccatgaggatgatagccatcaggcaggcaatatgtgcagcgaaaattacacacatcggtaatcgataatctcaagtaataaaatttgcgggcaaatgcatctacgagttgttccacaataacaccttccaaatgcgggagatgcaggcatttctaccttgcaccctggtgactcaggagccacggccaaagcatcatctcaatgtggtatccgtatgatagaacaatgacttagacacagaggctaggagttaataccaattccaatcattatgtgaataattgtgtgagtaacgagattctcgttgctgattctaacgtttaagataataaaaagctaacaccaaccttcaatatatattttattatacaacgagttaatgaaacgttgtcacatcaacttctgaagataaatcactctgttatccatcaaaatattcggcaaaagatcggataaaatcacggcaatttctcaaagcatcatattttatgataaattacacccgatttattaaggccatataagtttagtgaatatcagtaacaggaaccctatgcgaaaccgcacattagatgatttagatcgtgtggtcgccctcggcggcggtcacggacttgggcgcgtcatgtcttccctttcatctctcggtgcccgtctgaccggtattgtcacaacgactgacaatgggggatcaaccggaagaatacggcgtgctgaaggtgggatcgcctggggtgatacccgcaattgtttgaatcaactgatcactgaaccgacggtcgcttccgccatgtttgaatatcgattcagtggtaatggcgaactggccggccataatctgggtaatttgatgttaaaggcgttggatcacctgagtgtccgcccccttgaggccattaacctgctccgtagcctgctgaaagtcaacgcacatcttatcccgatgtccgaacatgctgtcgatttaatggctgtcgatgatcaaggcaatagggtgtatggggaggtcaatgttgatcaactcagttgtgtaccacaggaattaatgctctatccccatgtcagcaccaccaaggaagcgttggaagccatcgaacgggcagacttgattttgatcggacccggtagtttttttaccagtctgatgccgttgttgttgctggaagatttaactcaatctctgcgccgtagcaatgccagtatgatttatattggcaacttggggaaagaactcagcaatgctgccgcagggctgtcattgagcgataaacttgagatgatggaaagtaagattggccgcaagatgattgatgcgattattgttggcccctgtactgatatcagttccttaagtgaccggattgtgactcaacaaattttggaagctcaggatattccctatcgccatgatcgtgaattattacgacaggctatcgaaaataccctgcaaaaattgggctgactattttgcaagtggagagtttgcaagtggagagtgatgctattcactctccgcctttcattttatttctatttacgagttagcaataaactgcacccgtaatgcctgtacctgatcacgaatattcgccgcctgttcaaattccagatcccgcgcatactggtacattttttcttccaattcccgaattttgttttccagctcttttgccgacaatttacggtaatcgtcagtgtcgggagaaattttacctctccctttggcttttcctttgccactcactggttgaccaattttcaggagatcaccgatttttttattcagccctttcggtacgataccgtgctcctcgttaaatgcctgctgtttggcacgacggcgctcggtttcaccaatggctttcgccatagagtcggtgattctgtcaccgtacaaaatcgctttaccgtgcaagttacgcgccgctcgaccaatagtctggataagggaacgctctgagcgcagaaaaccttctttatcggcatccagaattgccaccagagaaacctccggcatatccaagccttcgcgcagtaagttaatgcccaccagcacatcaaactcgcccagacgaagatcacggataatttccacccgttcaacggtatcgatatcagaatggagataacgcactcgttcaccgtgctcttccaaatattcggtcaaatcttctgccatccgttttgtcagcgtcgtcaccagtacccgctcgtttttctcggcacggatacgaatttcagatagcagatcatcaacttgtgtggcgacaggacgaacttcaatttcaggatcaataagacccgtcgggcgcaccacctgctcaaccagttcgttacctgatttttccaattcataacggccgggggttgcggaaacataaatcgtctggggtgccagtgcttcaaactcctcaaaccgcaatgggcggttatccaatgctgatggcaggcgaaaaccataatccaccagcgtttcctttcgggaacgatcgccacgatacataccgccaatctgcgggatagtgacgtgagattcatctaccaccagtaaaccatccgcagcaaggtaatcaaacaacgttggcggcggctcgccttcggcacggccagagagataacgggagtagttttcaatgccagagcagtaacccagttcgttcatcatttcaagatcgaattgagttctctgggtgatgcgctgctcttccagcagcttatccgacgccagaagcattttgcgtcgctgctccaattcaactttaatgtcttccatcgcctgagtaatacgctcacgcggtgtgacatagtgcgtcttgggatagacggtataacgcggcacgttgtactggatctgaccggtcagtggatcaaacagggaaagccgctccacttcatcatcaaacagttcaacacgcagcgcatgttcattagattctgcggggaagatatcaatcacttctccacgcacccggaatgtcccgcgctggaatgcctgatcattgcgggtatattgcagttctgccagacgatgcaagatggcgcgctgatcaatgagcataccatcggtcagatgaagcatcattttcaggtagctatcggggtcacccagaccataaatcgcagaaaccgaggcaaccactaccacatcccgacgttcgagcagggctttcgttgccgacaaacgcatttgttcgatatgctcgttcacagaagcgtctttttcgataaaggtatctgagctgggtacataagcttctggttggtagtagtcataataggaaacaaagtattccaccgagttttcagggaagaattctttcatttcgctataaagctgagccgccagcgttttattgggagcaaggatcatcgttggccgattcagatttgcaataacattagctatcgtgaaagttttgcctgatcccgtcacccctaaaagcgtctgatgggccagaccatcttccagcccttcctgtaatttccggatagcgtctggctgatcccctcccggctcgaaatcagaatgtaacttgaatactttatttgtcataaataaatcaaccaattaattgtttatcaatacattatgaaacgataagtgccggtgagtattgagggtttaagttctccgccgccattttgccgccattttgtaactgcgataatgggttgtatatcaaggcatcattcaggtggtcaggtgcaaaatgggcatatctcattgtcatcttgatatcggtatgtcccagtattctctgtaagacaatgatattacctccgctcatcataaaatgtgatgcgaatgtgtgacgcatcacgtgggacgattggtgagatggtaactctataccagcttgcttaaccgctgtacgaaaagcattgtagcaagagctaaataacttcccttttctcttcggtatctcatcatacagctctttagttatcggaactgtgcgattgcgtttacctttggttttagtgaacgttatcttataaggcgtgatttgtgaatcagttaatcccgccgcttcagaccatctggctcctgttgataaagctattttgacaataataagcaaatcttttgctcggcttttagcacagaaatttagcagagtaataatttgttgatttgataaaaaagccatttccttctcaccagtgttgaacgctctgatgttttttaatggattccctgctttccattctccaagcctatgcaactcattaaacatagcacggaaatatgccaattcattattaacggtactaggcgcaacgggttttaatttgtccgcatatccatttaatcttttttctcgataaatggaaaacagcttattatcaaactcggttacaaaaggatgatccatttctttacaagcaaagaacattctttttttacggtgttcgccatcgcttagggttatgccatgcgcccgataccaaatgtcaatcaactcagaaagaagacgtttatcttgcttctctccaagccagggtttttctacagtttcatctaatatatggcgttcgcaggcaattgcttcacctttggtcgtgaactgtttacggattctgcgcccattcctgccattaggataaagctcaactagccatttcccatttggttgtttatttattgccattattttctataccaaatataacgcttaaccattcgtcaaatttgtgttttttatgtccttcactatttaacatagtgtcaattttacttttctgaaagatatgtcttttacccgtattagagtcaagaccagatatccattgatggccgtattcattctcaaggtattgatctataagaacgtcatacttttctcttactcttaattcatttttaaagtatgtataggtgaatgaagttctgattgggagagtttctttgataattttagcggttgcggctatgtcacggataatatttgcatattcaaacacgtcgctattgtttagctttaagatttctctacaaagttcaacgaattcatatcgtgatgatctgactaagaatttagtttcaacatattgttcattgataatgtggtttataccatcgccatcaattatggataagtaaaaatctccttttttatggaggaatatcctatttaactcaccagtaattctctgttttttttcattatcgtttaaaaatgaaaaactgatgttattaatattacctgtccaaatggttgcttcgtcattaaccattgtgtatgtgtgttttttaagttcttttgaatcagtgctggaagcaggagtatactcagttgaactattattagttgattcttctgcgtttaacttattattttctttcttaaattcggcagagattctatctgttatagaagagttcctatctgttactagactatggctactttcaggtttattttttttacgatgcagtagaatccaacgataggataaatagcataaaagtaaaccagaaataaatagcataaccttgacagtgtttctcttttcaggttcggtatcgaaatggaaacctaatccagaaataaaaaataatatcaagaaagtaagtaaaataacttttattgttgtaattataattttcactttaataatccttaatttccttaataacacgaccaagcacagttaaatctgataaatcacaatcgaaagggatgccagctccagttactctaactcttttgatagggattctagttagttctcttatgcttatttttccttcaatgtcgacaagccatttaccgtcaaacacatcagcgaatttgcggtcaataacgtagtaatctttatcttcttggattgatacagggtcagaaggtaaaagagcaccgttcgtaagcattactttatcaaacatgatatgacctgattgttttaaattgccatcaaccagtcgatgattaggtagtttcaatatatcaactttttcatgatcaaacgggtgacctgttccaaaagctagccactcaagattagcccctgtctcatgcatacagcggataaccatatccgcaggaaagatagaacgtttatagcgccctgataggctacttgcagccatattaaaatgctcagctagcataatttttgaagaaaatccgtatgcttcaattatacgatccaatacctcagcattgttttcgcatgacacaaagtcatatgtacccattatcccgcctatctgaatttgttttggacaaaaaaatatagaaattccgttgacacttcgcctaagacgaattatctttcgtatcaagatttgcgtcttaaacgaatgttaccgaataacaccgaatattaacttaacaggagattttgccttatgcgtcccatcatttcaatcaatgtcactgaaccctatctccctcttgaggagttttgccgccgtactgcgatgcctaagaacactgttcgcgacatggtcaatgacggccgcttacctgtccgtgaaaaatcagttgataaaaaacgtggcaaagttcttatcaatatgatggcgctaacagttgaagcattaaatgcgagtaacgttgctgctatttcatttaacacgcaatatgagtaaagcatttcgcttttggagaaaaaaagcaatgtttgattatcgggtttccaaacaatcgtactttgataatgcgtgtcgtgcgttctccaatgcccactcaggcgatttagttcagatcgcggaatctatcggcatgactccgcaaattctgcgcaataagctgaaccctgagcagcctcacatgctgacttgtgttgacttaatgaagttaactgatgcaacagaagacgcttccattttggacggtctgctggagcaattacagtgtcagccatcagtgccggttaatgaagtttgtgatgccaacatgccaagttacctgttaggagctacggcagaagtgggcaagctggcaagtgaagctgtttcgggtgagcatcttaatcagacgcgtgttgcggagtttaagaagacggttaataacgcagtaaggttattgacgttggcgggtgtcactatgtcatcaagattatattctaaccctgcgtttaatacgacggttgatgttgtggcagggatgggagcaacgttagtctgaggttagtatgaacgcattaaagcaacagcaataccaatataaattgactggtgagtcattcaaagccaataaaggagatggatttatcttcccaatcgttttgtgtgctttcgcttattttattttgtttcttattcggtgaggtttaaatgaacacggagtaccaatttgaatcaactgaacagcgagcttttccaatgtcctttgaaatgcgcgctaatggtttaaatcaactcgctcaaatcagagcgcagcatttaaaatctggtaatgagcagttggctacctttattgatgaaatgcgtgataaacgcaatgaacactatgctgataacatccgaatgttaggcgctatgttctatcttgcccatatacctaaagagcggcataaattgaaattaaatcaatttaccagtgaagaaagaattaatttaattaaggcagtgaatttaattaaggcagcgagtgcagtattgccagaaggtttatcactacccaactaaataataataaataccgatttaattttaatggcgtcaacacgtcagggattctttttatctaaaaataggaaattaacaaatggaaaataaaaatttaataattggctatgaccctgctcaagggcgcgatgtttctgtctgtgtaagcattgaacaattaattaaagatgtacgtatggaagagcgcaaacattgtgctgatttatattcggctcgtttagttaaattgtctgcccgcgttttgaaaaacaagatggttcattctgacagtgccgcacttctgcaaagtgaatcggagaacatcgaccgccaagctcaagagtggaactatgtttgatgttataggatgtacttattagtaatttttgaacttaaaaataaatattatcggagtgtatagaatggatctatttgaaatttctactgatgaacgttcgtttactcggcttttaaatcatggcaatgagtatatttcagtgcttgatgatacccttaattttactgttggtactgtgttaattataagagaagaaattttgaaaggttatgagcctcctaaattcacgggaagaaaactaacagccaaaattgttagtgttattcgttcgtttggatgtgtacaaaatatgtatccatcacctccttttgtctatgtctacgaattaaatgttttgccaatgtcatttttctaccaaacggagtatagcgatgacaaataaatctatctctgagttggaaaagaaaagaacgcatagcctaatcatcagtggagttcattttaatttcatggctgtagttgacggcgatagaaaaacagcgtttgtcaaagacgatagagattataaaagcggtgattttctggcattgaatgaaattgataatgacgggaatttcacgggcagtttaatggcagcaagaataacagatgtggcggcaattgataaaaacctgtatccgcagatagcgggggaatttgtttttctttcgtttgaattggtttccgttaattacctatagcatgaatattgcagtcaaggaagaacacaacagcgacgcattactttcaatgtgtcgccaacagtttcagccagagatgccacaaatagcaactctggctgaacgcgttatgtgggaagtgaaccccgcagattacacatggtgtcaccaatactttggacacctgccggattcgttggcggtttacttcgtcaatcgttatgccaacatcttcaaacagtcaggtcgcgacggtcgtcgccgtgctaataaatttttgcgccagttcagcaagaatgtattaccacggttcaatctggtcagtgaacaataccagtttcaaagtttggccgtaggtgctgaacctttccctttcattgaacaacttgaccgtcttccaacattaggacgtaaagagatcaggttactggcgcacggtgtagcgcggtatatgaccgacagttacgaacactttgttaatcattcagcaaccccagacaatgagcaggaagcccgccaaaggttaatttatatctatacccagttggcaaaattaactcagcaaattgggacagccgcaccctattcacaacagtttacaaaaggccgggtttcacccaccgaagatcagctatgcgccagtttgctgcgcatgatgtcggatcaatggtggtatgcccgcttaaagcgtctgcgtgatattcgcgctgaacatatggcaatggcagtcggtcaggtacaaaaggccgcttcatcctatgtttcacgccagaccttacacgaatggacagagcagaagcgccggaactgggaatacctgcaagagtttgaattagaaaatgaagaaggtgagcgggtttcactaagcgataaggtcttgggcagcattgcaaatccggccgtccgccgttgtgaattgatgatccgtatgcgtggatttgaggacttagccaatgaaatgggctgtgtcggtgatttctataccatcactgcaccttctaaatatcattcggcacacagtggcggcggttttgttaagaactggaacggggcaagcccacgggatacacaaaaatatttgtgtggtgtctgggcaaaaatccgggcggcgtattcccgtgcggggattagcgtcttcggtttccgtgttgttgagccacatcatgacggcacaccgcactggcatctgttgttatttatgcagcctgagcatgtcgaagacatgcgggaaattgtgcggcaatatgcgactcaggaagatgcccatgagttaaacagtgaagccgcccgcaatgcccgctttttggtgaagccgatagatccagaaaagggcagtgcaacaggctacattgccaaatatatctcaaagaacattgatggctacgcgctggatggtgaagtggacaacgaaacagggggaaatctcaaggatatgtctcgttctgtttctgcttgggcgagccgctggcgcattcgtcagttccagcagattggtggtgctccggtttctgtctggcgtgaactgcgccgtttaaggggtgacaaacagattttgcctgatgaggatatggataacgtccgctttgcggcggatgtgggcaactggtcagcatataccgagtttcagggcggggcattggtttcacggaaaaatttaaccgtgcgcctgtcttatgaagtcaccgaacagggcagcatctacggtgaggatgtacaacgcatttcaggtatttactcgccccgtttgggtgagtcctcatcttttattacccgtactgtgaaatggaagattgtacctaaatccagcgctgcacctgcgggtgatggttttggggtttcttctaattctggcggctctgccgcctcttggagttctgtcaataactgtacggaggcacgaagtacggtcagcaacggtagtgatctttgtttagatgagtttcatcagaattggtctcagatgagcgagaaagaaaagatccagagggtttatgaatcagccaaattgaatgatatagagatgagtgatggtctggcgctgggattactgaggggcaatagcatgacggtagagggtcaatattatcggttatcgatgtttggtcatttatgtcccgccaaaccgccgcatactgaaagggcaaaaataatactgaaaaggttaaatgaaacgggacgtgtcaagattaatattaatgcaattatccgtgatcctaaagggtattatcttaatgctttggagtaaaggtctgaaaatattgattaagtcacataataaactatttctaaactaaattactttctttattaattgtattattttatgctgtttatgcatacagtgtaatgaatggtaggaatatgatgtctgattctttgaataaatttgttcttttagaacgtattgaattaatttctaaaattggcggtggggatagctttaacgataaagataggcaagtggcgttatattgggttggggaactggcggagcaagttaaacaaatgataatagaaaagccactaaagagtggctcaacggaattatgcggcgctagtctgcaataaatctaacgccatttggcgctgttgcggattgaggttattaatcacagtctgcaacagaatattgcccgttttggcactggggcttatggtgtgggaaaacgtcagattcatgacgaaagtatggccgcattccacatcaaaacacgaacagtacacatcggcaatttcacgatgcatccggttggttttgcgaatgatagctttagcgccacactcaggacagattatttttaatacgcgcatgttcctcattcccaatgtatcgattttcctcgattttaccatttttttgctcattctgcatccgaacttacgttatcttgttgaaaacgtaggtgtaatatttcggggagttcacggctgttgatggcactcatgaacatattttgaacggggatcacttcatccttgcggtaggcatcacgggctttttccggatcacccagaccgccgacattggtcggaataatacccgccagtcctgccgggaatcggtgcgcggtcagcacgtcttgcgaactgatgcttttcacattggcaaattcatcattggcagagatatccccgaccggaataaatttaatgccgtcagggtcgccattgggaatgctcacaaacagggtttcaaagttgccaatccccttactttgtgccagcttgcgttctatctcttcttcggcttcatctgagatattcgggtcattaatgtaaatcatgccgcccgtatgcccgccattgtgataatagcggcggcggaagatagtggcttccgagttgagcaaggcggcatgaataccgccgatataatccggcaggccgtaaacttgctgctggggatcatattgcttgatgaaaatgacctcttccggtgaatagaccaacggctcaccctcctgcaataccacaaaatccccgtctttgcggcggcgcaggtagagcgagggtaacacgtccagtctgaccagatcgccccagaaattacggactttcaggatggccacatcaccgaaaatcaggaaattgatcatggccgccttaaattgctcatgtgtcagcccgccgccgaggtaatccgaggaaatcatattgtggcgggaatagataatgccgccgtgcgttccgttcatgttggtcagttgtgccagtgctaaacggtcaatcggcagggtgtaatgatcatagtcgttgtcataccagattttttggtaatccgtcatggtcgtgagtatcggctccggtttacccagcgtgatcaggctcattttccgttgacggtgatttgtctgtgctttggcggtcttccttaacgttttcttactcatcatgctgcctttgcaaatttatatttagaggtgcgtttcttctcgtaatttaacggctcattcatcagggcatgggagactgcccagaacacgtcggcgtgtccggtttcctgcgaacggtcagcgacaaaggtcattgcgccgcctttggccgtggtggtgtgccggatagacagaaacgaggccaggagttctttttgttcctgatcccattccagccgttcttcactgaccacatcgatcatcttcatgaccaactggtttttgctctgctggctgtagtgaatggcctgcgtttgccgtggggcgaaatcctgaaccatctcataaaccccgtgaccaatccccgtggtatcaatgccgatatgggtaaagcgataacgtttgaacagttcttcaatcagttttgcctgatgcttccagttcatgccctgccagtagaacgtcgccagtacccgaaaggcttcgtttgccatcatcggtggggcgacaatcacaaaagtggacgtatcaccggagcgggcaggatcgaagccgccccagacttcacgttcaccaaacgggcgtgaagcgttgggggcgtgatcttcccacaggttgatatcgacaccgcatttatcaacctgactgtaggtgaagacagaggcaccgctgtcaacaaacacgcacataaacagcatgttaaatgagtccgggttatacttgttgcgcagtcggtcgatgctggcgaggttaaagccgcccttaatagcatcttccaaggtaatgacatagcgccactgaccatcgggacaatcgcgcccgccgtcccgcagttcatcaaaggcagggaaagccacgttcttacgcttgggatcattgccgcgccattcgtcacctgtccaaagagagtaggcgggatgggttttcgcgctgggcgttgaaaaataagtcgtgcgccaatgatcatgggtggccattgccgaagccacttcgttgaaccgcttaaaatccggtatccagaagtattcatcgcaatataagtgcccgctgtaagattgggcggtgttcttgttggtcgaaagaaagcgtagttctgcgccattgctcaggcgaatgtgttcaccggataaggtgatcccgaaaagttgttcagcaaagttaacgatataggagcggaaaacttgcgcctgtggtttggaagccgacaagaacacttggggcttccctgttaagactgcatcttcaaaggcttcaaacgcaaagtaccaagttgccccgatttggcgcgattttaagatattgcgtacttgctggtgcttgttgtcacgcaaatgtttctggtatccaaacaaattactatcaataaaggtctggaaatcttccgccgtcagtgccgaaatatcatttttgcgatagcgtttctttttcttcggctcaccgtcacccgatggcgcataatcactatcgttgtctgattgcgcccgcgctttaatgtcggccagcttttccttgtgcttattttcctgcgccatcaatttcacatgatggataatcaggcggtcgagttcgtccagctccagcgcggttttattattacgttcactcagtaacgccgcgcggcggttaatcgcttcaatcacactttcatggctgagcatatccgcccaattccacttttctgcccagtagtaaacgatccgccgattgggcagatttaactcttcggcaatttcagccggagtcgagcggcgcaggtaaagcgactttgccactttgattaactcatccgagtatttagccatatccttaagcatccttgtcctttcatgccctcattatgcagggctaattttctccttacgtccggccaacttcggttgaattcggttatgtgtcatatccgaattcaaccacattgaacccctcgccgccgccgattgaatccgcaatactgtgttggaagcaaacgaaaggaatgcgatatgtctcagttaatgacgaactggatatgtattgccatggaaggcgacaccgtcgatggccgggtgatggagccgcaatggattctggatgcggcagaactttatgaccctcaattgtataccgccctgatttggccggagcatgaacgctggacaggaacgatgggcgaagtgctcgcggttaaggccgaacgcggggaggacggggctttgcgtctttatgcgcaattgcgacccaatcaccgtttgttggacgccaaccgggacggtcaactgttgtttacctcggtagaatttacgatagacggtaactggcgcgggacaggcaaatcatatctggaagggctggctgtcaccagttcgccagccagtgtaggcacgacacgcttacagtttagtaaaaagaaaaaatctcatcggtcaggcacgtattcgccgctggtgattgacgaagtcagggaatttaaacaaaagggaacaaaaatggctaaaagcactaaaaagacatggcgtagtcgcttcggtattgaagagccggaagaaacctcagccgaaaacacgggtgacgatgcgttgcaggctatcgctgaagcattggcagaaatggataagcgaatggctgccgtcgaaagcaagctgaaatccactgagcaggaagtggaagaagtacagggcgatatcgaaaccgtcaaagaggtggttgatactgaagagtttgcccgattgcgtgacagtctgccggatattctgaaaaagtttggcaaactggatgggattgcgacccacttgccgtctaaaaatccaaaaggcaacaagaacaagagttttaattatctgtgatcccctaatgggaaaaggcaaagggaagagctatgcaattaaatcaacgggcacacgcatttttgcagaattactctgtgggattggcaaaagcctatggggttacggatacctcacgttacttcgcgctgagtgacccgaaagaaaccgccttgcgcgccgccctgctggaatccgtcgaattcctcaacatgatcacttgtgcggatgtggatcatctgtccggtcaggtggtgtctgtgggcaatccgggactctttacgggacgcaagaaagatggccgctttatgcgtgcgacgggcattgatggcaatgaatataaattggtggaaaccgattccggcgcagcgctgaaatgggacttgctgtccatctgggcgaactccggcagtgaagaagaattcttcctgcgtatgcaggcctttaccaatgagtcatttgcactggatatgctgcgcgtgggctttaacggccagcgtatcgccgagacaaccaacccggacgagaacccgaatggggaagatgtcaacaaaggctggcatcagattgccaaggaatggaacggcggcaaacaggtgattaccacgcctgtcacactggatcaacatggtgaccataagtcattggattcgatggcttccgacctgattaacacctgtattccgcagcaatttattcatgatccgcgtttggtggtgctggtcggggcggatttggtggcagcggagcagtaccggctttaccagtcagccgacaggccaacggaaaaaattgccgcgcagatgttgggcagctctattgctggccgtccggcgatggtgccgccgtttatgccgggcaaacgtatggtcgtcaccatgttgcctaacctgcaaattctgacgcagcgcaatacccgtcagcgcaaggcggaatttgtggacgaccgcaagcagttcgaaaacaagtacctgcgtaatgagggctatgcgctggaaacgccggagttgtacgcggcctatgatgagagcgccgtgacgattggcaaagtggccgaacctgctgaaaaaacgggtacagactaatgttgtcacctgctcaacgacaccgggcagcggttgaacttcgccagaaactggcacggcaacaagccgtcgccattgccgatggcgcgagtatgcatctgcaagcccgtgcccttgagcaggacgtgaagcggttgcgtcagttggcgttgaccgcagaacgggtcgagatgaaaaagcgggaattgctgcccaattatcagcctacagcagagcgctatttagctgagggcgaggtgtaccgcaacccgatttttgcccattgcatcatctggttatttgatatcggggattttgataagggactggactgggcggatatcgccattgagcaaggacagctcaccccggactattttaaaagtggctttccggcgtttgtggccgatacagttttactctggtcacaggcggaagccgaagcgggaaaccccgtggaaccctatttttcaaggacatttcagaatgtcactgaaaaatggaaggtacacgagaaaatcaaggctaagtactacaaatttgccgccctgaacctgctgaaaggggataaccccgacattaaggtgagttcggttgacagtctgggcgtgctggagcaggccgatagttggctggcgaaagcccacaagtgcaaccagaaatccggggtaaaaacttatcggcaacggattgccgcccgcttgcgggcactgacaaccgaaccataacgactaccgcaagccggagcgggcgcggtggaggcataacagcaatgttaatggccgtggaaaccggacagcccgctttttattcagggagaaaggcacgatgtttaatggcaacaccgtcgattatcgggatgcaccgctgaccaatgacggcttttggccggacttgaacctgaaagagtttcaggtcaatcgcaagctgcccgctgatttggacaatgacatgctcgctaatgcgttgctggcaacggtggctgagatcaatctggacttgcagcgcctgaaatcgcgcttgcaggccaaaggctacccatgtgcggctgatgtgctgggcatttccatcaatggcaataacgcactggtcagccagtataaaaaagcggtctatgcgcgggcaaaggccgatttactgggggagtacacgacactggtcagccgtgcccccaatccgggacaggaaagccccgaagcgcgcaacagattgctggctgaagcctcggtcgtactgcgcaacatgaaaggcttaaaacgcgcaacggtacgactgatatgagcaaattacagcagttaaccgcctttctgcgggaaaacctgccggaacgcctttgcgagacggaatttaccagcgaaatggatgaaattcgctttattccggcacaacgggatttaggtctggggcaataccagatgtttgtccagcaatatgaggtggtgattgcgtgggggcgttttccttatcgggagtgtgatccgcgcaatatccccctgctgatagatatctggctgactgagcaaggtgaaagtttgggtgatgccaatgtcgagcaggaacggccatcattaacggttgaagtggatggcgacacggcggttgtggtggtgtcgctgtcactggccgagccagtggtgatccgggaagacccgaaaggcatgatcccgtttgatggcaagcgctggtcactggctgaacccgaagtgtggttcgctgaacaaggcgcggtgcacagtgttgacgagacaggtgcccagattgggcaagtacggtcatgatcaacggtcagttgaaccgcaaccagcttaaggcactgcaagatgaattgagccgccttgagttaccgccgaaaaagcggcagcgtctgttatggcgcattgcaaaatatggtgtgattcaggcggcaaaacgtaatgtacgtaatcagcaatcgcccgatggcagtagctggcctgtccgcaaaagtccgtggcgcaagaagatgctcaggaacatgccgaagctcttgcatattcgggaaatgccggaaaataacgccgtgcgcatttacctgcaaggcgggcattaccggaatgggagtcagccagtgccagcgggtgtcgtcgggtatgcacagcagcacgggatgcgttttcaggtcagtcggcggcaggtgcaaaagaacgttgaccgtgaacgtatggcaacgatcaaacaggcaaaaaagctgcgtgagttaggctatcaggtcaggaagggaaagcgctggcgaaagccgccaataaaggaaatcaccgccaatatgaagtttattcaggccggatcattgatccgagaactgagcggtaaagtggcgaaaagcgcatggacggtggatgttccatcccgtgagtttttaggcatgaatgatgaggaattcagtcaggcgttggctcgccagttacaaagcattggatacggcgcgccttaacgcatcaataaaggacataaataatgtggccacatgttcaggttaatcaggttaaccaactgcaaggcgaaaccaaggtgattgaacgggtattgctgttcgtgggggcgggaaaaacccatgtgggcaaaactcttgccgtgaatacccagacggattttgatgccgtgttgggaacggcgcaaaccgccctcaaacgtcaggtactggcggcgatggctaacgcaggccaaaactggtctgggtatgttcatgtgttgcccgaatcggcggatgaactggcgttcgtggaggccgtcattgcggcgcaaactatcgcgagcgttgaaggttatgtactgactgtcggtgccaccaaagccattatcaaggcggcgcagacgctgcgggcaaacacgattgcccagtttggccgctggcagtgggcgattttggcggttgatggcacacaatctaaggagccgtgggcagattacgtcactcgcttggcggagttacaaaagggtgaagccgtgccttcggtgcaactggtgccgtgtctgtgggggcatgaggctggcgtactggccgggcgtttgtgcaatcgtgccgtgacggtggcagacagccccgcccgtgtccagaccggggcattgatggatttgggcgcaacggatttcccgaaggatggtgcagggcaaacgcttgatttagcgaccttgcaggcactggaaaaactgcgtttcagtgtgccgatgtggtatcccgattatgacggcctgtactggtcagacggccgcaccttggacgtggaaggcggcgactaccagagcatcgaaaatttgcggattgtcgataaagtcgcccggcgtgtgcgtttgcaggccatcgccaaaattgccgatcgcagcctgaacagtacaccgggcagtattgccacgcatcaggcgtatttcgcccgcaccttgcgtgagatgtcgcgcagtaccgagattaacggcgtgacctttccgggcgaagtgaaatcgccgctcgacggcgatgtcgctattacatggcgcaataaaaacacggtggaaatttatatcactgtccgtacttacgaatgtccgaaagggatctcggtcagtttgttgctggatagcagtctggagaaaaccgcatgagtaaaaggatttcaggccagtcggtcgatttcaatatggacggggatcttgtccatgctgaaaaggtcaatctgtccattacggataataccgccgccgcccagacgcagggcgtaccggatgggtatatctccggtgatgtggcggcagaaggggagattgaactcagtaccaagtatctggatatcgtgacggccaaagcccgttcagcgggttcgtggcgggggatttcgcccgtcgatttgatgtggtatgccaaggcaggcaacgaagaaatgaaggtcgaagcctacggctgcaagctgatcgtcagcgacattctggatgttgatccgaaaggcggtagcgtcatgacccataaagtgaaatttgtggtgaccagccccgactttgtacgcatcaatggtattccctatctggaagcagaactgacacaaagcctgattgggtaaggaagggcgttcatggaagaacatgaaaaaacctttgtcacgctggtgctattgggggcactgattgcgttaggcaaaatgctgacaggccatgaaccgatcaccttacggctgtttgttggccgtatcattctggggtcggcggtgtcggtcatggcgggggcgttgctgatttggtggccgggtatcagcccggtggccgtgaccgggattggcagcgcaatggggattgccggataccagttaattgaggtctggttacgcaagcgcggcagcgcttggttaacagggaagttaaagaaatgacactgagtgaaaaacaacaattattttctgtcctgattgcccaactgattttatgggcagatgagcatggatatcgggtcacgttcggggaagcctaccgcacaccggagcaggccgcactgaacgcgaaaaaagggatgggtatccgcaatagcctgcatagccaacgtttggcggtagacctcaatttatttattcagggcacgtatcagacaagcagtacagcgtacttgccgttgggcgaatattgggaatctctcggcggcacatggggcgggcgtttctcccgtcctgatggtaatcatttctcactggcgcataacggggtgaaatgatgcccaaggcacggatgctctattttttcgttgtggcactggcgttcggtgcaggttggcgcgttaatcactattaccgtgacagtctggaattgaagatcacccggacggcggcggaaaccggggcaaaaatccggcaggaactgcacgccatttccagcgcctccgcccgacaattggaagaaaaactggaagggatcgcccatgccgccccaagagaaattcgtactgaagtggttaagcctgtttttactgctgtgtgcgttagccctgagtttgtcaggatgtacaacgagaccgccgacagtattgagcgaacattatcaggaaaacttactgacaaaatgtcagggcacattaccgaaactgaccggaacgaccggaaataatctggccaatgtattaattgattattctgccttatatggacattgtgccgcccggcataatcaattggtggatgaaataaataaacgaaaggaaataacccatgagcaaagaaaataaaatgattacgttaattatcggtgaaacagaaattaactttgagccgaatatggtcgcctataacagcatgattaatgatatggcaatggataataagattgtgcccattgtttcttatttacgccgtattgtacagcctgcgtctaaagcagcactggatgaactcttgcttatccccggcgcagccatgcagattgtggaaaaggttaattcggaatatgcgcccaaattggatattgaaataaaaaactaaatgcacgggttaaggcgattgagaatagtctgtttgaacacgccttaatattacgccgtcattatttaccgaatgaaaaagataatacggaaagtttagcccgtgctatttggctggataatcgttattgggaaaatacgcgcattgcaaccgccaatggtattgccttggccttaaagggtgaatgatgggacagttagattttacattgagtttaatcgacaaactgacacaaccgctggcgggggcaaaagcggcagtctctggttttgcccagtcttcacaggatgcctttggcaaactggcggttggcggcgcaggattggccgcctcgttctggtcaatcaagggctttcttgatccggcgattgagatggatgacgccctgaaatccgcctcattacagggcattgatagcggtgtcatggcgaaagtcgctaaagacgccatgacctttagctcacagtatggcaaatcgtcggttgagtttgtgcagtcggcatcggaaatcagcaaggcggttaatgggctgtcacaaagcgacttgccccagatgacccagattgctaacaccaccgccgccgctctgaaatccagcgcaaccgatacggccagttatatggggaaaatgtttgcgcagttttccagccatgccaaagaggtggggcatctccagtttgccgaggagctggcagataaagccgtggtgatgtcgaagaccttcggcacgtccatgacagaaattgccgacctgatggaaggtgcccgcgccgccgggacaaactttggcgtagggatagatgaacagttggctgtgctgggcgagttacaacgctcactgggcacggaatccagcggggcgtatgagtcatttttaacgggcgcggtcagcggggctaagacgctgggcttaagttttgtgaatgcgtccggtcagatgttgtccatgccggacatgctggaaaagttacaggctaaatacggcaagagcattgaaggcaaccttaaggcgcaggctgaaattgaagcggcctttggggattcggccgtggtggtcaaacagctttacggtaatgtcgatgtgctgcgcaagaacatgacttcattgggcgcgaatgatggcatgaagcggactcgcgacatggccgcacagatggccaacccgtgggaacggctgcaagctatttggcagaatattcggattgcggttggctcaaccttgttgccggtgatctcttcactggtcaatcggctcgccaatgccagtcaattattggtgcgttggttgaaactgtttcccaatatcgcccgttgggtcggctatatcacggtgggtattctgagttttgctgccgcaggggcggcggccaatatcatcatgggcgtgtctaaatttatctggctgggtcttaaggggatttgggtcgcctgtacgctgatcatgaaactgtggacggcagcagtatggatttgtaatggtgccattattgtctggaataccacattacgcgtgttacgcggggtcttactggcggtcaggattgcggcttttttagcgggtatttcgttcagctttatgacgtggccgatcttgctgattattgcggctattgcgttgctggctattggcatttatctgcttatcaagcattgggataccatcaaagcggccatcatgaacaccacggcctttaaggtggtggcggcctatgtgaaatgggtcggcgggatattcagcgcggtctgggattggattgccgagggctggaataatctgtgcaactggttcagcagtttttcactggcggacaccttttccggcatggttgacggcctcagtaatatcttcggcggtttatgggattggctgaaaggatcgttcagcgatacctataactggattgtcgataaattaaattaccttccgggcatcaatattgaaacccaagccattgaaaagacggtgactgaaccgatgggaaaagtgacagcacccacgggggggatgggggaaaatacccagaaacttatcgcccagcctcatggcctcttgcagggacaacctcaagcgaggatacagcctgtaaaagccattaagccgccagaaacggagggcgtattaacgggcgggaaaaagcaggggatcggcaagcagggtctgatgaaagaagtgaccacgaattcacagaccctcacggataacagccgccgctttgaaaatgtaacattcaatgtcgccaacggcatgacgccggaacaattaacggaatgggagcatgtggcttatggatgagcctaaatacattgatttattgatcaccgagggtagcttcacgctgaactcagggaatgagccgcgattttgccataaccgcatttccattggtcaggactgtgtgcatgccattatggaaagcgggctggctacggagcttgttgccgaacgcagcccgacactgcgcgcggatattcgtacccagatagaaattctggttgaagacgatgagcggattattccgggcacggtcatcattaacgaagaaacgccgacccagttatggatcacggctgagacgtatgattttggccgcctgaatgtgagtgtgggacatggacactaaaccgacgattgattacgagaaagtgctgcgtgatagcgggatgccgaccacggaaaccgacatcagcgccgcgttcgccaccgtcgtggatgaagccgggctgattaccaacacgtctcggatgtccccgttctggcggttgattaacacgattgtgacgcggcctgtgttatggctgaaagaggcgctaatcaacgtgacgttaaaaaatatgtatctggcgaccgcagcgggggcatggctggatatgttcgcatggggcgtcaacctgaaacgcaagcctgcaacagcggcacagggggttattcgcttctataaagccgcaggtgcatcggcggtgacggtgcctgccggaacggttatccagactgagcgcattaatggcgaaatctatcgtgtcagcaccacagaaagcggggttatggcggaaggcgttacccgtgctttacttccggtaaccgccgatgctacagggggcgcctttaatctggctccgggctattttcgcctcctgcccgtggccgtgtccggtattgaacgggtacaaaatgaggaaggctggttattgacgcccggcgcggatgctgaaagtgatgatgatttgcgcgaccgttgccgcaaccaatataacttggtggggaattatcacacggacgcggtttatcgggggatgattgccactgttgcaggcttgagcattgaccgtattttcttcctgcatgacgcgccccgtggcgcgggaaccgccaatgcgtatttattactggattcgggcgtcatcagccagccgtttattgaggcggtgaacgattacatcaccaatcaggggcatcatgggcacggggatgatatgcagtgtttgccgatgccggaaacccatcatgcgctgaccgtgacactctttgtcgggcacttggcgaactacagtcaggaacagatagccagactgaaaacagacgtgggcaaccttattcgctgcgcttttcgggaaaacactgattatccagtgaagaaaacatggccgtactcgcgtttttctttttccaacttgggacgcgagatacaccgcgaattcagcgagattgaatctctgactttttcattgggtgacatcctcagtgagttgagtgtgccacggctgcaatcgctgtcggtggaggtgaaggatgtctgaattcagggaacgcctgaaacggctggcgctgccctcatggatggataagggggagcctgccaagctgctccgtgcggcgcgggcattctggctaagtgtctatgactggctgacatggccgttggcacaactggacgcggaaacctgtgcagcggcgctcttgtcgatgctggcgtaccagcgggatatccagcgctttaacggcgaaccgctgccgttgtttcgcaagcgggtgaagtacgcctttatcaacgccagagacgcaggcagcatcgcaggtttcattgccatctttgagcgtctgggcgtgggctatgtcgaattgctggagcgccagccggaaattgattgggatgtgattatcctgcgcgtcagtgacggccagatagccgaaaatcccgatttgctgatgaacatcatccgtcagtatggccgcacctgccgccgctaccgttttgaagtgatcgcaaaaaatcaattactgatgcgtgtgggcagcgtgggcgcagattactgctgttattacgcggccatgccgatacagccattattgttaagagtggggcatctatcgggcgaatccgtctgtgagaatgcccgcttaaaggaaaatagcgcaccgaatgtgacctacggtgcctcattataaggaaataccatgtcttcagtaattacgacagactttgaaaaatggaaggcacaacagaccgcagcgggaaacccggtggtacttgatgaatttgtctttgcttacgtgccggatttagatcctgcgcaggccatcaatcgtgatgagaaattgcccgccgacaatcatattgtgcatcgtcaggcggtgaacaaaaccggactcgccagtgagaacgccgtggcctacagcgtcacgttgggaacggaagtgggcagttttgattttaactggattggtttgctcaactcggcttctggtgtgattggtatgatcacccatgcgccaacccagaagaaaatcaagacggcaaacggcttacagggcaatgtcctgacccgctcttttttactggagtttgaaggagcggccaaagagaccgccatcacgaccacggcggaaacatggcagattgattttactgcacggttgacgggcattgacgaaatgcaacgcctgataaatattgacagttacggcgaagcggcgtttttcggcgatggctttgctgtggtgcgccacggtgagcagtaccttgtaaaaaaagggctggcttatgtgggcggcttgcgtgggatgctggagtttgaccagacgcttaacagtcaacgcaatacccgtgtgtatgccgattttagttatcaggggaatcttgtcagtcagtggaaaaccgctgggcaaatcaccgtcgccaatgaattgcaaaattacatcgatgcggcagggtatccgcattatgtttttgcggttgccaatattgataataacggtgatatttcagatttgcgtcctaaagggacgttgagtgatcgtgaccttgctgaactggatgaagaattaggcaaggttaaacaagattatgcgcccaagaaatgggtagcgggtagtttcgcccgtggcgatgaatcatccgtcgtcattaaggggagttacccccgcgttaattttatgcaatccaatatcaacagtgattatttggcctttgaagcggattttaacagtgatacacgtgacctttatatgtatcgtcgggatgcacaaggtgacaatatttatgtcctcggatttcctaaaaaaatgggaatgctggctacgctggatgacattaatagcggtttggctgacaccaaagaattagcggaaaatgcagcaccaagggaatgggtggcagagggttttgcccgtgggaacgattcatccgttgttattcagggaaattatccccgcgttaattttatgcaatccaatagcaacagtgattatttggcgtttgaggcggcgtttaacagtgatacgcgtgatctctatttatatcgacggaatgcgcagggagacaatatttatgtcctcggatttcctaagaaaacagggatgctggctactttagatgacatttctgacggtctggcgggaacaaagcaagttgcagacaatgcggcgcccaagctgtgggtggctaacaattttgctcgtgggagcgattcaactgttgttattaaagggggctacccccgcgttaattttatgcaacccaatagcaacagtgattatttggcgtttgaagccgattttaacaatgatacgcctgacctctatttgtatcagagaaatgcacgaggtgacaatatttatgtcctcggattcccacaagaaacaggaacgttggctaggttagaggacatcactaaaagttcagcgctcaaatcaaatgatggatggtgggagtgtggtgatacaggaatgattgtccaatttggtacggtttcagtcggtgataatgaggttgtcaccgaaaaattcccggtcacattccctaataaatgtacgtcattggtcgttaccgcccgctcagaatcgaggaacgggggagctgatgtcttgtcggcctatggagtggctatcagtcaatcgcatatgcgggtgtcaatcagtactaatttttcggctgcaatcgcaggtgtcagtttcatcgcaatagggtattaatatgtacgtatacagtgctaaaacaaattcattttatccggttaagttgcagttacgttatattgatgccggttcttggccggatgacggtatagaagtcagtgaagaaacgtatcttgaattttcaacaccgccagaaggtaagatgttgattgctgacgatgatggcttgcccgtatgggcagatatcccgccccccacatcaaaggaattgcaacgcggtgcggaatccaaaaagcagcatttgataaagattgccaaagaaaaaattgatatttttcaggatgccgttgatttagggttggcgactgatgcagaaaaatcgacattaacccaatggcgccgctacagggtgctactcaaccgggtagattgtgctatcgcctctcatattgattggccggagcaaccagagtgatgcgatggcagcgtaaaaccctgcaactgtccccgaccctatcggggctatcggccgctatcgtgcctgtacacccgtttatttatggtgtcgggcagcaggcagacagtggcagttacttaagtccggccaacgcccttcattacctgtcaaataagctgatgggggctgagaacctgaacgccgttgtgctgatgatctgcgccaagacccacgatgaatttatgcagagcctcacgcaattttcatcggtgttaccgttgcccgtcttttttcaggtcacgcgcatggcaaaaaccgcagacagtctggcagcaaccaaaatgcaactgccgggcaaacagggcggcggtttaccgctgcctcaaccgctgtcaacatcgaccagccgcttggccgtcaatgcacaacggatagagcaggccaaagcccaagccagcgcgggcagtagtctggcgggattaaaatcacaattaagcgggtttaccacggcaagacagaacgccttgcaacacgtgacggataccttaaacgggatcaaggataaatcagcccgcgtctggacgttctccgggaaagggaacggcgcattgttggccgaaaagatgcacaaggacatccccgaacccgatgccgtttacacgttggcgacactgtttgtcggggatgacatcagcccgttagaaaggatgctatcgcatgagccagattatcaccctcgcccttgatggcgaggccatcccgttaaaaagcctgaccgtcacgccgtcgatgatgtttcaggatgctgaccaaagcggccagtcatccagcacggcggtggcagagcagggcattaaaccgaaagaattgcgcatcacggggattattccctttaccgaacagaagacctttgcccggctgtttgctctggcggaagccaaagagaacggcaacctgaaacgctaccgcgtcgccaacctgaccgcacaggccattaactttcgcatcgggacattcaccagtacccttgatgccagtaaggtagacggtaaacaggcctggcaggtcacatttaccttgcgggaacatttgtcggtgtccgaaaaacgcgatgcccgcgcagtcggcactattcagtccaagaaacagacaaggcagggagccggagccgccaaggaagaacccgaacagttaagctggtttgagcgtgaggtcttaaagccgattaatgacaaaataggggcagccgatgaaaccccttaaccgattgtcgttatccggtgatgccgttcatttggtcgatgccaatctcatgctggaactgtcatcctgtggccgggggtttatcacggcagagacgggcaccgattacaccggaaaactggtgaggctggatgtcggttacaccgatttaatattacgctggtttacgggctatgtggagcgctcgcagcctgcccagaacggctatcaacgcctgtttgtgcgtgagctggtcggcgtgtttgaccgattgtggccatgctcttttcagcatccgaccctgcgccagatgacggactggttgcaagcgcatagcggcttgacgttcaccttaccggatgcgccttatacggataagcctgtcccgcattacacgcataatggcacgggctatcagctattggcgagtctgggacaggttttttccattgaggactatatctggcagcagttgccggatgggtcggtttatctggggagctgggcgcattcgatgtttgccggaaagcccgtcaagatcccgaatgaattcagccaacatcagtccgcaggcaatgccatgaccctgcccatgatccaatccctgcgccccggcgtggtggtcaatcagcagcggctgaacaaggtcaacctgaacaatgaaaatatggtcattacatgggaagccatcaacaaactgacaggccagccggaaagcaaaacgccgatgcagcgccagattgacgccgcttaccccgaattatcggccgggctgcatttgcctcaattcgcccgtattgaagcacacaccgaaaacacggccagcggcgatatctccgatcccttccggccgcgctatgccgttgatgtgcaattgctggatgatgacggaagagacgccgccgcccctgtttaccgtgccgttccgctgcccctgccgatggcgggcggtgaagcgggcatgttccagtatccgcctatcggtacgcgggttgagattgctttcgaaggtggacgcccggacaagccgtttatccgccaaacgttgagtcagggcaataccctgcccgatatcaagcccggtgaacaattgcagcaacagcgggcggaagtctcgcagcgggtgacgcaggaggggagctggattaggcagactgaccagaccattaatgaatcgtccatgcaccgtgaagtcagggcagacacggaaactcgcaccgtcgttgcacgggaaaccacggtacaggccacggataaaactacggtcttgggaacgtctaccttactggcgggcgctatccagcaggtgacagacggcgaccacagtctggcctcatcgaactacctcgccagcgtggggaaagacgccactatcgacgtcggccagaaactgattgagaaaatcggcttgcttaagcagagcattgccggagtaaagcaagagatagtcgcgcccgtggtgtgggtaggcagccagcaaatcaacgtcatgcaattgatgctagacacccttggcgtggtcaaggagttggccgaactgaccgccgcgcatacccatcacaacacaggtacaccggagaacgccagcgcgataaggaacacggctgataaatcggatggactgaaacagaaatattcgccagtgattgggtgaatatcgtttatttgtgtgagatcctctacgccataccataggttgatatttaatgctataggtattagactgacgatgttggcttgagaatgtcgcgctatagtcgaggctaccaaccacgtaaatagcactgtgaaagacgactcatcaaaagtaaaaacaaaaaaaccaacctcaccagttggtttttttgtttcttcctatctatcacgttaattgattgaatgattttaaaatcaacttataatctactctgttggttagacaagcgaactggccgcgcgcagtatatatagaagaaaaggaattcagcgtcttgctaatttgcgggacgtattaaagccctggctgagtacaggtggtgctggctcagtgccttggccagggcgcgccattctcaagccaacgctgatgaaagccaaccggacaggcagtgtaaaggcaacggttgggtaaatcgcgctccctaaatgaggagcaagcggatgaaagcattcaaaggctttattgacactgctatcatcgttctcaaagctttagttgcgcttttagaattgatccgtgcatttttgtaatagataacggaaacgtagctgaggccatcgggttaaccccccgatggccttacatttactgctcacgatcaagcccactgaggcttataattttctacctctccacaaacgtaatcagacacacacagcaccattcactcatcaactcactgaccatctgtgtttaatttggatcgcgtccctgcatcgctcctatgctgcacaatccccacgaaataaacgtaaacctgacgtaaaacgcactacaccgcacccgcctgcacgttttggatcaaaaaattatttcagttttaaaatccgacaaagggaaccgccagagcgcgccagcacaggcggcgtgagagaaatcgcaaattgaaaagtgtgaaaagattttcaggaaatttcagtttttggatcaaaggtggatcgcggggaagacatcactacattgatattaaagaaaaaattctattttacgtgggttaatggatcaaagggcaaagccgcatcatgttaaagggttcagtggtggtacggctttgaagaggaagcgatactgaaatttattgcattaatgagtgattactatggttatcgttttctgcgtgtacgactctgattgtataagcgaactcaatagctttgaaagagggagcatcctatcgccactttatcgccacttattacaatagtctaaaaaatacctctacaatctcaatataattaattgttttttaagtagttaaatacaaaccccactccaagtacttgacaaataaagttacttgaatactttgctcgtttctttgctcatgctctacttccacctgatatcagttacaacaaaaaaaccctgtacatccaaataccgacccaaactcacttataatactggataaaaaaccagcttcaagtgagttaataaaataatattgtttttattgcaaaggaagcatgtcgagttttggtaaaagaaaccaaaataaccttatcgtgatattaacttttaattaacacccgacgtgactatttttatccccagatatttgttttggtttttcccatttttgtattagcgactgaaatgatatagcactgaatcacaaaggcgagctgaaagggattgattttatataatcaactgattctgataaaaaaaatatcagaggagagaataacagcaaatcttgcgcaggccgcgtattatcttgtgtgagaggacttttataaaacgtaatgcacaaggttctccccgggctcttgtggntcgggctaacgagcgtttt
